(12) United States Patent
Jaffe

(10) Patent No.: US 11,807,563 B2
(45) Date of Patent: Nov. 7, 2023

(54) FEAMMOX ACTIVITY IN BIOELECTROCHEMICAL REACTORS

(71) Applicant: The Trustees of Princeton University, Princeton, NJ (US)

(72) Inventor: Peter R. Jaffe, Princeton, NJ (US)

(73) Assignee: THE TRUSTEES OF PRINCETON UNIVERSITY, Princeton, NJ (US)

( * ) Notice: Subject to any disclaimer, the term of this patent is extended or adjusted under 35 U.S.C. 154(b) by 155 days.

(21) Appl. No.: 17/280,501

(22) PCT Filed: Sep. 27, 2019

(86) PCT No.: PCT/US2019/053478
§ 371 (c)(1),
(2) Date: Mar. 26, 2021

(87) PCT Pub. No.: WO2020/069327
PCT Pub. Date: Apr. 2, 2020

(65) Prior Publication Data
US 2022/0032349 A1 Feb. 3, 2022

Related U.S. Application Data

(60) Provisional application No. 62/855,208, filed on May 31, 2019, provisional application No. 62/792,971, (Continued)

(51) Int. Cl.
*C02F 3/34* (2023.01)
*B09C 1/10* (2006.01)
(Continued)

(52) U.S. Cl.
CPC ............... *C02F 3/342* (2013.01); *B09C 1/10* (2013.01); *C02F 11/02* (2013.01); *C02F 2101/36* (2013.01)

(58) Field of Classification Search
CPC .. C02F 3/342; C02F 3/346; C02F 3/34; C02F 3/005; C02F 3/305; B09C 1/00; B09C 1/002; B09C 1/10
See application file for complete search history.

(56) References Cited

U.S. PATENT DOCUMENTS 8,932,848 B2 * 1/2015 Cantwell ............... C01B 21/02
423/239.1
8,932,849 B2 * 1/2015 Scherson ............... C01B 21/02
423/239.1
(Continued)

FOREIGN PATENT DOCUMENTS

CN 105271514 A * 1/2016
CN 107098459 A 8/2017
(Continued)

OTHER PUBLICATIONS

International Search Report and Written Opinion corresponding to PCT/US2019/053478, dated Feb. 6, 2020, 11 pages.
(Continued)

*Primary Examiner* — Frederick L Lagman
(74) *Attorney, Agent, or Firm* — J. Clinton Wimbish; Maynard Nexsen PC

(57) ABSTRACT

Microbial reactors are provided for ammonium oxidation. Briefly, a reactor comprises a medium including an ammonium component and a Feammox bacterium and/or enzyme (s) thereof capable of oxidizing ammonium with electron transfer to an anode in contact with the medium. As described further herein, use of the anode as an electron acceptor can mitigate or overcome the disadvantages associated Fe(III) acceptor. In some embodiments, for example, ammonium oxidation in the reactor can proceed in the absence of Fe(III) and/or other metal compounds operable to function as an electron acceptor in the medium. Moreover,
(Continued)

the medium may further comprise one more contaminants in addition to the ammonium component.

16 Claims, 12 Drawing Sheets

Specification includes a Sequence Listing.

Related U.S. Application Data filed on Jan. 16, 2019, provisional application No. 62/737,255, filed on Sep. 27, 2018, provisional application No. 62/737,322, filed on Sep. 27, 2018.

(51) Int. Cl.
*C02F 11/02* (2006.01)
*C02F 101/36* (2006.01)

(56) References Cited

U.S. PATENT DOCUMENTS

| | | | | |
|---|---|---|---|---|
| 9,815,723 B2 * | 11/2017 | Jaffe | | C02F 3/341 |
| 10,479,712 B2 * | 11/2019 | Jaffe | | C02F 3/341 |
| 2015/0321933 A1 * | 11/2015 | Jaffe | | C02F 3/341 |
| | | | | 435/262.5 |
| 2018/0029909 A1 * | 2/2018 | Jaffe | | C02F 3/341 |
| 2020/0277211 A1 * | 9/2020 | Jaffe | | C02F 3/342 |
| 2021/0340042 A1 * | 11/2021 | Jaffe | | B09C 1/10 |

FOREIGN PATENT DOCUMENTS

| | | | |
|---|---|---|---|
| CN | 107555616 A | * | 1/2018 |
| KR | 100193917 B1 | * | 6/1999 |

OTHER PUBLICATIONS

Ruiz-Uriguen et al., Feammox Acidimicrobiaceae bacterium A6, a lithoautotrophic electrode-colonizing bacterium, Authors Manuscript, Apr. 14, 2018 [retrieved on Jan. 9, 2020]. Retrieved from the Internet: <URL:https://www.biorxiv.org/content/10.1101/300731v1.full.pdf>. pp. 1-30.

Kochunarayanan, Biodegradation Potential of Perfluorooctanoate and Perfluorooctane Sulfonate, Thesis Submitted to the Office of Graduate Studies of Texas A&M University, Aug. 2011 [retrieved on Jan. 9, 2020). Retrieved from the Internet: <URL:http://oaktrust.library.tamu.edu/bitstream/handle/1969.1/ETD-TAMU-2011-08-10177/THELAKKAT-KOCHUNARAYANAN-THESIS.pdf?sequence=2&isAllowed=y>, pp. 1-37.

* cited by examiner a.

b.

FEAMMOX ACTIVITY IN BIOELECTROCHEMICAL REACTORS

RELATED APPLICATION DATA

This application is a U.S. National Phase of PCT/US2019/053478, filed Sep. 27, 2019, claims priority pursuant to 35 U.S.C. § 119(e) to U.S. Provisional Application Ser. Nos. 62/737,255 and 62/737,322 filed Sep. 27, 2018, U.S. Provisional Patent Application Ser. No. 62/792,971 filed Jan. 16, 2019, and U.S. Provisional Patent Application Ser. No. 62/855,208 filed May 31, 2019, each of which is incorporated herein by reference in its entirety.

FIELD

The present application relates to systems and methods for environmental remediation and, in particular, to reactors operable for ammonium oxidation via Feammox. The Sequence Listing titled "Sequence Listing," having a file size of 2,867,945 bytes, created on Sep. 29, 2017 and filed herewith is incorporated herein by reference as if fully set forth.

BACKGROUND

Ammonium ($NH_4^+$) is a common compound that can accumulate in soil and water, and it is found in high concentrations in agricultural runoffs and wastewaters as result of its extensive use as fertilizer in crops and because it is a waste product of cellular and animal metabolism. High concentration of $NH_4^+$ can be detrimental for the environment, particularly to water systems. Therefore, nitrification, which is the conversion of $NH_4^+$ to nitrite ($NO_2^-$) and nitrate ($NO_3^-$), is a key step to decrease eutrophication and to lower the demand of dissolved oxygen (DO) in the receiving waters. Low DO puts aquatic biodiversity under pressure, and it is a main cause of general deterioration of ecosystems.

Engineered systems such as wastewater treatment plants (WWTP) or constructed wetlands harness nature's ability to oxidize $NH_4^+$. However, nitrification is energetically intensive as it requires oxygen inputs, which can account for more than 50% of the energy usage in WWTPs invested in the operation of aerators. Therefore, an important goal in wastewater treatment is to oxidize $NH_4^+$ without aeration. Efforts to decrease the oxygen requirements have been done by implementing Anammox in some WWTPs. Anammox oxidizes $NH_4^+$ anaerobically by coupling it to $NO_2^-$ reduction, nonetheless, partial aeration is still required to form the needed $NO_2^-$. Feammox is another $NH_4^+$ oxidation pathway that has the exceptional ability to do it completely under anoxic/anaerobic conditions, thus it does not require aeration like conventional systems, which makes it an attractive candidate for the development of a new form of energy efficient $NH_4^+$ removal. However, it requires iron oxides [Fe(III)] as electron acceptors in a stoichiometric ratio of 6:1, i.e. 6 moles of Fe(III) per 1 mole of $NH_4^+$ oxidized (Equation 1).

$$NH_4^+ + 3Fe_2O_3 \cdot 0.5H_2O + 10H^+ \rightarrow NO^- + 6Fe^{2+} + 8.5H_2O \quad (1)$$

Iron is abundant in the environment and thus Feammox can be enhanced in systems such as constructed wetland as a method to treat some types of wastewater. However, adding Fe(III) to WWTPs is technically inconvenient because iron build-ups are bulky and its removal and disposal is burdensome.

SUMMARY

In view of these disadvantages, microbial reactors are provided for ammonium oxidation. Briefly, a reactor comprises a medium including an ammonium component and a Feammox bacterium and/or enzyme(s) thereof capable of oxidizing ammonium coupled with electron transfer to an anode in contact with the medium. As described further herein, use of the anode as an electron acceptor can mitigate or overcome the disadvantages associated Fe(III) acceptor. In some embodiments, for example, ammonium oxidation in the reactor can proceed in the absence of Fe(III) and/or other metal compounds operable to function as an electron acceptor in the medium. Moreover, the medium may further comprise one more contaminants in addition to the ammonium component.

In another aspect, methods of environmental remediation are described herein. A method of environmental remediation comprises providing a reactor comprising a medium including an ammonium component and a Feammox bacterium and/or enzyme(s) thereof, wherein an anode is in contact with the medium. Ammonium in the medium is oxidized by the Feammox bacterium and/or enzymes thereof coupled with electron transfer to the anode. In some embodiments, the ammonium oxidation proceeds in the absence of Fe(III) and/or other metal compounds operable to function as an electron acceptor in the medium. When present in the medium, other contaminants can also be degraded by the Feammox bacterium and/or enzymes thereof.

These and other embodiments are described further in the following detailed description.

DETAILED DESCRIPTION

Figure 1:
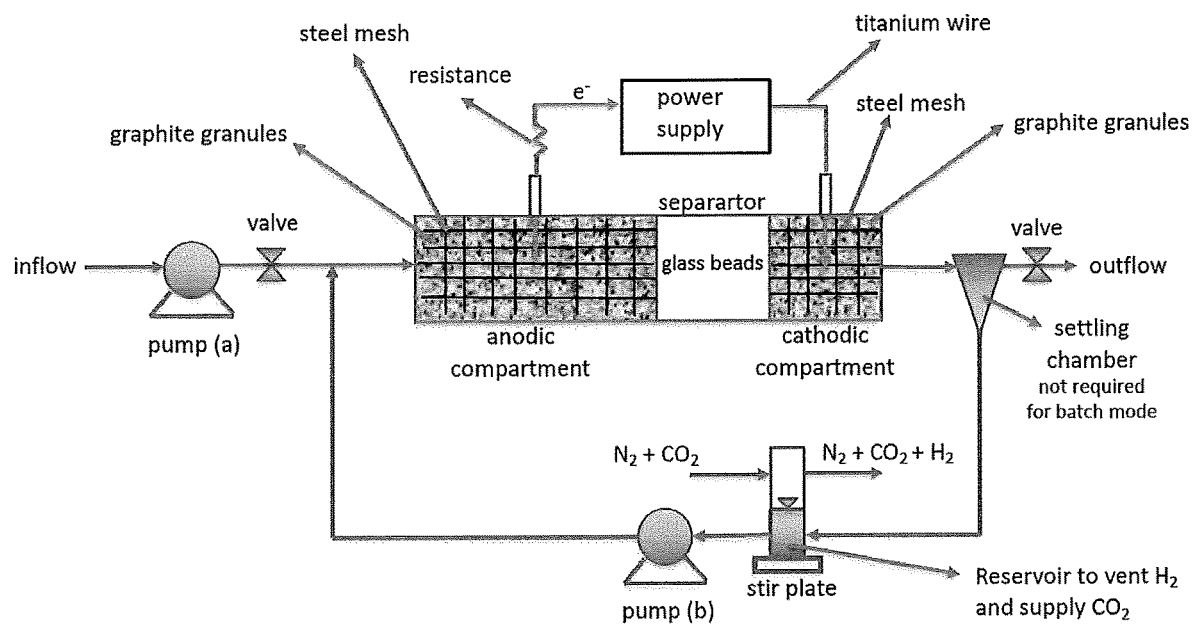
FIG. 1 is a schematic of a reactor according to some embodiments.

Certain terminology is used in the following description for convenience only and is not limiting. The words "right," "left," "top," and "bottom" designate directions in the drawings to which reference is made. The words "a" and "one,"

as used in the claims and in the corresponding portions of the specification, are defined as including one or more of the referenced item unless specifically stated otherwise. This terminology includes the words above specifically mentioned, derivatives thereof, and words of similar import. The phrase "at least one" followed by a list of two or more items, such as "A, B, or C," means any individual one of A, B or C as well as any combination thereof.

"Synthetic nucleic acid sequence," "synthetic polynucleotide," "synthetic oligonucleotide," "synthetic DNA," or "synthetic RNA" as used herein refers to a nucleic acid, polynucleotide, oligonucleotide, DNA, or RNA that differs from one found in nature by having a different sequence than one found in nature or a chemical modification not found in nature. The definition of synthetic nucleic acid includes but is not limited to a DNA sequence created using biotechnology tools. Such tools include but are not limited to recombinant DNA technology, chemical synthesis, or directed use of nucleases (so called "genome editing" or "gene optimizing" technologies).

Embodiments described herein can be understood more readily by reference to the following detailed description and examples and their previous and following descriptions. Elements and apparatus described herein, however, are not limited to the specific embodiments presented in the detailed description. It should be recognized that these embodiments are merely illustrative of the principles of the present invention. Numerous modifications and adaptations will be readily apparent to those of skill in the art without departing from the spirit and scope of the invention.

In one aspect, microbial reactors are provided for ammonium oxidation. A reactor comprises a medium including an ammonium component and a Feammox bacterium and/or enzyme(s) thereof capable of oxidizing ammonium coupled with electron transfer to an anode in contact with the medium. In some embodiments, for example, ammonium oxidation in the reactor can proceed in the absence of Fe(III) and/or other metal compounds operable to function as an electron acceptor in the medium.

Turning now to specific components, the medium contained in the reactor comprises an ammonium component. The ammonium component can comprise ammonium and/or compound(s) comprising ammonium. Ammonium containing compounds, for example, can comprise fertilizers, domestic sewage, or industrial effluents. The ammonium component may comprise ammonium chloride and/or any other ammonium salt. The ammonium component may also be a nitrogen containing organic compound, wherein nitrogen may be hydrolyzed to ammonium.

The medium also comprises a Feammox bacterium and/or enzyme(s) thereof capable of fluorochemical degradation in conjunction with oxidation of ammonium and electron transfer to the electron acceptor, such as the anode. The Feammox bacterium may be an Actinobacterium or a bacterium with a similar genetic composition. In some embodiments, for example, the Feammox bacterium is an *Acidimicrobiaceae* bacterium or variant thereof. The Feammox bacterium may be a bacterial strain that was isolated from wetland soils collected in New Jersey after a series of enrichment incubations. The soil samples were collected at the location identified as 40° 15' N–74° 30' W or within 100 m of the identified location. The Feammox bacterium may be the bacterial strain designated the *Acidimicrobiaceae* Feammox bacterium A6 or variant thereof. In being a variant in some embodiments, the bacterium may have at least 70% genome overlap with an Actinobacterium. The *Acidimicrobiaceae* Feammox bacterium A6 was submitted for deposit with the American Type Culture Collection (ATCC; 10801 University Blvd. Manassas, Va. 20110-2209, USA) on Apr. 27, 2015, the submission was supplemented on May 7, 2015, and was assigned Accession Deposit Number PTA-122488 on Sep. 17, 2015. The *Acidimicrobiaceae* Feammox bacterium may have a genome comprising, consisting essentially of, or consisting of a nucleic acid sequence with at least 70, 72, 75, 80, 85, 90, 91, 92, 93, 94, 95, 96, 97, 98, 99, or 100% identity to SEQ ID NO: 1. The Feammox bacterium may have the genome size of 3.3 mega base pairs (Mb) and guanine-cytosine content 52%. The bacterial genome may further include a gene encoding a Feammox Ammonium Monooxygenase. As used herein, the term "Feammox Ammonium Monooxygenase" (FMO) refers to an enzyme that plays a key role in oxidizing ammonium coupled with ferric iron reduction. The FMO also refers to genes encoding clones or different variants of the Feammox Ammonium Monooxygenase. The gene may include a nucleic acid comprising, consisting essentially of, or consisting of a nucleic acid sequence with at least 70, 72, 75, 80, 85, 90, 91, 92, 93, 94, 95, 96, 97, 98, 99, or 100% identity to a sequence selected from the group consisting of: SEQ ID NOS: 8-28. The Feammox Ammonium Monooxygenase may include an amino acid comprising, consisting essentially of, or consisting of a nucleic acid sequence with at least 70, 72, 75, 80, 85, 90, 91, 92, 93, 94, 95, 96, 97, 98, 99, or 100% identity to a sequence selected from the group consisting of: SEQ ID NOS: 29-49. The Feammox bacterium may be live or lyophilized.

| SEQ ID NOS of FMO Related Enzymes and Genes | | |
|---|---|---|
| FMO clone* | SEQ ID NO (Gene) | SEQ ID NO (Enzyme) |
| ERCFMO_0001 | 8 | 29 |
| ERCFMO_0002 | 9 | 30 |
| ERCFMO_0003 | 10 | 31 |
| ERCFMO_0004 | 11 | 32 |
| ERCFMO_0005 | 12 | 33 |
| ERCFMO_0006 | 13 | 34 |
| ERCFMO_0007 | 14 | 35 |
| ERCFMO_0008 | 15 | 36 |
| ERCFMO_0009 | 16 | 37 |
| ERCFMO_0010 | 17 | 38 |
| ERCFMO_0011 | 18 | 39 |
| ERCFMO_0012 | 19 | 40 |
| ERCFMO_0013 | 20 | 41 |
| ERCFMO_0014 | 21 | 42 |
| ERCFMO_0015 | 22 | 43 |
| ERCFMO_0016 | 23 | 44 |
| ERCFMO_0017 | 24 | 45 |
| ERCFMO_0018 | 25 | 46 |
| ERCFMO_0019 | 26 | 47 |
| ERCFMO_0020 | 27 | 48 |
| ERCFMO_0021 | 28 | 49 |

In some embodiments, Feammox bacteria and related enzymes are described in U.S. Pat. No. 9,815,723 which is incorporated herein by reference in its entirety.

Determining percent identity of two nucleic acid sequences may include aligning and comparing the nucleotides at corresponding positions in the two sequences. If all positions in two sequences are occupied by identical nucleotides then the sequences are said to be 100% identical. Percent identity may be measured by the Smith Waterman algorithm (Smith T F, Waterman M S 1981 "Identification of Common Molecular Subsequences," *J Mol Biol* 147: 195-197, which is incorporated herein by reference as if fully set forth).

As described herein, the medium may comprise one or more enzymes, such as FMO, in addition to the Feammox bacterium for the oxidation of ammonium coupled with electron transfer to the electron acceptor. Alternatively, one or more enzymes, such as FMO, can be present in the medium in the absence of the Feammox bacterium. In such embodiments, the one or more enzymes can be responsible for ammonium oxidation and electron transfer. In some embodiments, for example, FMO is isolated from Feammox bacterium and employed in the medium. In other embodiments, the one or more enzymes may be fabricated via synthetic chemical techniques.

The reactor also comprises an anode in contact with the medium. The anode can serve an as electron acceptor in the ammonium oxidation process. By serving as an electron acceptor, the anode can partially or completely replace one or more metals in the medium that function as an electron acceptor in the ammonium oxidation process. For example, the anode can partially or fully replace Fe(III) in the medium. Accordingly, the ammonium oxidation reaction involving the Feammox bacterium and/or enzyme(s) thereof can proceed in the absence of iron, thereby mitigating or overcoming disadvantages of prior processes requiring the presence of iron and/or other metal. The anode can be constructed of any material(s) consistent with the ammonium oxidation processes described herein. In some embodiments, the anode comprises metal or alloy. Alternatively, the anode can be constructed of an electrically conductive non-metallic material. For example, the anode can comprise electrically conductive carbon. In some embodiments, the electrically conductive carbon comprises graphite. The anode may also exhibit various morphologies. The anode, in some embodiments, may be monolithic in nature. Alternatively, the anode may be particulate. Graphite particles, for example, can form all or part of the anode. In some embodiments, a metal or alloy cage can contain the particulate material and form part of the anode. Particulate material of the anode can have particle size, surface area, packing characteristics and/or porosity advantageous for contacting or otherwise interacting with the medium. The Feammox bacterium can colonize the anode, in some embodiments. In such embodiments, the Feammox bacterium can transfer electrons directly to the anode. Electron transfer to the anode can result from oxidation of the ammonium in the medium.

The reactor, in some embodiments, comprises an anodic compartment in which the medium is disposed. The anodic compartment, for example, can be filled with anodic material, such as graphite. In some embodiments, metal or alloy mesh can be employed with the anodic material to reduce electrical resistivity of the anodic compartment. Metal or alloy mesh can be particularly useful when the anodic material is particulate and/or an electrically conductive non-metallic material. When in liquid form, the medium may be passed over and/or through the anodic compartment. The reactor may also comprise a cathode or cathodic compartment. The cathode or cathodic compartment can be separated from the anode or anodic compartment by a separator. The separator can comprise any electrically insulating material. In some embodiments, for example, the separator is glass. The glass separator may be provided in particulate or bead form to permit flow of the medium from the anodic compartment to the cathodic compartment. FIG. 1 is a schematic of a reactor according to some embodiments.

In some embodiments, a potential can be applied to the anode and cathode of the reactor. In other embodiments, no potential is applied to the anode and cathode, and the electron transfer process occurs under natural redox potential gradients. In some embodiments, the anode and cathode can be placed directly in a contaminated environment, such as soil, sediments, and/or wetlands, and methods described herein occur under natural redox potential gradients. The anode and cathode, for example, can be placed in different zones of the medium in the natural habitat to effectuate methods described herein. Accordingly, methods described herein can be practiced in situ of contaminated environment and/or within compartments of a constructed reactor.

The reactor may be a continuous reactor or a batch reactor. In an embodiment, a reactor may be an industrial-type reactor. The reactor may operate within a water treatment plant. The reactor may be a treatment pond or a reservoir. The reactor may be a tank for wastewater storage.

Reactor conditions may generally include a temperature in a range from 4° C. to 35° C. The temperature may be in a range between any two integer value temperatures selected from 4° C. to 35° C. The temperature may be in a range between and including 4° C. to 10° C., 10° C. to 15° C., 15° C. to 20° C., 20° C. and 25° C., 25° C. and 30° C., 30° C. and 35° C. The temperature may be any one integer value temperature selected from those including and between 4° C. and 35° C. or 15° C. to 35° C. Temperatures between room temperature and 40° C. may be used. The temperature may be any one temperature including and between room temperature and 35° C. Temperatures between 20° C. and 35° C. may be used. The temperature may be any temperature including and between 20° C. and 25° C.

The reactor may be operated for any desired time period. In some embodiments, the reactor is operated for a time period ranging from 2 hours to 45 days. The time period may be 5 hours, 10 hours, 15 hours, 20 hours, 1 day, 2 days, 3 days, 4 days, 5 days, 10 days, 15 days, 20 days, 25 days, 30 days, 35 days, 40 days or 45 days. The time period may be any one integer value selected from those including and between value points, endpoints inclusive. The time period may be greater than 45 days. The time period may be less than 1 day. In continuous flow reactors or in batches, the process may last from several hours to several months. For continuous flow reactors, the time period may depend on the bacterial concentration in the inoculum. Higher bacterial concentration in the inoculum may result in a shorter remediation time. The time period may depend on hydraulic retention capacity of a continuous flow reactor. Lower retention capacity of the continuous flow reactor may result in a shorter remediation time. Hydraulic residence time for the continuous flow reactors may be from 3 hours to 4 hours, from 3 hours to 5 hours, from 3 hours to 6 hours, from 3 hours to 7 hours, from 3 hours to 8 hours, from 3 hours to 10 hours, from 3 hours to 15 hours, from 3 hours to 20 hours, from 3 hours to 1 day, from 3 hours to 2 days, from 3 hours to one or several weeks. Hydraulic residence time may be any integer value selected from those including and between value points, endpoints inclusive.

pH of the medium in the reaction can range from 2.0 to 9.0. The pH of the medium may be in a range between and including 2.0 and 3.0, 3.0 and 4.0, 4.0 and 5.0, 5.0 and 6.0, 6.0 to 7.0, 7.0 to 7.5. The pH may be any one integer value pH selected from those including and between 2.0 and 7.5. The pH may be any pH including and between 4.0 and 7.0.

Figure 2:
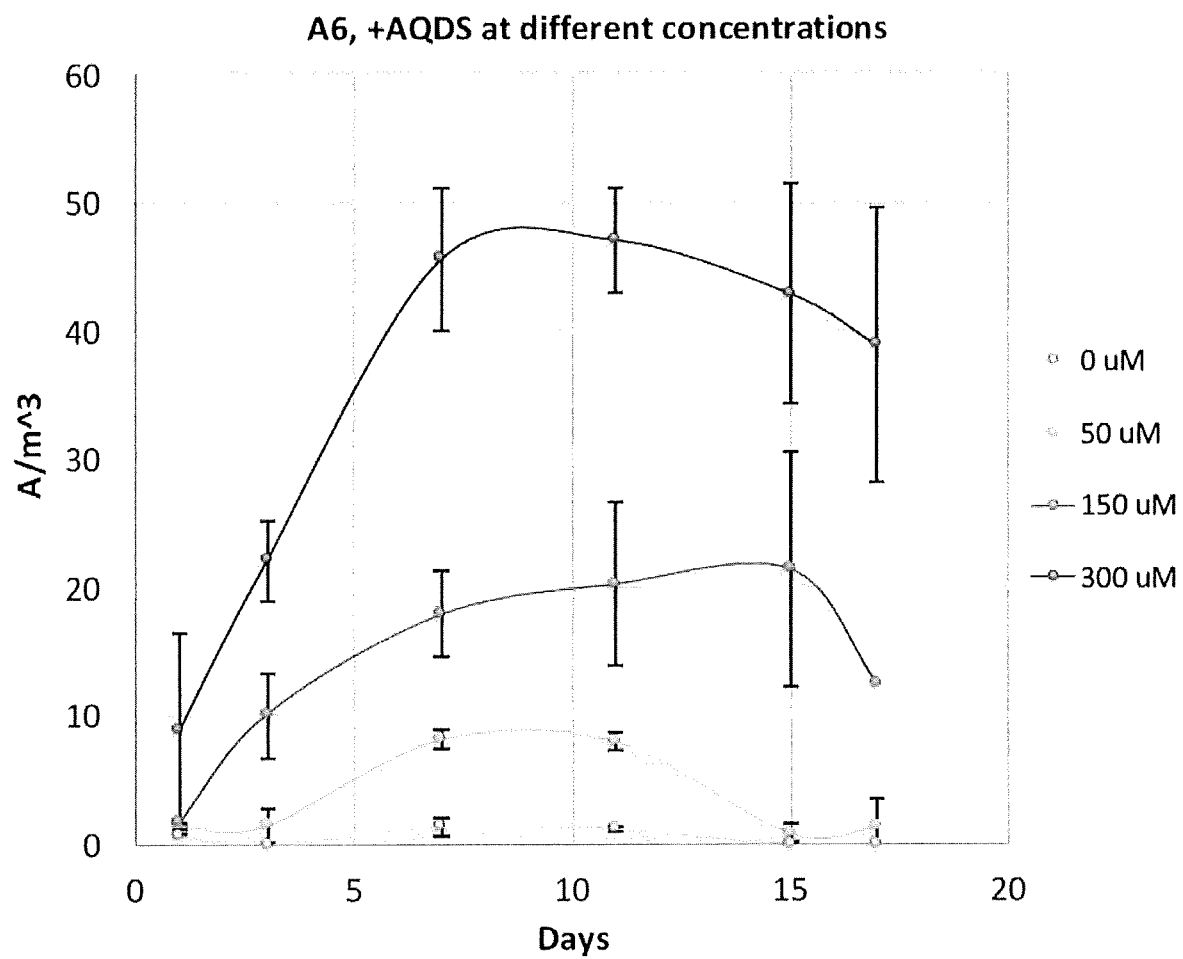
FIG. 2 illustrates current density of a reactor relative to AQDS concentration according to some embodiments.

In some embodiments, the medium further comprises one or more electron shuttling compounds. Any electron shuttling compound consistent with the objectives of ammonium degradation can be used. In some embodiments, an electron shuttling compound is 9,10-Anthraquinone-2,7-disulphonic acid (AQDS). As discussed further herein, the electron shuttling compound can enhance the ammonium oxidation process and/or degradation of other contaminant species in the medium. Presence of the electron shuttling compound can result in higher current densities produced by the reactor. FIG. 2 illustrates current density of a reactor relative to AQDS concentration according to some embodiments. The electron shuttling compound can be present in the medium in any desired amount. In some embodiments, the electron shuttling compound is present in an amount of 10 μg/l to 1 mg/l. In some embodiments, an electron shuttling compound, such as AQDS, can serve as the electron acceptor, thereby permitting the oxidation of ammonium to proceed in the absence of the anode and/or other electron acceptor.

The medium, in some embodiments, further comprises one or more chemical species operable to inhibit or preclude accumulation of nitrite ($NO_2^-$) in the medium. Accumulation of nitrite can retard Feammox processes. Therefore, removal of nitrite from the medium can assist in efficient functioning of the reactor. The medium, for example, can include a denitrifier and suitable electron donor, such as organic carbon or elemental sulfur, to effectuate nitrite removal. Additionally, $CO_2$ is added to the medium, in some embodiments. Presence of $H_2$ in the medium can result in the Feammox bacterium consuming $H_2$ instead of ammonium. Accordingly, $CO_2$ is added to the medium and/or atmosphere surrounding the medium to remove $H_2$ and to provide a carbon source. In some embodiments, for example, $CO_2$ is added via a $N_2$:$CO_2$ flush of the medium and surrounding environment. $N_2$ and $CO_2$ can be present in any desired ratio. In some embodiments, $CO_2$ can be derived from other chemical species, such as bicarbonate. Additions of bicarbonate to the medium may require pH adjustment to the medium. Notably, degradation of organic compounds in the Feammox process can also produce $CO_2$. In such embodiments, $CO_2$ addition(s) to the medium may not be required. In some embodiments, $CO_2$ can be derived from the degradation of organic compounds.

The medium can further comprise one or more contaminants in addition to the ammonium component. In some embodiments, the one or more contaminants are selected from the group consisting of fluorochemicals, chlorinated volatile organic compounds, perchloroethylene (PCE), trichloroethylene (TCE), trichloroethane, dichloroethane, vinyl chloride, polychlorinated biphenyls, fuel constituents, benzene, ethylbenzene, toluene, xylene, phenanthrene, methyl tert butyl ether, tertiary butyl alcohol, polyaromatic hydrocarbons, and ethylene dibromide. One or more fluorochemicals selected from the group consisting of perfluoroalkyl compounds, polyfluoroalkyl compounds, fluorinated carboxylic acids, fluorinated alcohols, and fluorinated sulfonates. In some embodiments, the fluorochemical component comprises one or more compounds selected from Table I.

TABLE I

| Fluorochemicals |
| --- |
| Heptafluorobutyric acid (HFBA) |
| Perfluorooctanoic acid (PFOA) |
| 2,2,2-Trifluoroethyl Nonafluorobutanesulfonate (PFBS) |
| 6:2 Fluorotelomer sulfonate (6:2 FTS) |
| 8:2 Fluorotelomer Alcohol (8:2 FTOH) |
| Ammonium 4,8-dioxa-3H-perfluorononanoate (ADONA) |
| Perfluorobutanoic acid (PFBA) |
| Perfluorooctane sulfonamide (FOSA) |

TABLE I-continued

| Fluorochemicals |
| --- |
| Perfluorooctane sulfonate (PFOS) |
| Perfluoroheptane sulfonate (PFHpS) |
| Perfluorohexane sulfonate (PFHxS) |
| Perfluoropentanoic acid (PFHeA) |
| Perfluoroheptanoic acid (PFHpA) |
| Perfluorohexanoic acid (PFHxA) |
| Perfluoropentane sulfonate (PFPeS) |
| Pentafluoropropionic acid (PFPrA) |
| 6:2 Fluorotelomer alcohol (6:2 FTOH) |
| 8:2 Fluorotelomer phosphate diester (8:2 diPAP) |
| 8:2 Fluorotelomer sulfonate (8:2 FTS) |

Contaminant in addition to the ammonium component may also comprise one or more inorganic compounds. In some embodiments, an inorganic contaminant comprises uranium and/or selenium. Uranium and selenium, for example, are reduced via the Feammox process.

The medium can comprise water, soil or mixtures thereof. The water can be any source of water, including ground water, lakes, streams and/or reservoirs. In some embodiments, the water is wastewater. As used herein, the term "wastewater" refers to any water that has been adversely affected in quality by anthropogenic influence. Wastewater may be municipal wastewater, industrial wastewater, agricultural wastewater, surface runoff, landfill leachate, stormwater, or wastewater combining wastewater from multiple sources. Wastewater may be treated in a wastewater treatment plant. Similarly, soil may be any soil that has been adversely affected in quality by anthropogenic influence. The soil may include groundwater. The groundwater may comprise wastewater described herein.

In some embodiments, the medium may further comprise a carrier. The carrier may support growth of the Feammox bacterium. The carrier may comprise a filter, beads, agarized medium, or any surface that allows bacterial attachment. The carrier may include media for culturing the Feammox bacterium. The media may be inorganic $NH_4^+$-ferric iron media. The inorganic $NH_4^+$-ferric iron media may be solid media or liquid media. The liquid media may include but not limited to the following components: $NH_4Cl$, $(NH_4)_2SO_4$, $NaHCO_3$, $KHCO_3$, $KH_2PO4$, 100 mg $MgSO_4·7H_2O$, and $CaCl_2·2H_2O$. The liquid media may further include ferrihydrite, AQDS, trace element solution or vitamins Vitamins may be but are not limited to ATCC® vitamins. The liquid media may have a pH in a range from 4.0 to 5.0. The media may include traces of dissolved oxygen. The solid medium may have the same composition as the liquid media but include elements to solidify the mixture. The solid media may be solidified with 0.8% agar. The solid media may include ferrihydrite that is spread on the surface of the medium.

In another aspect, methods of environmental remediation are described herein. A method of environmental remediation comprises providing a reactor comprising a medium including an ammonium component and a Feammox bacterium and/or enzyme(s) thereof, wherein an anode is in contact with the medium. Ammonium in the medium is oxidized by the Feammox bacterium and/or enzymes thereof coupled with electron transfer to the anode. In some embodiments, the ammonium oxidation proceeds in the absence of Fe(III) and/or other metal compounds operable to function as an electron acceptor in the medium. When present in the medium, other contaminants can also be degraded by the Feammox bacterium and/or enzymes thereof.

Components of the medium, including the ammonium component, fluorochemical component, anode and Feammox bacterium and/or enzyme(s) thereof can have any properties and/or compositions described hereinabove. Moreover, the medium can comprise water, soil, sludge, sorbent porous materials, and/or any solid contaminated with the pollutants described herein. Water of the system can be any source of water, including wastewater, ground water, lakes, streams and/or reservoirs.

These and other embodiments are further illustrated by the following non-limiting examples.

Example 1—Feammox Reactor Employing Electrodes

Figure 3:
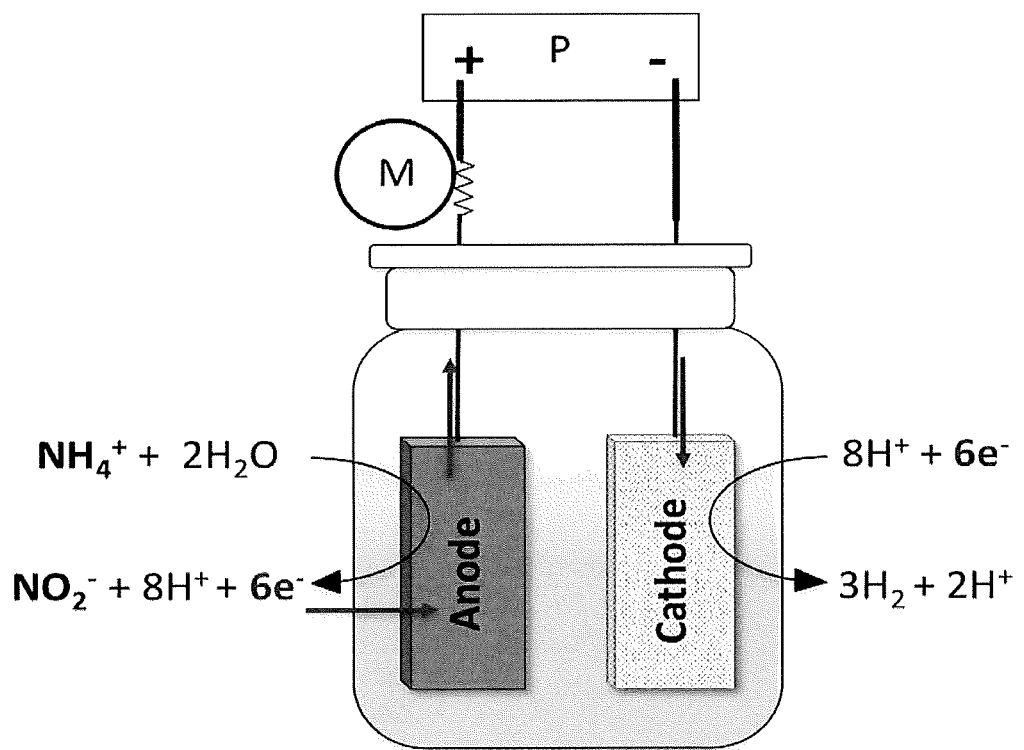
FIG. 3 is a schematic of a biotic Feammox-MEC according to some embodiments.
Figure 4:
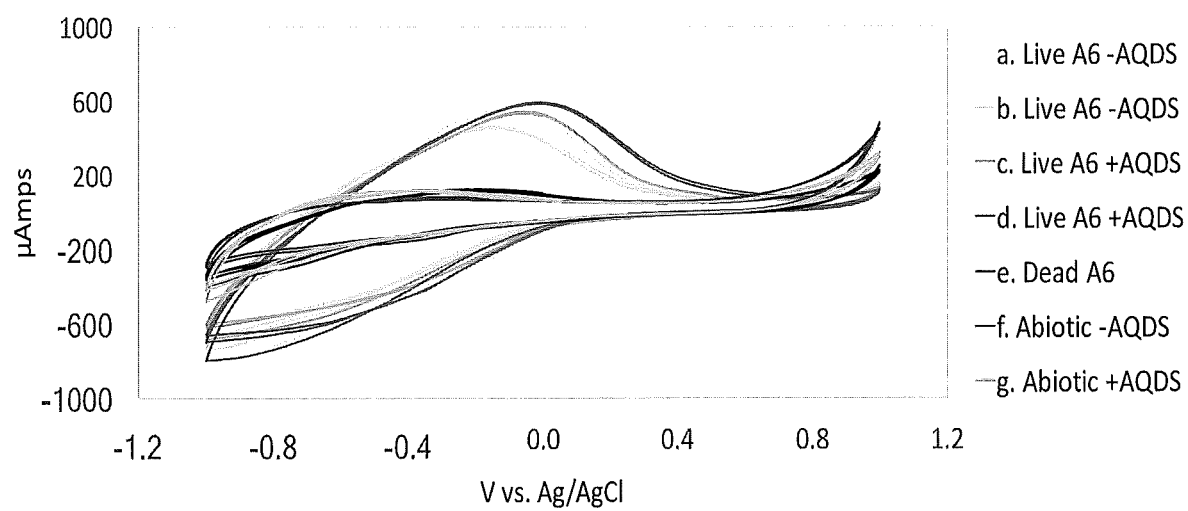
FIG. 4 are cyclic voltammetry scans for Feammox-MECs with and without Feammox bacterium and with and without electron shuttling compound according to some embodiments.

Cyclic voltammetry (CV) was performed on biotic Feammox-MECs in order to determine the optimal applied potential ($V_{app}$) for electron transfer process to the anode. FIG. 3 is a schematic of the Feammox MEC used in this Example. CV was also performed using MECs with dead (autoclaved) bacteria, and on blank abiotic controls. Each CV for the biotic and blank abiotic controls was performed with and without AQDS to determine if the added electron shuttle had any additional effect on the $V_{app}$. Results (FIG. 4) show that the optimal $V_{app}$ for all biotic Feammox-MECs containing AQDS was $-0.03\pm0.025$ V vs. Ag/AgCl (3.5 M KCl, +205 mV vs the standard hydrogen electrode, SHE), while for the experiments without AQDS the optimal $V_{app}$ was shifted slightly toward more negative values, $-0.11\pm0.035$ V vs. Ag/AgCl. Using these optimal $V_{app}$ to calculate the $\Delta G°$ for the reactions, using Nernst equation, results in $-59.77$ kJ/mol for the biotic reactors with AQDS, and $-15.34$ kJ/mol for the biotic reactors without AQDS.

Other studies on $NH_4^+$ removal using bioelectrochemical systems inoculated with sludge from wastewater treatment plants reported current oxidation peaks of 0.59 V vs Ag/AgCl and 0.53 V vs Ag/AgCl. The conditions used in those studies, such as pH of 7.7 (Feammox reaction requires acidic pH), and the associated microbial community, are different from the ones presented here. Therefore, the anaerobic $NH_4^+$ removal reported by those studies does not appear to be associated to the Feammox reaction. Similar oxidation peaks ($-0.08$ vs. Ag/AgCl) to the ones found for the Feammox-MECs have been reported for other bioelectrogenic system, but it is unknown to what type of exocelullar or extracellular electron transfer compounds it is associated with.

The CV on abiotic and dead controls did not show a peak near the oxidation peak for the biotic reactors. The controls showed a current peak at 1.00 V which is thought to be due to hydrogen evolution, a common electrochemical process in abiotic and biotic systems. Hydrogen evolution results from the hydrolysis of water, which takes place starting at 0.82 V. The amplitude of the voltagram on the reverse scans is believed to be due to a pseudocapacitance behavior of the system. Protons ($H^+$) adsorb to the surface of the electrode prior to hydrogen evolution, and desorb during the reverse scan if $H_2$ was not produced. The proposed $NH_4^+$ oxidation reaction in the Feammox-MECs ($NH_4^+ + H_2O \rightarrow NO_2^- + 3H_2 + 2H^+$) (FIG. 3) supports the increased amplitude of the voltagram during reverse scanning, because not all protons are converted to $H_2$, thus they undergo adsorption and desorption during scans.

Feammox-MECs with Enriched *Acidimicrobiaceae* sp. A6 Culture

Figure 5:
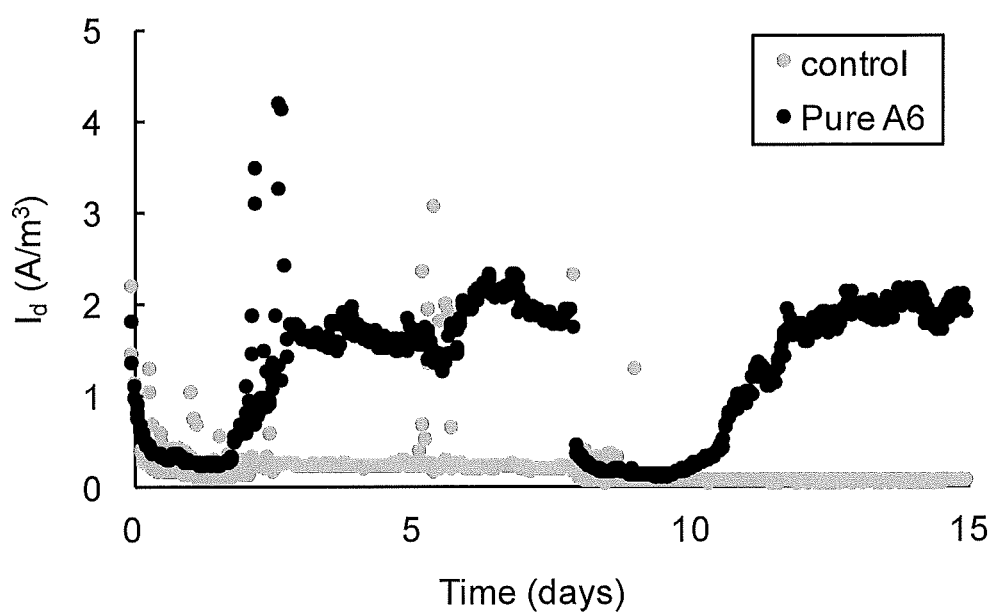
FIG. 5 is the illustrated the average current density in MECs containing enriched A6 culture according to some embodiments.

Our results showed that A6 has the ability to be active in MECs, under constant mixing and with a $V_{app}$. MECs seeded with an enriched A6 culture containing $NH_4^+$ produced an average current density ($I_d$) of 2.5 A/m³ (FIG. 5), and removed a total of 0.52 mM $NH_4^+$ after 3 weeks of operation, however current production lasted for 2 weeks before the system became unstable because the connection between electrodes and wires became loose due to the constant movement of the shaker plate. Control conditions showed negligible $I_d$ and no change in $NH_4^+$ concentration.

Microbial Community Composition Analysis

Figure 6:
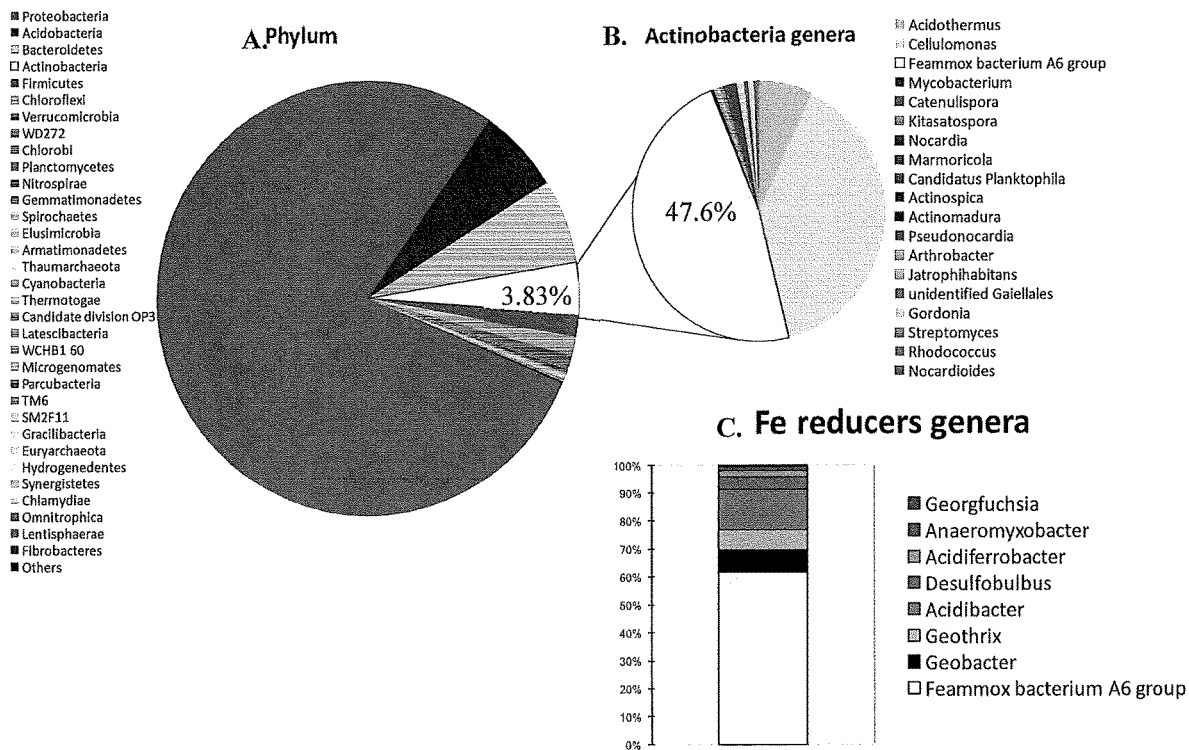
FIG. 6 illustrates microbial community composition from a Feammox-MEC according to some embodiments.

The microbial community of a working Feammox-MEC culture (FIG. 6) was composed of 3.83% Actinobacteria phylum, of which 47.6% was classified at the genus level as Feammox bacterium A6, i.e. *Acidimicrobiaceae* sp. A6. Feammox bacterium A6 makes up 61.6% of the total diversity of all other Fe-reducing bacteria (ERB) present in the culture. Other present ERB that are also known to be electrogenic bacteria that can power bioelectrochemical systems include *Geobacter* (7.8%), *Geothrix* (7.2%), and *Desulfobulbus* (4.7%), however, they require organic C as their electron source and this was not provided at all in the system. The only source of C was $CO_2$ because A6 is an autotroph, therefore, we attribute the presence of other ERB to be remnants of the initial microbial community as well as biomass turnover. The only electron source available in the system was $NH_4^+$.

There are a very limited number of studies on bioelectrochemical $NH_4^+$ oxidation using electrodes as the electron acceptor, and they conclude that the key organism responsible for this process is Nitrosomas (Proteobacteria), a group not found in the Feammox-MECs cultures. Nitrosomas are common aerobic nitrifiers present in soil, freshwater and wastewater. A6 is an Fe reducer that carries out Feammox, the only fully anaerobic $NH_4^+$ oxidation process known, hence, we attribute the current production and ammonium oxidation in the MECs to A6 activity. No current was observed in the control MECs with dead A6, abiotic MECs nor in the MEC operated with live A6 but without $NH_4^+$.

Feammox-MECs with Pure *Acidimicrobiaceae* sp. A6 Culture

Figure 7:
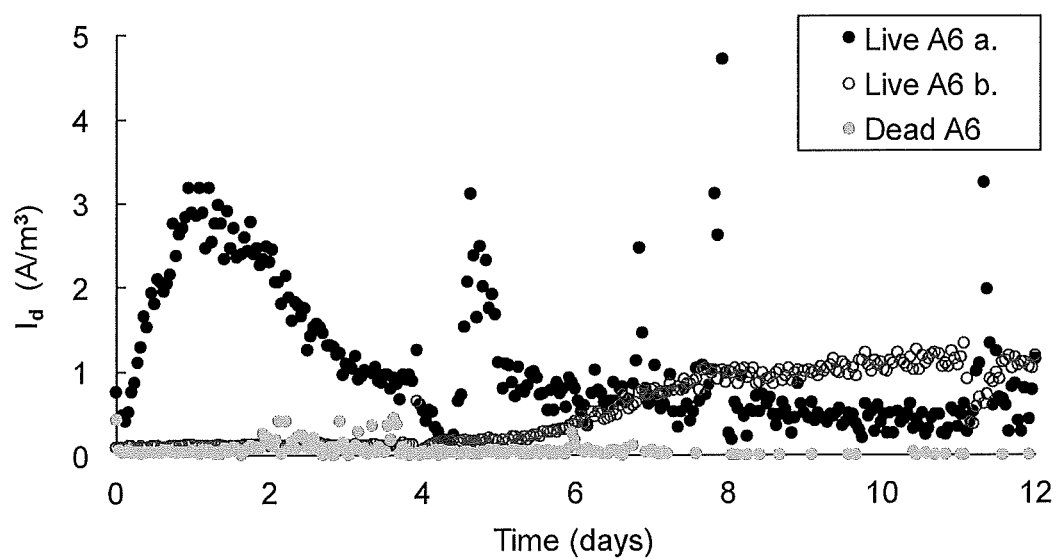
FIG. 7 illustrates average current density measure in 2 MEC replicas containing pure A6 culture.

Replicas of the MECs run with pure A6 culture had $I_d$ peak at different time points. For example, live A6 culture (a) peaked on day one with a maximum $I_d$ of up to 3.2 A/m³, while live A6 culture (b) only ramped up on day 5 but never peaked, instead it showed a stable increase on $I_d$ and then leveled out (FIG. 7, for other replicas of MECs with live A6 see supplemental material Figure S1). All control conditions, including MECs with dead A6, abiotic MECs and MECs with live A6 without $NH_4^+$ showed negligible $I_d$. Although MECs were operated for 3 weeks, $I_d$ data is shown only for a 2-weeks period, because after that the connections to the electrodes became loose due to the constant shaking, resulting in noisy data resulted.

Figure 8:
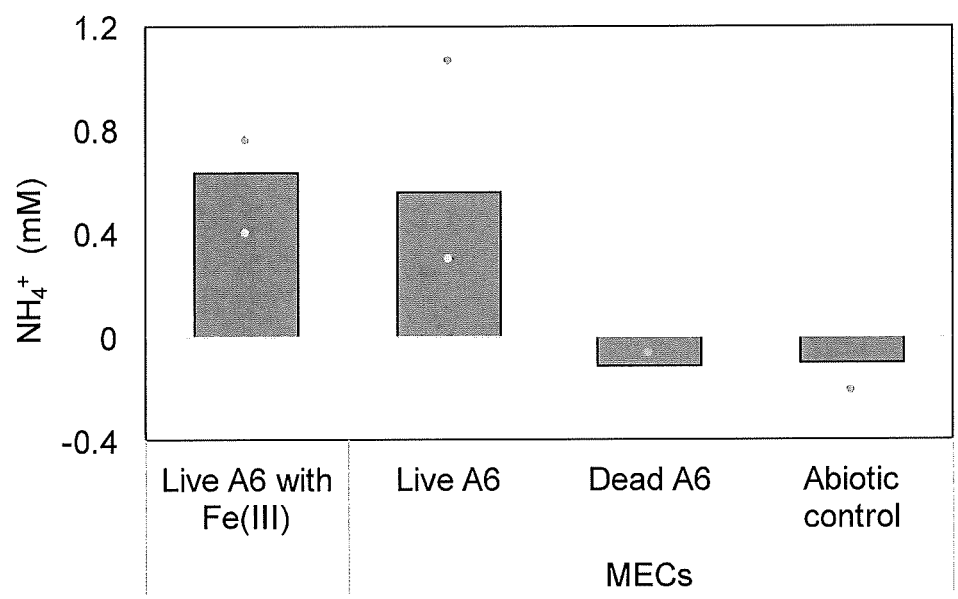
FIG. 8 illustrates average $NH_4^+$ removal from MECs employing media of various composition according to some embodiments.

All MECs containing live A6 removed on average $0.6\pm0.25$ mM of $NH_4^+$, which is similar to the amount removed for cultures grown using Fe(III) as the electron acceptor over the same time period, i.e. $0.6\pm0.14$ mM of $NH_4^+$. The control conditions showed no removal of $NH_4^+$, instead a slight increase in $NH_4^+$ concentration was detected ($+0.11\pm0.09$ mM of $NH_4^+$) (FIG. 8), which is attributed to decaying biomass. Quantification of biomass from MECs with pure live A6 showed that its biomass can be sustained as good as when A6 is cultured with Fe(III) as the electron acceptor over 3 weeks of operation ($2.90\times10^9$ copies of DNA/ml in MECs and $3.35\times10^9$ copies of DNA/ml in batch culture with Fe(III)).

Mixing of the medium in the MECs in necessary to facilitate electron diffusion from the cells to the electrode.

Figure 9:
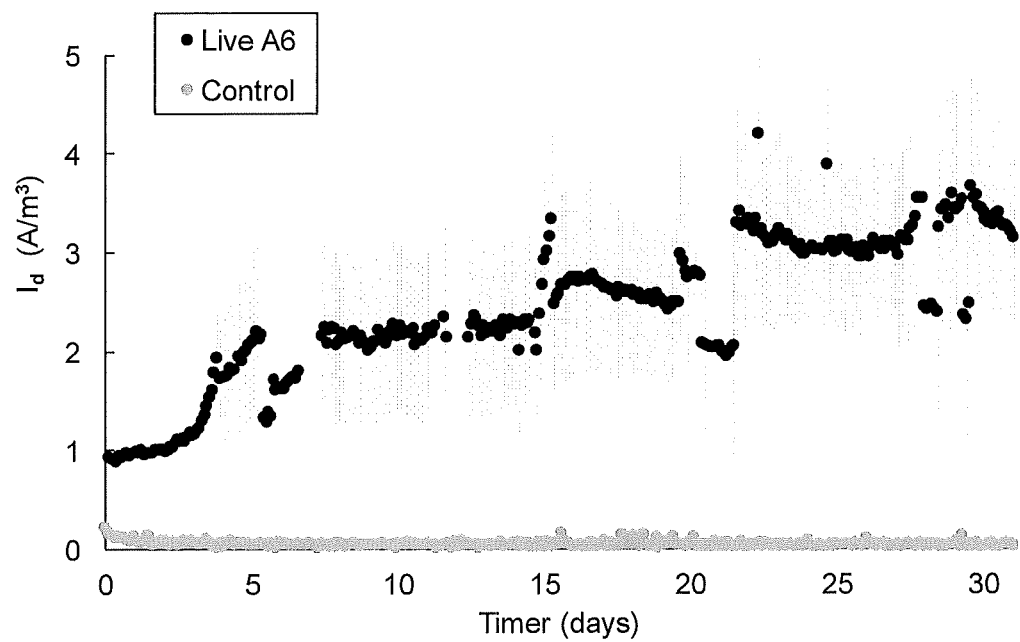
FIG. 9 illustrates average current density of MECs with pure A6 under stirring conditions according to some embodiments.

However, using a shaker for this purpose did result in deterioration of the connections in the MECs. Therefore, to expand the operational time of the MECs, we tested the use of magnetic stirring bars in each reactor, which where placed on a stirring plate. This change resulted in MECs with pure A6 culture to be capable of operating for over 1 month, with continuous increase in $I_d$ over time (FIG. 9). MECs removed an average of 0.7±0.03 mM of $NH_4^+$, comparable to the bench pure A6 cultures containing Fe(III) which removed 0.64 mM of $NH_4^+$. Both, MECs and bench cultures sustained similar amount of A6 biomass ($2.11 \times 10^9$ copies of DNA/ml in MECs and $6.97 \times 10^9$ copies of DNA/mi in batch culture with Fe(III)).

Figure 10:
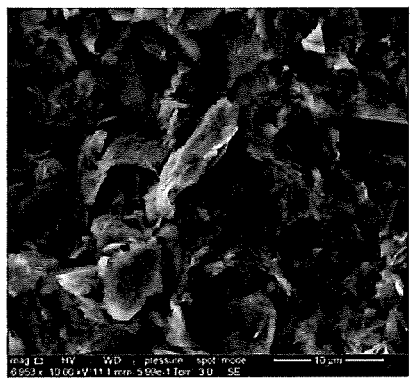
FIG. 10 are scanning electron microscopy images of (a) the graphite anode of a control MEC operated with dead A6 and (b) the graphite anode of a MEC operated with live A6.
Figure 10:
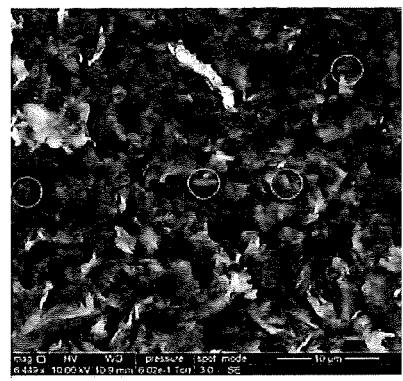

Additionally, the anode of one of the MECs operated with live A6 and the anode of one of MECs containing dead A6 were analyzed through scanning electron microscopy, bacteria cells attached to the surface of the anode of the MEC with life bacteria were observed, while in the control MECs with dead bacteria, no cells could be found on the electrode's surface (FIG. 10).

CONCLUSIONS

This study shows that MECs seeded with enrichment and pure culture of the Feammox bacteria *Acidimicrobiaceae* sp. A6 can carry out anaerobic $NH_4^+$ oxidation while using the anode as the electron acceptor. Cyclic voltammetry shows oxidation peaks of −0.03±0.025 V vs. Ag/AgCl for MECs with AQDS, and −0.11±0.035 V vs. Ag/AgCl for MECs without AQDS, thus confirming that confirming that the reaction is thermodynamically feasible.

Current density of up to 3.2 Amps/m$^3$ were measured in MECs within 2 weeks, and up to 4.2 Amps/m$^3$ were measured in MECs that operated for over 1 month. $CO_2$ was thought to be a limiting factor. It is contemplated to set up a 2-chamber MEC, where the production of $H_2$ does not go in contact with A6, as is has been shown that A6 has the ability to use hydrogen as its energy source.

Materials and Methods
Experimental Setup

MECs were constructed and run in parallel as described by Call and Logan (2011) (FIG. 2). The MECs were built in a 10 ml glass serum bottle containing a graphite plate as the anode [1.5 (H)×1 (L)×0.32 cm (W)] (Grade GM-10; GraphiteStore.com Inc.), and stainless steel (SS) mesh as the cathode [1.5 (H)×1 (L) cm] (Corrosion-resistant 304 Stainless Steel woven wire cloth, 90×90 mesh, 0.0055" wire diameter). Each graphite electrode set was connected by a 5 cm long titanium (Ti) wire (ultra-corrosion-resistant Ti wire, 0.08 cm in diameter, McMaster-Carr code 90455k32), and each SS cathode to a 5 cm long SS wire (302/304 Stainless Steel wire, 0.032" diameter, McMaster-Carr code 85385T99). The headspace of each MEC was purged with an 80% $N_2$, 20% $CO_2$ gas mixture, and autoclaved.

The MECs were connected in parallel to a programmable power supply (model 3645A; Circuit Specialists Inc.) with a constant applied potential (Vapp) set at 0.25 V, the optimal potential for Feammox-MECs set up determined by 2-electrode cyclic voltammetry analysis (Supplemental material, FIG. S1). Voltage was recorded every hour with a multimeter (model 2750; Keithley Instruments Inc.) across a 10Ω resistor placed between the lead connecting the anode and the positive terminal of the power supply. Current (I) was calculated using Ohm's law (I=V/R), were V is voltage and R the resistance. Data is reported in terms of volumetric current density (Iv=A/m$^3$) which was found by dividing current by the volume of the culture.

Cyclic Voltammetry

Cyclic voltammetry (CV) was conducted on the anode with the cathode as the counter electrode, and a 1 mm thick Ag/AgCl 3.5M KCl reference electrode (model ET072-1 mm, EDaq Inc.) placed between the working and counter electrodes. MECs were cycled using an Ivium potentiostat, using the Ivium software. Three consecutive scans were conducted which ranged from −1 V to +1 V at a rate of 1 mV/second. Only the last 2 scans are shown to avoid overcrowding of the figure. CVs were conducted in duplicates on MEC with live A6 enrichment culture with and without AQDS to determine possible effects of AQDS on the system. CV was also conducted on MEC with dead A6 enrichment culture with AQDS, and on abiotic control MEC with and without AQDS to confirm the effect Feammox bacteria A6.

Feammox-MECs Operating Conditions

Each Feammox-MEC was inoculated with an A6 enrichment or pure culture in Feammox enrichment medium. The medium contained: $NH_4Cl$ 5 mM; $NaHCO_3$ 0.24 mM, $KHCO_3$ 0.71 mM, $KH_2PO_4$ 0.052 mM, $MgSO_4 \cdot 7H_2O$ 0.41 mM, $CaCl_2$ 0.54 mM, vitamin supplement (ATCC®) 0.1 µl/l, and trace element solution; the last one as described in Sawayama (2006). Electron shuttle compound 9,10-anthraquinone-2, 6-disulfonic acid (AQDS) 0.15 mM was included after determining that its addition facilitated electron transfer to the anode. All vials contained resazurin (1 mg/L) as an indicator of anaerobic conditions. The pH of the medium was initially set to 5-5.5 because Feammox bacteria work best at acidic conditions with pH below 6.3.

Various replicas of Feammox-MECs with working Feammox culture were run (n=4 for enrichment culture, and n=2 for pure culture). Two types of controls were set up to confirm that current production and $NH_4^+$ removal were the result of biotic activity: 1) Feammox-MECs with dead A6 culture by autoclaving, and 2) Abiotic Feammox-MECs with enrichment medium only and no microbial inoculum. Furthermore, positive controls with live Feammox A6 enrichment culture were incubated in batch reactors for $NH_4^+$ oxidation rate comparison. The positive controls were placed in MECs assembles which were not connected to a power supply, therefore they did not have functioning electrodes, thus Fe(III) in the form of 2-line ferrihydrite was included in the medium as the electron acceptor. All the MECs with enrichment culture were placed on a mixing plate at 240 rpm, and later the MECS with pure culture were placed on a magnetic plate with a stirrer to avoid noisy readings generated by movement caused by the mixing culture in the shaker. When current production decreased, headspace was flushed with an 80% $N_2$, 20% $CO_2$ gas mixture.

Chemical Analysis

Samples were taken at three different time points of the Feammox-MECs operation. Each time, 1 ml of the supernatant was filtered using a 0.2 µm pore size syringe filter. The filtered solution was used to determine $NH_4^+$ concentrations in a Dionex™ Ion Chromatograph ICS3000, using a CS-16 column with CS-16 guard column, and a CERS 500 (4 mm) suppressor. Iron was analyzed for the control treatments and to determine the small amount of Fe that was transferred with the enrichment culture seed to the MEC. Total Fe was analyzed by adding 100 µl of the MEC or control culture to 4.8 ml of 1 N HCl and 100 µl of 6.25M $NH_2OH$—HCl, then Fe was quantified photometrically using the ferrozine method analysis. Ferrous iron [Fe(II)] was quantified by direct ferrozine method. Paper pH indicator (Ricca Chemical Company®) was used to measure pH before and after the operation period.

DNA Extraction and Microbial Community Composition

Total genomic DNA was extracted from 5 ml of working culture of one Feammox-MEC at the end of each operation period. DNA extraction was done using the FastDNA® spin kit for soil (MP Biomedicals, USA) according to the manufacturer's instructions. Total DNA was eluted in 100 μl of sterile water and its concentrations were measured using Qubit 2.0® (Invitrogen, USA). All DNA samples were preserved at −20° C. until further analysis.

In order to determine the microbial community composition, sequencing and phylogenetic analysis was performed by Novogene (Beijing, China) as follows: From total genomic DNA, the variable region V4 of the 16s rRNA gene was amplified using the primer set 515F/806R (515 F: 5'-GTGCCAGCMGCCGCGGTAA-3'/806R: 5'-GGAC-TACHVGGGTWTCTAAT-3') with a barcode following the method of Caporaso et al (2011). All PCR reactions were carried out with Phusion® High-Fidelity PCR master mix (New England Biolabs). PCR products quantification and qualification were determined by electrophoresis on 2% agarose gel. The resulting amplicons were pooled, purified, quantified. Sequencing libraries were generated using TruSeq® DNA PCR-free sample preparation kit (Illumina, USA) following the manufacturer's protocol and index codes were added. The library quality was assessed on the Qubit@ 2.0 Fluorometer (Thermo Scientific) and Agilent Bioanalyzer 2100 system. Finally, sequencing was performed on an IlluminaHiSeq2500 platform and 250 bp paired-end reads were generated.

Paired-end reads were assembled by using FLASH V.1.2.7. Raw reads were processed according to QIIME V1.7.0 quality controlled process and chimeric sequences were filtered out using the UCHIME algorithm. A total of 31,969 sequences were obtained which were clustered into operational taxonomic units (OTUs) using Uparse V7.0.1001. Sequences with >97% similarity were assigned to the same OTUs. A total of 995 OTUs were produced. A representative sequence for each OTU was screened for taxonomic annotation using the blastn algorithm against the 2016 NCBI's 16s ribosomal RNA sequences for bacteria and archaea at an e-value of $10^5$. A6's 16s rRNA gene sequence was included to NCBI's database for annotation at the family and genus level of the top 100 most abundant OTUs.

Environmental Scanning Electron Microscopy of the MECs' Anode

The graphite plate working as the anode of a MECs containing live A6 and one from the MEC containing dead A6, from the MECs operated for over 1 month, were analyzed using and Environmental scanning electron microscope (Quanta 200 FE-ESEM) at the Imaging and Analysis Center at Princeton University.

Example 2—Feammox Reactor for Degradation of Fluorochemicals

Figure 11:
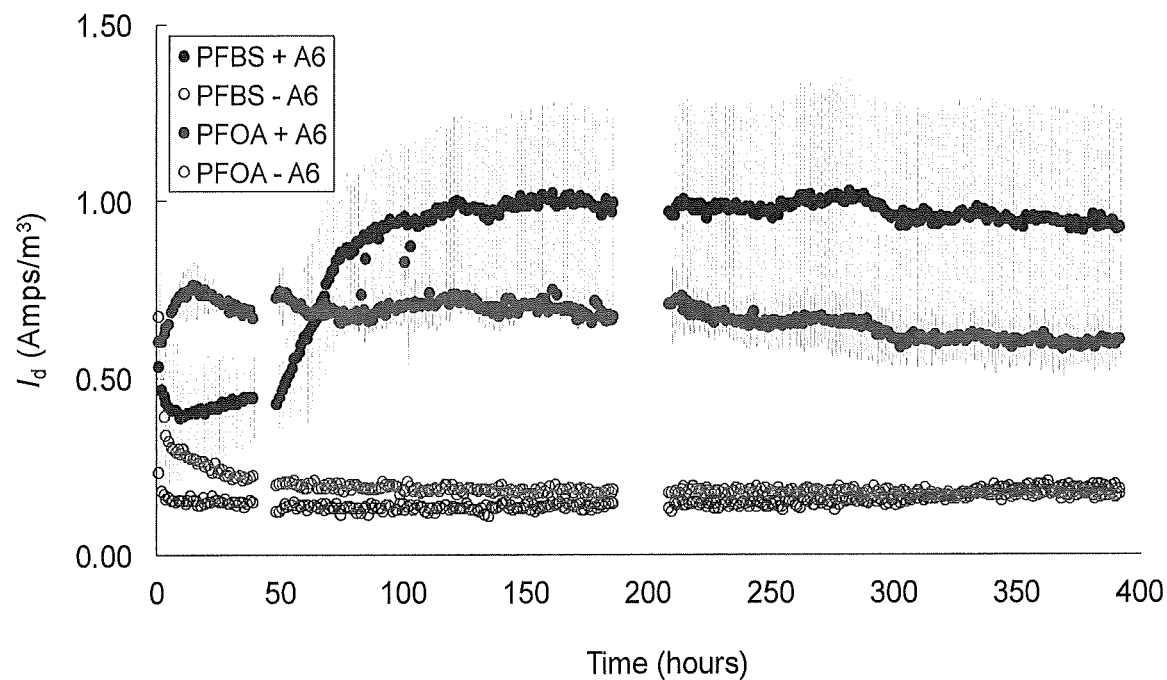
FIG. 11 details current density in a MEC in the presence of PFBS and PFOA (100 mg/l) and a pure A6 culture.
Figure 12:
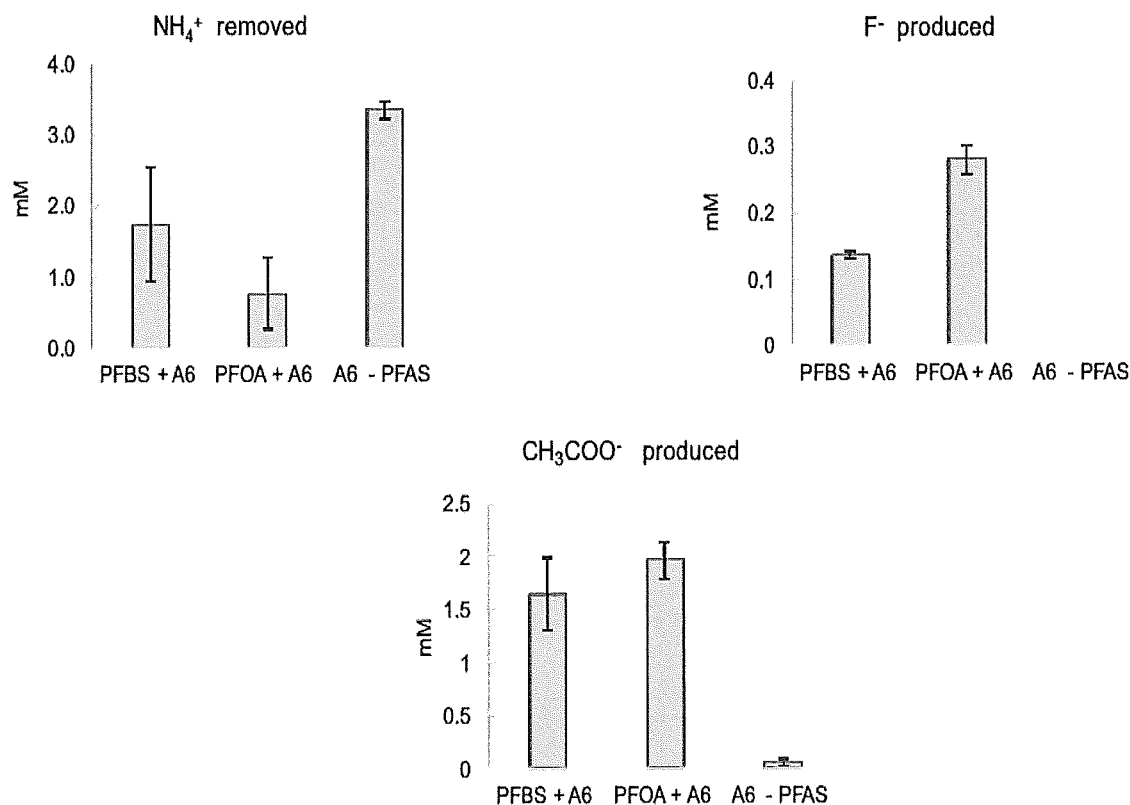
FIG. 12 details $NH_4^+$ removal and F– and acetate production in the presence and absence of PFBS and PFOA.

MECS were constructed and operated as described herein for a period of approximately 2 weeks. Either PFOA or PFBS was added to the MECs to reach a final concentration of 100 mg/l. The MEC's were then seeded with a pure culture of *Acidimicrobiaceae* Feammox bacterium A6 and controls were not seeded. Results presented in FIG. 11 show that, in the presence of A6, a cunent was measured in the MECs with PFOA and PFBS, while in the absence of A6 no current was measured. Results presented in FIG. 12 show that the MECs seeded with A6 removed ammonium over this period, indicating that A6 was active. Over the same period the production of fluoride was observed in the MECs containing PFOA and PFBS. Similarly, the production of acetate was observed. Acetate is a product of the defluorination of perfluorinated substances by A6. The MECs to which no A6 was added did not produce current, did not remove ammonium, nor did they produce fluoride or measurable acetate. These results demonstrate that PFAS (PFOA and PFBS in this case) can be degraded in bioelectrochemical reactors.

Various embodiments of the invention have been described in fulfillment of the various objects of the invention. It should be recognized that these embodiments are merely illustrative of the principles of the present invention. Numerous modifications and adaptations thereof will be readily apparent to those skilled in the art without departing from the spirit and scope of the invention.

SEQUENCE LISTING (49 sequences)

SEQ ID NO: 1 - DNA, 2165577 bp, Antimicrobiaceae bacterium A6
  misc_feature (216)..(577): Antimicrobiaceae bacterium genome sequence
gactcgtcgcgtcgacccggagacgttgtccacaggacagtgtccacagctgtggagcatcttgtggataggaggaggttagaggagtgagcgcacccgaggcatcgtgggaggcgatcgcccaggcgttccgaacggcgtcctgaccacaccgtcaccgctcgccaaggaacgtctcgagaccaagtaccgcgacgtgctcgaggacgtgtcggggaagccacgtggctgacgtggttccgaaccactaatctttgaccctgcgacttgccccagccccctggcgccccaggagctctccgaccagcagatcgattcccgttacccagggtcggagggcttcccatcgatcctgaccacaccgtcaccgctcgccaaggaacgtctcgagaccaagtaccgcgacgtgctcgaggacgtgctgacgcccatcatgggagcgcgagtgcctgtcgcggtacgggtccgcgccgatgtccccgacgagacaccgaccacggcgcattcgctgttcgactcctcacccacatcctcgcccacaccgtcgcggcgtaacggtcgcgggtcctcttcgaccttcgatccccgctataccttcgaagcgttcgtcatcgggtcctccaatcgcttcgcccacgccgcggccctgtccgtggccgagacgccggctcgctcctacaaccccctcttcatccacggcgacgctggtcttggcaagacccatctcctccacgcgatcggcaactacgcccgtgagaactatccgaacctgctgacgacctacgtttcgaccgagaccttcctgcctagccctccgagccctcgtcgggacttttcacccaacgagttcgtcgacgccatcaagcgaaaccagacgcccgccctcgaccgcggtaaagtcgattcgtgagagtgagttcaaggcccgctaccgtgcgtgcgacatcctcctcgtcgacgacatccagttcctcgagggcaaagaagcgatccaagaagagttcttccacacgttcaacacgctctacggggcacagaagcagatcgtgctcacctccgaccgtcccccacgtgcgctggcgacactcgaggatcggctccgaagccggttcgccatgggcttgatcaccgacgtgcaaccgcccgatctcgagacgcgagctgcgatcctccggcgaaaagccgaggatgcgggcgtcaccgtacccgcaacggtcatcgagttcatcgccgcctccatcaccgacaacatccgagagctggagggagcactcactcggctcgccgcattctccacgctcagccagaccggcatcacgctgacgatggccgaacaggtgttatcggatctcatctcgcagcacgccacccaacgtcaacgcacgcctgccgaggtcatcgctgcgacggcggccttgttcaacctcacccctgaagacatcaccggcgcatcgcgcaagcggccggtcgcggtagctcgccagatcgcgatgtacgtcgttcgcgaactcaccgaactcagctacccggagatcggccgcgccttcggcggcaaggaccacacgacggtcatgcacgccgtcagccgggtacaagagctgatgcaagagtctgtggagatctacgaacaggtcgatcagctcttcaagagtcttcgaggtccgcggccgtgagcctgtggatgtccctgaggacggacggtggacgaccgcccgctcatccacaggctcgaggagcccgacgagtccttcgaacgacgacggcctcgcggctccacagcactgtgcatgtcctggggacgagttcatggccgctgcgctgggaaaacgggtgtcgtccacagttcacaggccttactaccagtgctaccgtacacatagataggggaggacatcggtgaagtttctctgtgaacgcgacgaactcgcatcggcgctccaggcggcgtcacgagcgctctcgtcacgctcctcgctcgcgggtgtgcgctggacgcttcgaggcggcgaactcgaggtcgagggacgagagagcgacctcgcgattcgcagtgtgctgggtgcgatgggaaccgagggttcgttccagacgccggcgtcgctcgccgtcgatctcgttcgtaccatgccgagcgaccaagtcgaggtggtggtcgaggacgcatcggtcgtgctccgatcgggtcgggccgaagtgtcgctgcagctgctcccgacgctcgaactccccggaatcggagagggcacgacgccgagtgcgacggtgccggctgccgcgctggcccaggggattcgtcaggtggccgtcgcggcggctcgcgacgacggtcgcgacctcatctattccagcatgctcttctcctcgaccaatgacggcttgcggctggtcgcgacggacgggacgaggcttgcgcttcgtgacatcgcgaatctctctgtcgcgggttcggaagctcgcgacgtcgtgatcccgaccagggccgttcgcgagctcgagaggctcgtcaccggtgcgggtgtcgacgagatccacgtcggtatcggcgagcgcgatgccgtgttcgtggtcggcacgaccacgttggccacccggctcgtcgacgagccctttcgcgactatcggcggctcgtggaggccacctatccgaagaagctcctcctggatcgattgtcgctggtcgatgccatgcggcggcttcgccgtatggccaaggaggcgcggaacagttcgtcgatccagatgaacatgacgccgacggcctgcgagctcagcgtgcgcatcccgtccgtcggccaggtgcacgaggtcctcgacgcgaacttcaacgatgccgagttcaccatcaacttcgacccggacatgctcgccgatggcgtcgacggtgtcgagggcgacgtcatccggctcgagttcatcgaggccaaccgtgcggcgtgcgtgagttcggcggacacccgcgagtacctgtacatcttgatgccgatcgtggcccgctgagtatgtgggtgcgcagtctgcgcatcactggcctgcgcaatctcgacctcaccatcgatcacgtccccgacgacatcatcgcggtggtcgggagcaacggacacggcaagacgagtctgctcgagtcggtcagcgtggtcctggcagggcgatcgttccggacccatgatcggtcggcgctggtcagggtgggccatgacgaagcggtcgtcgtcgcggacgtggagcgcgagctcgctccgccggtgcgagtcggccgtcgggtcgatcgggagggacgactcgagacccgtgtcgacggacagcgggagcaacggggcccgtcgttgccggtggtgagctttcatccagacgacgtccagatcgcgagcggcggcccggagcagcgccgtcggtttctcgacgagtgcgtcgtcggactcgatcgaggggcagcgatccggctgcgtcaggcggagcgtgtcctgcggcagcggaccgaggctctgcgggcgccggtcttggacgaggtgacgctcagcatcctcgaagagcggctcgcgcgcgcgtcggtggaggtagccgagctccgggcccgtgctgccgaggtgatcgctccgcacgctcgggcggtgatcgacgagatgctgatgtcggcgggtcgcgtggtggtgacctatcgaggcgctggcgacgaggcgacgctcctcgaacaactgcgtgcgcgtcgcggagacgatcgacgtcgtggcgtcacgagcgtcgggttccaccgcgacgacgtcgagatcctcctcgacggcgagccgatccgtcgcatgggatcgcaggggcaggtgcgtaccgtggtcgtcgccctcaaggtggcgctggcacgcgcgatggaggcggtgacgaaggagccgccggtgctggtgctcgacgatctgctcgccgagcttgatgccgagcgggcgcggcgagcggtcgcgatgatggaggggatgcaggcgttcatcagtcacaccgcaccggtggaggggtcgggcttcgagcttcggatcagccatggagccctcgtcgacgcgtgatcgaggacgagtgccggggcccgtgcccatcgctgaggtgctcgcgaagctcgataccgctcagcgggccggcgtggacgtcgtgcgtcgtggcgaactcaagaccgtcgtgcgcgaggcgctgggaccagccctcgtacgtcgatgctcgttggtcaggctcgccgaggacgagatcgtcctcggcgccggtggtgccggtctcgtcgccctacgtggtgcggcagcacggctccgcgtggcgcttgcggaggcgggttaccagggtgagctgcgtctcgttgcgatcccgggagagccgcgaccctggtcgcagctaggctgaggtgggctcgagcgcccgtgggtgtgagtctgctcgcagtgtgtctgcatcgccacgagcgtggatgacgcatcgagcagcgtaggtggtcgatcgaggaaggatcaagagcttggagcccgaggcaagctacaccgcagccgacatcgtggtcctcgagggcttggagcacgtccggctgcgcccgggcatgtacatcggctccactggtccgagcggactgcaccacttggtgtgggaagtcgtcgacaacgcagtcgacgaggtcatggccggcgcctgcaccgagatcgacgtcaccatcctcgccgacggcggctgtcgggtcgaagacaatggtcgcggtattcccgtcgacccacatccatcagacccgtcgaagtcggcagccgaggtggtgctgacgcagctcaacgctggcggcaagttcggcacgggtggttataaggtttctggcggtctccatggcgttggcgtgtcggtcgtgaacgcgctgtcggcacgcctcgtcctcgaggttcaccgcgacggtagcacctatcgcatggagttcgtcaagggtgggacgccgacggggccgctcgagcggatcggctcctctggaggccggcgaggcacggtggtgaccttctggccggatccgacgatcttcgaggacactgagttctctgcccagaggatcctggagcgcctccaggtcatcgccttcctcaacaagggcgtggtcgtgcgcttccgcgacgagcgtcctggtcgagaacatgaacagacgttctcctacgcaggtggcatcgtggacttcgttcgccacctgaacgagcccaagggacccctctttgcgaaggtgggctactacgccgcgagcgaggaggacatggaggtcgaggtggcgttctcgtggaacaccaccttctacgagacgctgttcaccttcgcgaacggcatctccaccgaagaaggcggcatgcacgccgagggcttccgcaaggcgctcacgcaggtgatcaatcgctacgcgagggcacggaacctgctcaaggagcgcgatgagaatctcgaggggaacgacatccgcgaggggatgaccaccatcgtgtcggtccgtctcgtcaacccgcagttcgagggccagaccaagacgaagctcggcaacgtgtcggtgcgatcgttcgtcgagcgtgtgaccaacgagcacctggcgacctggctggaggagaaccctcgcgaagcgcaggcgatcgttcagaaggccatcgtggcacagcgtgctcgcttggccgcgagacaggctcgcgagctcacgaggcgtaagtcggggctcgagagcgcgggtctgcccggcaagctcacggactgcacctcgcgcgatccctccgagtcggagctgttcatcgtggaggggaactccgctggtggcacgaccatcaagggacgtgatccgaagacccaggcagtgcttcccatccgtggcaagatcctcaacgtcgaacgtgctcgactcgacaagatgctctcgaaccaggagatccagtcgttgattgcggccatcggcgctggagttggtgacgagttcgacatcaagaaggcccgctaccacaaggtgatcatcttggccgacgccgatcctgacggatcgcacatccgcacgctgctgctgacgttcttcttccgtcagatgcggccgctcgtcgaggcggggatggtctacgccgcacagccgccgctgtactccacgttgctcggcacggagaaggtctacatcaagaacgaagccgagcgcctgcgctttctcgaagcccaccccaaccacaagaagccattcctgcggttgaagggtcttggcgagatggacttcgacgagctgcgcgacaccacactccatcaggatcggcgaaccttgctgaaggtcaccatcgagcaggcggcgatcgccgacgaggtgtgcagtgtcttgatgggcgacgacgtcgagcagcgccgtcgtttcatccaggagaacgcgggcgacgcgcgtttcatcgacttctaggtaagcgacatcggcccacgaggagatctgcgtgcctgacgaacccacccccgacgcttcgaacgtcgagctcatcgagttgcaggaggagatggagcgctcctttctggagtactccctctcggtgatcattgcgcgagcgctccctgacgcgcgcgatggtctcaagccggtgcatcgtcgcatcctctactcgatgtacgacgctggctatcggcccgatcggccccacgtgaagtgcgcgaaggtcgtcggggacgtcatgagtcgcttccacccacacggcgacgctgcgatctacgacgcgctcgtgcgcatggcgcaggacttctcgctgctccatcccttgatcgatgggcacggcaacttcggttcgcccgatccgtcgacgggtcccgcggcgtctcgctataccgagtgccgcctcgccccgatcgcccttgagctgctcgcgggtatcgacgaagacacggtcgacttcgtcccgaactacgactcacagaccgtcgagccgtccgtactgccggcgcggttcccgaatctgctcgtcaatggatcacaaggcatcgccgtcggtatggcgacccagatcccatcgcacaacctcggtgaagtggtcgacgcgattgcgtacctcatcgaccaccccgaggccaccgtcgacgagctcatgcgcttcgttccgggccccgattttcccacgggtggcatcattctcgggcgagatggcatccgcgacgcctaccgaaccggccgggggagcgtcaagcttcgcgccgtggccacgatcgaggaggctcgatcgggctaccagatcgtcgtcaccgagattcccttccagacctcggtcgaggtgatcgccgacaagattcgccacctcgtcgaggagaagctgctcgaagggatccgggacatgaagaacttctcggcagggtccgagacgcgcttcgtgatcgagctcaagcgtgacgcgaatccgaacgtcgtgctcaacaacttgtatcgactgacgccgctccagacgagcttcccgatccagatgctggcgctggtcgatggcgcgccgcgcaccttgaacctgcttggcttgtgccagatctacgtcgatcaccaacgcgaggtcattcggcgtcgctccgagttccgtctcggcaaggctcgagagcgactccacatcgtcgagggtctcctctcgtgcatcgaccaactcgacgccgtgatcgcgaccatccgagcctctgaggatcgtgcggctgcccgtgccgcactcatggccgagccgttcgggttctctgagctccaggcgaaccacatcttggacatgacgctcgggcgcctgacccgtctcggacgtgaggagctcgaggaggaggcggcgacgctccgagcaaccatcgctgaactcgaagcgatccttgccgacgcccaacgactgtccgcggttgtcaaggacgagatgctcgcggcgactgccgagtaccgccaggcgcggcggacccgcttcgaggtggacccgggcgacttcgccgcggaggacctcatcgaggacgagcccatcgtggtgctcatcagccgttccggctacatcaaggccgtgcccgagtcctcgttcaaggcgcagggccgaggcggccgaggcgtggtgggggcgcgagtcaaggacgaagacgagatcgcccacgtcatctcgtcgtcgatgctctcgaggctgctggtcttctcgtcgcgtgggcgggtctaccaactccggggttacgagctgcccaagctcgagcgatcggcgcgggggacggcgctcgtcaatctcgtcccgttggccgacgacgagcgcatcacctccgtcatgggcacgaaggacttccccgaggacgctgacctcgtgttcttcacgcgcaacgggatggtcaagcgaaccgccatggccgagtacgcgcgctcgcgtcgtgatgggatcatcgctatcgacgtgcgaggcgacgacgagctcgtgagcgtcgtcgtcgcgaccgaagagcacgatggcgtcgtgttcaccaagcgcggccaggtcctgcgcttcccactcgctgaggtgcgtcgtaccgggcgcgcgacggcgggcgttcgctccattcgccgagcggacggcgactggatcgtcgcgggcgggctcatcgaagacggtgtcgaggtcctgctcgtcacgagccgcggttacggcaagcgaacccccctcgattcgttcccggtgcaccatcgaggcggcgccggtatcagaggcatcggcttgaccgagcgcaagggagagctggtcgccgcggccttcgtgaggccggaggacgaggtcctcatcgtgagctcgcagggccagatgatccgcgtgcgcatcggcgacatctccaaccagggtcgctacgcaaccggggtcaagctcatctcgctacaagccgaggagtccgtggcgtccgttggcgtcgtgccagagagcggtacggacgcataaagattcgaatcggtccgtgccgatgccatcggtgcaagggagtgcgcgatggcacggtggaccgctcggtggcttctacaagtcgcctcgactgtcgcgatggcgggcgtgctcgccgtggtgcccggtgcccgcggctcgggcacaaagaccctgaccggatcacaggtcagttggagcatcgcctgggtgccggcttcggtcccgtcggtcgcgctcccgagcgtgagcttcgccagcttcgaggaccccacgaacccgaccgagggtccccagccgacgttccctcatcccaacatcgctacccccgaaggcgccgccctgtccgtgggccaacccatcatcgtcgcgccacagacgagcgagctcgggacgaccctgtcgggatctgcgaccgtcgccggtgggatcgtcgtcaccgtcacggtgaatggggtggccgagcccccggtcaccgtgtcgaacgtggcgagctacgcgatgagctggcaggccagtgtcgaggacgtctacgtgtcggccggcacggtgccggcgtcggccccgatcctcgctggcacgaacgtgctcgcgcccaccgccaacgacgtcacgccgacaggctcgctcgcaccgggcacgtttgggtccctgtgcgacgctggcgcggtgagcgcatccagtgatctcttctcccgcctcacgccggccctcgcccagtcggcggcgggcaagctcagtccgctggtgtcgacgccgaccagcgaggatccgggcacgtgcgccatcgagttcgctgcaccgtctggactctcgggtggttctacctggaccgtaaacgctcagctcgccgcggccttcaccgcgacggcgacggcacgactccagaccgtgcatctgtccgtcgatggtgtagccgtgacaattcctggcggtacctacagcgacgtgacgctcgacgttccaccttgggtgctcggcccggcgacctccatcgacgagcaggtggccaccgtcgagtcgcttccggtgggcgctgcggtgttcggaggctagggtcgtggccaccatcgcacccggggtcggacgaaccgagagccttgcgcctcgatcgctcgccgagctgatcgagcgcggcccgttcgagcgctacctgcgcgagacgctcacctggtcgctcgtgtcacgcttcctcgtcgatgcgcagcgccacgctgacgacgagcgtcaggccgcagagttcgaccattggcacgagcgttatcgggctctcttctctcgggccgccgacgaggttctccagacggtgagccaggagatgctcgaccacctgagtgtgctcgagaagcgggcggccttcaacgccaactacgtcgccatcggcgagcgcatccggacgctgctgcaagcgcgtccggatgccgacgagatccagcggctgccgaacgtcggaccgctgctcaccatccgtctctacggggagatgttcgatctcgggatcgtgttgctgtactacttcgcgtccgaggtggagaacatccacatcgtcgacgagcgcgtcaccgtctacacgagtgatggtcgagcgtggctctcgatgatcgatgcggccgccgacgggcgcgccctcaaggaccgtggtgcgcagttcgcacagatctccgggggaggcgtacctcaacggttcgaccccgtgcaccacgccccgaacctgacgagcccctacgggatccgcatggcgctccgccagcgcaccactcgatcgggggagtttctcgctgcgttgcgcctgcaccatgcgaccaatatcaccttcgatgccctcatcgaacagggggtcctcagcgaagaagcgggcctcatgctcgcgcaggcggtacgagctgcggtgccgatcctgatcgcgggggcccctggatccgggaagaccacgctcctgcgcgcgctcacgaagttcatcccgcgcgccgaaccggtgctggtggccgagaactacgaggaactgcatctcgaggagctggtcgacgaccgcggcaggccctggttctacgtgctccacagccacgtcgagcaggaggccaacgccgagggtgcgggctcggtcacgatgaagaccatcctcgaacgcggtctccaggaggatgtccgtcggctcgtgatcggtgaggtcaccgacccggagacgatggaggtgctgttgcaggccgccaacacgggcacgagcggcgtgctggccacgatccacgccgagagcgcgctcgacacggtgaaccgcgtcttcgggctgttgctgcgcacgacccgttacacggaccgggccgctgcctatctcatcgagagcacgttgaacctggtcgtgcactgcgccttggtgcgcaacgagcagagccgtcggcgggtcgtcacggggatcgggtgggtcgttccccatccgggccaggtcggtggcatgccacggatgcagatggcgttcgtgcgcgaggggtcggctctcgtgcgtgccgtggaccatgccaacgtcgcgcaccggctggaggagctcgtcgcgcggaggcgctcgtgagcgctcaagttctgacgccgagagtgacgatgcttactacgacgggtggtcaagcatcgtccgtcgagagacggcgcgagcgaaaggagcgtcgaaatgggaaggcgcatggtacgtggcgcagcgtggtggctggcctcggtggttcggtcggtgatggcagtggtcaccggtgggcctgctgcactggtgtcgctggcgagcgacgagtccggggcggagacctcggtggcgacgatcgcctgggtcgtgctcgggctcatcgtggtggcgttcgtcgtgttcttggtgttccagttcacgggcagcgcaaccagcgcggcatccaataccaacaatcagctcagcacccttccacagggatagcgggcatgttcgctcgtcgcctgctcgtcgacgagcaggcgacgagcacggtcgtggggccggtggtcgtggtggtgtttctcatgctcatcgcgctgaccatcggcttcggcgcgttgtgggtcgggcacgtcgaggccgtgtggggtgctgaggcgatcgccgccgacctcgggatcggtggctcgcccgcccaaggtttcgccttcggggtcctgcgcgacgtgacctggtcgatccagccggtcagcgtgagtggtccggacgcgccgggagctgcgtccatggtggtcgtgcacgccgatctcggcggtctcgtgccggtgacgagccaggtcgcgctccagccgcccagccagctcggaacgggagcgtgatgcgacggctcctcaccgacgatcgagccgagagcgatgcggtggttgcactgccagcggtggcggccgtgatggtcgtgctcgcggtctcggtgggcgtcgtggtgtggtgggcggccgcgcaatcggcccaggcgatcgccaatgccgccggattcgaagccctgagtctcccggtcctcgggactccggccgccgagtcggcgctcggtgccatggtcgcggccgagaccgcagcgcgctccttcccgccgctcagctgcgccctgagtgggctcgacgtcgccgccgcccagattccagcgtcggtgaccgtcacggtgacctgttcgacgaccgttcccgtgctcgggttcgtgcacttcgagcggtcggtgacgctgggcctgaacccctcacacctcatcgccgggagtacgccgtgagggcgccgagcgagcagggagacgcgacgcccgcgctgctcgcggtcggatcgatcctgctcgtcatgggactcacggtggcggccctcgtgctcgagagcatcacgatggccgagaccatggcgcgggcggcggcgcgggcggcggcgcacgccgctgccaacgtgctctggcagacggctgggaacgcggggtcgccagggctcgtgacgatgcggaatccgtcgttctacgatcccaacctccagagcgcggcctcggcagcgctcgcgggggtcccacacggggtcggtacgagcgtcgtgtcgtgctcgggcgggctcgtccccaacggacacggcctccagcgctattacctcgacgtacgggcgacctgcaccgtggtgttcgtcccgcccatgagcgatctcatcaccgtggtggccatcagcccgatcacggtcacggcctccgcccacctcgtggggagcctcgcgtgagcgcgcgtcgtgtggccatcggtctcgctgggtcgatcgcggaggtcctcgtcctgacaccgtggtcgctcccgaatgagcgcgtcgtggcccaccccgtcgtcgtcggggccgcggcggtgtgcgccatcgctgcgcttgcgctgtggtggcggtgggtgctggggcgaggtggtggcgaccattcatcgatccccgacggagtccgcgccccggcgcgagcgtcggtcgcggtcgatctcgatctcgacgcagtcccagccatcgaggtgcccggcgtcgggatcgtcgcgatggaacgctcgacgtcgcagtgggtcctcgaggtcgccgccgagcaggagctccaccgcgtggcggagcacgcccggctgcatcggccgcgagggatggtgccgctcgcagtgccagatcgcaacccggccgccgaggacctccgcgccctcgtccgccttgaccatcgcgtccgctcctcgccagcgcacgagggctcgctcacgccgctgcgctctggcgaggtcgtagggggtcagcgccacacacacgccgacgcagggtcggcatgcattcgcgtcgtcgaccggctgggccagcttcgcgtgctcagcggactcgtcggcatcgagcccggcaccggtctcgacctcatcgtccagcatcggctcttgccgtggctggagccggttcgctgtgtcgtggtcgggatgcgacgtgaggaggtcgtggccttggcacgatcgtcggtgctggtcgtgtccgacatccggcgggcacaggcggtgctcgacgaggcagtgagtgcgacgaatggattcccggtgctggtggtcgtgcatggtgtcaggcttgcaatggatgacgtgcgtgcgctcggtgcggccggacgcgtcgtggtcgtcgagacgagtggacctcccgacgtgtccttcgcctccatcgatcgtgggcgctggcacggcgcagtggagcggttgagtacgttcgcgccgaccccccttctgccaggtcaactgccaccgcccccacgacccgggagaccctgggtgcgcctgtgcggcctcgagccacggctcgagggcgtcgccgcgagccgagacgccgcacagttggtcgctgcgctcgtgctcgacggcggccgcgccacgatcgacgcgttggccgacgcgctcgagcgtccggcgcggaccgttcgatccctcgcacgcgaggtgcccacctgtgtggacgacgagcgtgacgggctccggttgcgcccaggtgtgggatccgatctcggcctcgtccaccgggtcgacgaggcgatccgcatcgtcgacctcgtggcgaggccgccacttgccgcctacgagcagccgtggtttcgcgctcgagcgccggtcctggaggcggtcctcgtcgactccctgctcgccaccgcggaggcactcgagcgcgcggacgctcgtggtgaggcgaaggtgatcgtgcggctcgtccgccggacattcggaccgctcgagcggctcgaaggcggcggtctgcgccccgacgggaccacgggtgcagacgagggcgtcgcccggagcgaggaggtcggcacccacgtgccacgagcggcgttggtgaggccaggagccgtggggtcgtggtgagtagcttcgatgagcggcagccatcggccctcgggtgggagggtgtcgatcaggcgccgtcgacgggcctgtcggagaccgaccaacatgtgttctgggtcgaggtcggcgatcggatcggcgaaggcctcggcctgatcactgctcgcagcgaggttgccgaggtggagctcatcgtcgggccgggtgacgagcatcgcacggtggccgagccggtgggcggcgccccgtcgaactggggcgacttcggggatctcggaggggtcgctcgggacgaccgcgacgacgagccgcggaggctggtcgtcgcggcgacggaacccacggccgagaccggaacggtcgcggcggtcgacgtcgtgacggcgccgctgatgacgcgtccgcgacgctcgcgatggcgcacctggtcgatggtgctggcgtcggttgcgctgatcgtcgcggcgcgcctcctgctcttcgtcgccaccaccggcggacggcacccatgatcgcagcggtgtggctccttgctggcgtcggcgtgatgggtgcgcacctcgtcgggcccggacgcgaggacgctcggagccatcgcctgcgccgacgtggttcgctgtggatcgttactctcgtgtcggcgctgtacgccgtcgccggcctggcccttgggttcgagccgcttgggtggctcccgctcgcactcgggctgtggctgatcctcgtcgtcgcgttcgtggtgctcttccagcgtcgtcacgtgggaggtgccgacgtgcgctacgtcggcggggcgctctggctggtcgccgtcggactcggtccggtcggtctcgtgtggttgccgctcaccttgctcggcgcaagcctcgcgcagctcgcgtggtcggcgatctcgggtcagcgagggccgtgggcgatggtggcgtggctgagtgcagcaggactcgtccttgcggtcgttgctctgattgctgaggtggcactgcgataggcgctcaatgggagccgtcgtcgtgccgacagtagtcgagagcgaaggaggcggacgtggctcgagatgacgccgcacggcgactggtgatcaccggcgtcggcatcgcgttcctcggcttggcgatcgccgggacgagtgtctactacctcgagacgcgtgtctttcgcgaggtccagatcgtggaggccgccgccgagctgctccctgggcaaccgatcgctcgatcggagctcaccgtcgtgacgaccccggcgcagatcgcctccgggagcggggtcgtgctggccggtgcgctcgacgccctcagctcggggagctataccgtgtcggtgccggtcgcccccggcgcgccactcgaggttcgcgagctcgccaagcgtcctcctcgaggggaacgcgtcctctacttcacgccgcaggtcgcgccccccaacctggaggcgggctcggtgatcgatatcctcgtgcctcagccgagcaccgtccagacgcagtcgtcggcgcacgtcccctacgacgttccggtcgcgaccggcgtgacggtgctgtcggtgacgcatccctcgtctggatcatccggttcgctcggcatcgaggtcgcactacctcccgccgaagtcgcggccgctgcggccgccgcgaccagctcgcagtgcgtcgtggtgttctcgttccctggtgcccgacccgttccggtgggctagccatgctggtggtgttcgggctcgatgcgaacgtcggtcgcaagcgagtcgccgctgccctgacacgtgctgttccggggacccgcctgctggtcgaactcggcgtgtcgggtacgacgtggtccatggcgggagccgagttccagaagcgcaccccgaccctcgaaacgatctacgaggtcctgcgcgagcgcaacgacggcatgcggcgggtgcgcgtgcacctcgacaccgtggtaggtgcgctgagcgacctcgagagcgcacggcccatcagcgccgccgatgcgtcgcgtcgcgatgtcgtgcccgtggtgcgcgcgcccgtcagttcgaccgaggccgccgagcgcgcgctcgagttcggctcggcgctcgtcgagctgttcgtccagctggaacgctccagcgttctcgggcccaccaccgtgctcgccgacgcgggctgggtggcgccgggtctcgtcgggcaggcggcgtgggccgctgcggcgagcgatctggtgctcgtggtcggggagcggccggtggcgatcgcctcgctcggctacttcgagcgggcgttcccgcaggctcgggtctgggtcgtcgcgctggcggcgggtcgtcgtcgccgtcgtctcgctgaagtggctcgcttcgcactgcgcgcgcgtcacggcgtcgaggtcatcgccgtagaacccgatcagctcggatcggggaccgccctcgagcaggtcctcgagcccatcgtcatgggatcggctggttcgaccctcggggagctcggagcgtgacccgggccctcgtcatgatcgccgggagcttcctcggtatcggtgtcgtgggggcgttgatcgcgatcgccgtggctctccgccccccgagtgggggtcgagtcgaggaggtcgaacgcgtcggactcgtgtcgcgtcggccatcggcgctccggtctgcgcttgcgacgatgcacccattcgccatcgaccatcgactcgccatcggcgtcgcgcttgcgctgctcgccgggctggctggggcgtggttgctggtcgtcccgtcgatcctcatcggctacgtgctcggcgacctgttcctacggccggcgctcgccgagtcggtcgacgagctctcgtcgatgctccagttcatcatcgactttcgctcagggctcctctccggaggtgtgtcggttccggcggcactcgagctcgcgatcgatgcacaaccagcgggtcgcttcacgcgagatcgtcgcgtgccgtaccaacagatggccgatccctccgctcgcgagggggaggctcgtgttgcgttgagccatctcatcgagcgcacgaccaatccgttgatccacatcaccgacgtgttggtgtacctggcgctgcgtgcgacgaacctgcgggtggcgaaccagctcgatctcctcggcgacgtgctgctacagcaggtccaggcctatcgagggctcgtggtcaccgagctgctctcgtcgctcggcgaggtgcggctcatcaccatcatcaccatcggggcggtgtatgcgacgctcctcgcactcggcggctcgctcggcagcgacatcggactgtcactgctcgcgcaggtcgtcgcccttgcagggagcggggcgcagctcttgtgggccctctcgttgcgtcgtgatctcgagttcaaacttcggtacctgtgaggtcgtgacccatggatgcacggtggctgatcatcggggtcggtatcgcgattggtttggtcatcgccggagccggcgtcgcgctcgccggaggcagcaccctacttgcgctcagacgctatgcggcagcgctgccctcgatcgcgtcgcgctcgcgtgtgccgctcgcgcggcgagtcgttgccgccctggcgcgacggcaagccgacttcgatgccacgctctggatcgcgcactggtccaccgaggatgccgtcgcgcgcctccagcagctgtggctggtgctcgctgttctggctggtggcctcgtgctcctcgcgaaggccgtcgtgccgaacctgtcaccgttcgtcctggcgatcgtcgcggcggcggcgctcgcccttgccgcggtcgttgctcgcgtggtgctggtgtggcaggttcgcgccgaggcccgcatcgcgcgccagcgcatcgacaactccctggccaacctggcgctcttgatccgggtgtacgtccagggcggtgcatcggcgaccgaggcgctgaccgccatcagcgagcttcgaggcgtcatgagcgacgccggtgcgcgcgatgtcgacgcgtggatccagggatcccagcgcaacgaccagaacatcggggccgtgctcgagcgcttcgggaacacctatggtgtgccccgcatcgcgcaactcggctcgtacctcgagcagtcgatcctgtcgggtcggccggtctccgacaccctggacgtggccattcgagacgcttaccaggccctgttcgagtccaccgtcgcggcggtgaaccaacgggtacgcatcgcgtccctggtgttcatccctggcgtcatcgcgatcggcgtggtgttcatggcgtcgatgatcgcatcgatgcacggcatcgggcaggtgacgaagctgttcggcggcggaggcctctagcgagatcagttggtggccgtcagcggcggctcacccgggtagctccagagcggctgccagggagagatcgtcggatcggccatcgcggaggccgggctctgggcctggttggcccacttggcctgataaggaagaccctcgaactccacgacctgaccgggttggtacgtgacggtgggctcccaagtcggatcggcccctggaggcagcgtcgggagtgtcggtgcgtgatcgctctccagcaccggtccgaggagttcccatggcgtctggtaggcatactcgaactgctgcgtgggctgttggccctggttgtaccacttggcctcgtagatgtagccaccccacaccaccttgtagccggcgggataggggaaggacgcgctccagatcgggaagggcgcgttggctgggttggcgctcaccgtggtcgtgacctggatcagcccgcgaccgcgttgcacggacgcagggatctgatgctcgatctcgctcgagaacgcgagcggggctgtctgtgcgtcggagcaggtgttcgagtagacggcttcgttcgccagcgatgcggcgcacggcgcatcacggttcagcgaccagaacgagacccgcccgatcgcctgtgacgtcgaccacgccacgagctgcgacgcgccctggaggctcacccgttgaccgacgacgttgttctgaccgatctggaacgtcacacccatgtggttccagatctggtgggagttgagggggatacggtactcggcgaacagggtcgtgagctgctggtgtgccgccgtgagtgcgctctcggcggtttggacgaggcccccgggcgtcgaggtgaagtccattgtcatcacgttgacgccagcgagaggaacccgcttgaggagcatcgcgcggatcgccgcgatgcctgggtccgacagtccctggggtgtcgctggtagcgtgagccagatctggatcccggggtcttcgtgagccacgatcgacagcgcggctgcccgtcggagcgtcgccgcttgactcgtgagcgcggggccctcgatatcgaagtcgacgatgtgttggtcgtactggcggatgatctgctggtacgcggcggccagcgacgtcggcgtcgtgcacgccatcgacaagtgggtgtgggcttggccgccgaaggacacgatcgcggtcccgccgatgctggcgtactcggcgagccgggagttcagggcgaggtcctggttggcggcgctcggggtatagacgccaccccaggtgggtgagcagccgttcgtgccgctcgcgacgacgaacccgagcaccgtctgcttcgcgtcgttctgggtcggatcctggaacgcataggtcggcgacagcgtggcgtcgacgtacggggcgaagtaggtcgcgtggaccggcgctgcgtcgatgatccgctggtggatgcgccacgccgccagcgagccagctccaccgagcaccatgaggcccatgaggatccgcacagggctgtagcggcgcaggcgctccccgagcggcggcttccgatccggaccgtctccctccagctcgtgcggcatcacgagatcactgacagtgatcaaaggctgcaatgagtggtcaccaagcggagagagctcgtcgtgtgacatcgctactcctgtcgaaacgggtcgttgtcggtacggacgagtgtagcgtggagcggtcgtgtcgggccctcgatcaccctccgtggggttcaattctcagttgagcccacaatgtgggttcgagtacggtctttgccctccgcaacaagctacactctgcgtgagggtggttctaccgtggtgggcggtctgcggtcggtctcctacgagcacgggagggagaacaggttgagtcgccaaccagccggtacgcatggacagcgagcgcaggttcggctcgtcggtcaggccgctcaggtccccgagtcccgcatcgtgacggcgcgcctcgcaattatgaccactattggtggttgggtcggttacctgatctactggttctactcacagttcctgcgccaaggggcctacacgacgcaggcgaaggccgaggcgatcgcctacctcgccatgatcaccctgctcgaggcgtcgtcgttggcgtacctcgtggcgaggctcggccatatttaccgagctcgcgagcatcgtcgggtaccgcgggctcacctcgacggctacttctggcagcgtcgaccgagcctcaccatgatcatcccctcgtaccgcgaggagactcgcgtcattcgcaatacgttgctgtcagcggcgctacaggagtatcccgacaagcgcatcgtgctcctgatcgatgatcctcccaacccgacggaggaacgccatcgcgtcctcctcgaagcggcacggtctctgccgagtcagctcgagtcgctcctcgcgtaccctgccaccgcggctcgtcgagcttacgacgagttccgcgagcgtgtcggttccagagtgagccagctgcccgcgatcgttcacgagggtggatcggactccggtgccgcgtgggacggcgtggtggtcgacccgagcgagctcgaacagctcgccgatacctatgccctggcggcgagctggctcacccttcagagcgaagaactcccgatcatcgaccacaccgacgagttccttcgagacgaagtgttcgtccggctggcccacgaatttgcacagatcgccgacacgctgcgagagggcgcgagctacggccgtgaggtcgacgcggctcgcctcgcgcagctgtacgaacggctcctcaacgtctttggcgcgcgcatcacgagcttcgagcgcaagctctacgcgtcactctcgagcgagccgaacaaggccatgaacctgaactcgtacatcggcttgatgggcggtgcctatagcgtccatcgcacgctctcgggtcaggtcctcgtgtccgacgaccccgagcacgcggacctcgtcatccccgacccggactacgtgctcaccttggatgcggactcgaccctgctccccgagtactgcctccggctcgtctacttgatggagcaggaggcgtacgcgcatgtcgcggtcgcgcagacgccctactcggcctatccgggccccgcgtcgcgtctcgagcggatcgcgggtgcgaccaccgacgtccagcatgtggtccaccaagggctcgccaactaccgggcgggtttctgggtcggcgcgaacgccgtcattcgcaagcgcgcgctcaactccttggaggagatcacctgggaaggcggctacccgatcaagcgctacatccgcgaccgtaccgcgatcgaggacacggagtcgtcggtcgacatcgtcgcccagggctgggaaatctacaactaccccgagcggctgagctactcggccacccccccgacttcggtgccttgtgcatccagcgtcgccgttgggctgatggcggcctgctcgtcgtgccgaagctgtggcgttaccacaagcgggccaaggagaccgggcgtcagtcgttcgccgagttcttcctccgcatgaactacctcgcgtcgatcacgtggacgaccgtcgccctggtcgtcctcctggtgttccccttcgcgaacgagctcgtgagtccctggatcgccgtgctcgccctcccgtacttcttcgcgatgtcgacggacctgaagtacgccggctatcaccgtcgcgacatcttctcgatctatggtttcaacctgatcctcgtcatggtgaacctggctggcaccgtcagctcgatcggccaggccgtcaccggggctcgagcttcgttcgcccgaaccccgaaggtgcgcaagcgcacagtcaccccgctcatgttcgtggtggctccgtacgcgctcgtggtgttgtcgatctacaccctcttgcatgactgggagcaccacgcactcaactcgatgctcttcgcggcgatcaacctggtcctcgcggccgttgccatcgtcgccttcatcggcgtgcgcaacagcatccaggacgtgtggatccagatcctcccatggttccagcggcgcacgaagaaccgtcccgtccgcacgacacgccatcaagaggtgcccgtcggagtcgggggcacccaactgggaacctgggagcacgtcctcgatctcggtgcgtcctcgatcgggttgggcgaggccgtcgataccgacgggcctggtcggttgcgcgtcggttcgcgagcagagcgcgaacgggcgcggcgccggctagccgactacgggctgagcgcgctcgcccagccgatccgtgacattgaggccgacgagatcgtcggctacgagatctatcaacgggtcaacggtgaggcaccgccagcccagctcgccaggctcgacacggtcgaagcggccagccttgagcagcggctcctggagcgcgccgcactgctggcacgtgacatccctgagggcgcgtggctgagcgtgaatgtgtcgtcgcgattcttgaccctgatggaagggcggcgacgcttttccctgacggcgcgcgaggggctgttcctcgacgtgtcgttcaccggcgtgctcgacggccctcacgtcgcggccacagaggacacgctctcgcgtgcgacgaaccggttcgcgatcgccctggacgatttcgtccccgatgcaggatccctggcggtggttcgtcgggtgcggccgagcatggtgaagctcgatcccgactgggtgcatgatctccccaagagtgccgcgaagcgtggccagaccgaactcctgctgcgtctcgctgcgccgcgtacgctcgtggtcgccgagggcgtcgaggacgagcgagagcttgcggcgctgcgcgcgctcggggtgcggtttgcccaggggtacctcctcggtcgaccggtcccgctcgaggagaccaagagcatcgctcctcgcgattaggcctcctcgcccgagtgggaccgccaccactcgaggaggcggcgcctcgcctcgtcgggatcgttcagcccctcgtcgatcgtgaggtcggtgaggaagcgcatcgcgcggcccacggcaggacctggtgggatctcgaggatgcgcatgacctccagtccgtcgatcggaggccgacgcgctcggagcgcgtcgcgctcggcgagctcccgtgcgcgctcttcgaacgtcgccatgcgctcggcgaacatgcgtcgtcggcgctcgttgcgggtggtcgcgtcgcaggtggtgagctcgttcaggtcctcgaggagctcgcctgcgtcgcgcacgtagcgacggacggcggcgtcgctccaaccctgagcataggtgtggaagcgcaggtgaagctcgacgaggcgagcgacgtcgtcgacgaggtcgttggggtagcgcagctctcgcaggatgcgacgggccatacgagccccgacaacgtcgtggaagtggaaactcacgccgttcggcccgatctcgcgagtcgcaggcttgccgatgtcgtggaggagggcggcgagcctcaggcggagccgcggtgagcagcttgcggtgaccgcgatggtgtgggcgagtacgtccttgtggtgatggatggggtcctgctcgagcctgagcgccggaagctccgggaggaactcggcggcgaggggcgtgtcgacgaggaaccagagacccttgctcggatcgggcacgacgagcagtcgagagagctcgtcgcggatgcgctcacgcgagacgacctcgaggcgcggggcgagttcgtggaccgcgtcgacgagcgcgcgctgcggctcgagatccaagcgcgcgatgaagcgtgcacagcgcaacatgcgcagcggatcgtcgctgaaggagcgtcgggggtccatgggagtgcgcaatcggcgcgcgagaaggtcctccatcccgccgaacgggtcgatcagggtcgggtcatcgctcgtgacctcgaccgccatggcgttcaccgtgaagtcgcgtcggaggagatcctcggcgagcgccgagacgaagtgcacggtcggcttgcgggtggaggagtcgtaggcctcgcctcggtgggtcgtgacttcgagcggcacgccgtgatagtggaaggcgaccgtcccgaagcggaggccggtcaggttgaagtgcgtcgcgacgggtctgacgatctccacgatctcctcgggcgtcgcgtccgtcgtggcatccacgtcaccgttcggctcgatgccgagcagtgcgtcgcggaccacgccgccgacgaggtagaggtggcgttgtcgttcgtcgaagcgtgcggcaagcggtcggagcgcctcgatgagtgggcggagtagggcggggagcacgtgccgagaggctacccgcgctcgttcgcgagacctcgctcgagtgcggcacgatgcagccgttggagggtcgtcacgagctcgtggtcgacatcgcggctcggggcctcaccgacgtcgaccgccgcatgcaggagcgtcgcgaacgtgaccagcgtcgagtgctcgagcgcttcgaggtcgtagccaccctcgagcgcgaggatcaggcggcctgggggaacggcgtcgcgcgcgatggcgatcaatggtgcatagtcgggggcgcgaaagtcgagttcggtgagcggatcgtcgcgatgggcgtcgtagccagcggacacgatcgcccacgtcgggccgaacgtggtgatggcggggagcgcgatggtttcgaggagtgcccgtgccgtctggcccgacgtctgcggggggagcggcaggttgatcgtggtgccgaccccagggccatccccgacgtcgccgatgcgcccagtccctgggaacaaggggtactggtgtgtggagacgtagagcacacgaggttcgcgctcgaagatcgcggcggtgccgttgccatggtgcgcatcgatatcgagaatgaggacgcgctcgccctggtcgatcagcgcctgggcggcgatggcgacgttgttgaggaggcagaaccccatggcctggtcgaccgtggcatggtggccgggcggtcgtacggcgaggaaggcggcgtcggcctcgccctgtcgaagccgctcgatcgcgtcgagcccagcgcccgcggcgagctgggcggcctcgaacgacgcgtcgttcaccgaggtgtcggggtcgatcggaccgccacccatgaggcagtaacgctccagtgcctcgacgtgcgctggggtgtggaccgcttcgatggcggctcggggtgcaggtgtcggcgtgacgatcgtgacggcgtcctcgaagtggctgagcgcatggcggacgacctcgagtcgctcggcacgctctgggtgccacgctccagcgtcgtgctccaagaaccgttcgtgcgtggcgtagaggatccggcccacagcgtcatcctacgccacgggggcttctcgacccgagtcggaggtcagctaccataggcctcatcggaaccccgttcgctcacccatacccagagccggccaccgtgcaggtcgcgggccgcagtgtccggctgtctccgtggtatggcttcgacggcgccgtgctgctcggcctcgcaccggcgctgtggctgcgtgatccggcgtggctcgacatcgctcgtcgtgcagcagccgcccgcggttggcgccgatttctcgtacaggcgacgactcctgcgcagcgtcttgcgctcgacgcagcagggtgggtcctcgtcgacgaactctacgtcttgtttcgacgagggtcactcgagctcccgccggtaccccacacggcccggggcgtcgagatgcggcgcgggagggcggccgacaccgcagagctgctcgaggtcgaccatcggtgcttcgagccgttctggatgatgaacgaggcggcgcttcgcgaggcgctccaggcaacgcctcgcactcgcttccgggtacttgcgagcgccgacgacgatcgagttgttgggtacgctatcttcggccttggcgccggtgagggctacctccaacgcatcgcggtcgaccctcgctaccagggccgggggctcgcgacgcgattgatcgtcgatggcctgcggtgggcgaagagatggagagcgcgccgagtcggtgtcaacacacaacgatcgaacgagaccgcccttcgcctctaccagcggcttggcttcgagatggagccgaacggcatcacgatctatgcctggccggatcactagtcgtctcgtcctcctcctcgccctcgtcgtgctgggtgtgtggttgcccaggggcgcagcgctcgtcagtaccgcgcgggaggccgtgaccgtggtctcggcgcccggcgtcgtcgtcggctcgcagccgatcgcggcgacctttcgcctcgcgcatcgtctccacgacgcggaggctttcttcgtcgtctatcccgccacgacgtcggtgagcggccttggtgcggtgctctcgggcgcacagctcgggtacccgatcgggatcacccacgccgtcgccgtgtccccgcacgcctcccagatgcacctggtggtgccagacccgatccctgccagcggctgtggcacgagctgcagcggcgtctacccggtgcagcttcgggtcgcgagcgcggtgagcgggcagaccctggcgtccgtgacgttcgcggtgccgtacttctcgacgctgagcggcgtcgttccgctgcacctcgccgtcggggtcatcgccgagacccctgccgtgacagcgtcggcgatcgaggaactcctcgcccgagacccgagcgtccaggtcggagtgagcgccgaaggcccggttggcctcggagcgctgcgctcgctcgcgcacgccgtgcctcttcgtgcatctctgctcgcgcccaccgttggcgtcgcacgcgcgtgtgtgggggcgctcgggcccttgtcgtcgttcgcatcgtcggttcagctggcgcgtaccgtcgttggcacggccagcgcgccgctcgcgttcgccaccgtgccgacgtcggacgaactcgaaagcctccgagcgctcggtatccacgaggtcatcctcccggcgtcggcccttgcgtcggcgtcgccggtcctgacgctcagcaacgcggtgcgcctcggcgcaggtgtggtggcactcggcacctctgcgatggtcagcgacgggctgagctcggtgacgcagcctctcggggcgcagctgctcatggccgaactcgcacaggtctacttcgaagctccctcgagacctgggcgggtactcgcgggtctcgtcgccgtcgcgagcgatgcgcgtatggcggcgttcgctcgcgggttggcaagcctgggcagcctccccttcctccagctctccaccatcgatggcgcgatggccaccgcgagctcgaccgtcgttcggccgaacgtcgccgccgagagggcgtgcccgcgcccactcgaggccctgcgcgtcgccgcgcgtcgtgccgcggccctcgccgaggctgcgcccggggtccgcccggagctcacggcgttggtgctcggtgccctggctcatcccgaggcaagccagctggcgcgtcacgccatcgatcgcaccctggatgcgatcacggtcgcctccgatcagctgacgctcacgagcgctcgcgagacggtgcccatcgacatcacgtcgcatctatcggtccctgccagcatccgagtcgtgctcgtcgacaccaagctccggttcccggagggctcgacacgcacggtcaccgtggcgtcgaagaccgtgacggtgcccatccctgtcgtggcacgcacgctcgggacctcgccgctcctggttcgcctcgagtctccctccgggcagctcatcgggcagaacgtcctcgtggtggactcgaccggtttctcggtggtgggcgtcgtgctgaccggttcgtccgcagccctgctcgccgtgtggtgggttcgcaatcggggtcggcgccagcggggccgacacgcgaagcggagctgatggtgcaggcgcgtctcgtgcggctgctggccggtcgcggtcgttcggtgggcgagaacgccaccgccatggcgatcgggacggcggcaagtcgtctcagcgggttcgtgcgcctgatcgtcctcgcggtggtgctcggggtgcgtccgttggccgacgccttcaacctggcgaacaacacgccgaacatgctctacgacctgttgctcggtggagtgatcagctcgacgatccttcccgtcgtggcggctcggatcgcgagggcgggggagcgagccggcgagcgctcgctcgctgcgatcatgacgatcggggtggtgggcctcctcgtggccacggtgctcttcgaggtcctcgccccggccgtcgtcgatctctacctcatcggcgaccatcttgcggctgcgggcacggagcgcgcggtcgcgatcgagctgttgcgcttgtttgcaccgcagctcttcttctacggcacgatctccctcgccaccgcggcgctcaacctgcggggcaactttgccgcccccgcctttgcgccgatcgcgaacaacgtcgtggcgatcgcggtgctcgtcgcgttcagggtcgctgacggctctgccaccctcgacgaggtcgcctcccgtccggacgcggtgctgctgctcgggctcggaacgacgctcggggtggcggcccagctcggcgtgctcatgccggtgatggcgaggctcggtctcggactgcgtccacgtctgcgcgtcagcgaccccgcggttcgcgaggtcgtctcgctgtccggctggacggcgggctacgtcgtcgccaaccaggtcgctctcttcgtggtgctcgcccttgccgcgacgcgggccggctacgtgtcggcctacaactacgcctacctgttcttccagctcccgtatgcggtggtgtcgctgagcgtgatgagtgcgctccagcccaggctcgcacgctcgtgggcagctggcgatcgagcgagattccggcgtgatctcgccaaggcgctcgccgtcggcgtcggtgccaccatccctctcgcggtgctcgcgtgggtggggggacctgccggcctcgatctcctcgtcggctatggggcggtcaacgagcacggcgtcgccctcatcgcgggtgcgctccgcggcatggcggtcgggttgcccggtttctcgctctttctgatgctgatccaggcgctccaggccatgcgcaatgctcgagctgcgttcgtcgcctacctggtcgagaacggattgaacatcgtcctcgccgtcgtcgcgctcggtccgctgggggtcgagggcctcgggctcgcgctgggactcgcctacaccatcggcgccatcgtcgcgatcgtcatcgttcgctcgctgcggggactcggccccatcgcgccgctcctcggctcgtgggtgcagctcgccgtcgcaagtgtcgtcggtggcgccgtgctggccgcgctcctccctagcacgctcgtcgcgccgaaccttggttttgccctgcgtgtcctcggcgggttggtcgcgggggtggtagtcttcggcgctgcggtgatcggcctccgcacaatccgagtggccgtggcgaggggagtcggacggtgagcgtcgtcgtcgttgcggattcagcgagtgatcttcctgccggggtggcagaggcgctcggtgtgcagatcgtgccgctcaccatcgaggtcggtggtcgggactgggccgacggcaccgagctcccgcgcgagcgtttctgggagctccaggcggcccagtcggagctgccgaagaccgcggccccatcgtcggcgcagttcgcggccgtcttcgaacgcgcgctcggtgagggcgctgaaggcgtggtggccatcaccttgacgcgcaagctctccgcgaccttccaggctgccgagcacgcctcgcgagactatggcggtcgggtgcgggtgatcgactccgagaccctcaccctcacagaaggcctgatcgtcgaggaagcagcacgcctcgctgcgagcggtgcggatctcgaggaggtcgcggcagcggtcgaggacgtgaagacgcgcgcgagaacccgtggcaccctcgacacgctcgagaacctccgccgaggcggacgcatcggcgcggcagcagcgctgctcggcacggtgatgtcgttcaagccaatgatcgacatcaccgacggcgaggtgaagccgggcggtcgccagcgcacgcggcgtcgagcgatcgacgatctcgtcgactgggtcgagggcctcggtccgctgacgcggctcggcgtcgtgcacgcgctcgctgacgacgtcgacgaggtcgtcgagcgcgtcgctcgcgcagcggcagtcgatcccgccacggtggcagttgcggtgatgggtgcgacgatcggcacccacgccggtccacgagcacttggagtctccgctctcgtggcctccaggtaggctgggagcgttccacgcgagagcggccacaccagagtccgtgagacgagcccagagaggagccagcatggcgaccttcgaaacgggaggggagcagccggacgtcgcggctcgcgtcgctacctgggttggcgaagcggtgtcgctcattcggtcgcggaccgtcgatccggcggcgttcgtggcccgtgtgctggtgtacggactgctcgcggctgcggtcggtgtcgtggtgctcatcttgtcgatcgacgccgtcgtgaagctgctcgatgcgtatgccttcggcaatcgagtctggatcactgagttcgtcgtcgcagccctctcgctcgccggatcggccgtggcgtggcggcggatgggacgtgcgcgtcggcgtctcggcgcttgaaccagcgcaccacgttgaggaggtagtcgtgcctgagcacgtcaaggtcgtcatcatcgggtcgggtccagctggcctcactgccgcgatctacgccgcgcgagcgtcgctcgagccggtcgtcatcgagggagagccctcctcgacgtccgaccagcctgggggccagctgatgctgaccaccgagatcgagaacttcccagggttccccgaaggcatccttggccccgagctcatggccaacatgcggcagcaggcggagcgcttcggggcgcgctttcggggcaccaaggtctcccggctcgatcttgcggagcggccgttcgcggtccacaccaacgacgatcgaagcggcgagccggcttatctcgccgacgcggtgatcatggcgaccggggctcgctcgctcatgctgggactcgaacgcgagtacgaactgatcggccacggggtgtcgacctgcgcgacgtgcgacggcttcttcttccgtggccacgacatcgcggtggtcgggggcggtgactcggcgctcgaggaggcgctgttcctcaccaagttcgcttccagtgtgaccatcatccatcgccgtgatcagctgcgtgcgtcgcgcatcatgcagcagcgggccttcgcgaacgagaagattcggttcgcatggaaccgtcgcgtcgtcgaactgctcgagcgcgacggtgtcctggtcggtgttcgcaccgaggacaccgtgaccggcgagcgcgaggatctcggagtcactggactgttcatcgcgatcggccacgccccgagcacggagatcgtcaagggtcagctggagatggacgatgcggggtatctgatcacgaagcctggctcgaccgagacgagcgtcgacggcgtgttcgcagccggggacgtgcaggatcacacctatcgtcaagcgatcaccgctgcgggctctggctgtcaggcggcgctcgacgtggagcggttccttgctgcgcgcgagtagcgggaagcatcgggtcgcagggggcgttcgttgctgatgcaacaagataagggaggtgcgcgatggcgggacatgaggtcatcctcacggacaagaacttcgacgagacggtcaaggcatcagagctaccggtcctggtcgatttctgggcagagtggtgcgggccatgcaagatgatcgacccgatcctcgaggagctggccgacgagatgagcgacaagctggtgatcggcaagctcaacgtggacgagtcgctcgagatcgctcgtcgcttcgagatcatgagcatcccgacgctgatgctcttcaaggagggcgagccggtgaagcgagtgatcggcgcgatgccgaagcgagccctgctgaaggaactccagccggctctcgaggactagcgcctgggcacgtccccgtgccgttcgtctctttgcgagggggcgagcgcagcgagcgtgtcgaggacttgtgtcgacggttgcggcgcctcgggttcgagctcgaggttcgtgacgagttcgacgatgaggtggccgaggccatcgtggccttccaacgacgtcgcggtctgccagagaccggggtggtcgatctcgtgacgtggcgcgcggtcgtcgaggcggggtttcgtatcggtgatcgtctcctctatctcaagcggcctgcgctccgtggcgacgacgttgcctggctccaaggcaagctgggctcactcgggttcgaccctggtcgagtcgacggcatcttcggtccgcgcacgcgcagtgcgcttatggagttccaggccaatatgggcctgcctgccgacggcatgtgtggtgcggcgaccatcgaggagctgcgacgggtcgatctgcatcacggtgcgcacgtacatggcgtgatcgagcgactcagccgcgccgaccgtcactctcggttcagtgacgtcgcggtcgtcgtcgccgccgaggcggcgctcgaaggcgtcgcggatctcgtcgcggctcgggtgcgtcgccgagggggccgctccgtcgtgctcgtcagcgacgtgcagtcggaacttgcccggacgatcaacgatgtcgcgccagacgtcttcgtccatctcgggtactcgctcggtggtcgttacgtggcctactactcgggctacaactacgtctctccggtcggtcggcaactcgcagaggtcgtctcccaaaccgccggtgcggtgcgaggactggtggagcgaggcatgagcatcccgatcttgcgcgagacgcgtgctcccggcgtctccattgcgttctccaacccccacgagtggtggatgctggcccccgatctcagcgacatcatcgtgacgagcgtggaggcggtggtgtgtcgagcgaggccgacgggaaaccatcgcgactgagtggctcgtgcgtcgtcatgagcgaactcccggtccgtgccgatggcacgccttgcgctggtccgcgggcgcgaacgggtatgatcggagatcccggggctatagctcagccggttagagcgcagcactgataatgctgaggtcgctggttcgattccagctagccccaccgtcctgacgagggttgtttcggcggaccggtcggcgatccgggcgttcgcaccgcatcggcaccacacgaggtcgcgggcctgtcgcgggacggctgtgtcggggtgccagctggattccttcgaaccgcagccccagtctgctggaaggtccttccaccctgactgcgatgctcgacgcgtcccgctcgagctgctcggaccgtcgatcggtggccttcccgccgtctgctcgacagtccgaggtgaagccagggccatctccccgcgggcccaggcaagctccgactcgaccggcggcacgtacccgaggcgcgagtgcagccggacagtgttggggcgccggatccagggagcgatgccagagggggccccggcgaggttggcgaagcggccgcaagctaccagctcgcgctcgcaagctcccgaagaaggcctcggccacggcgttgtcgtcgcaggtcgcgatcctgcctaccgactggcgaagcccgagcatcgcgctgagcgcgcgtaccgtacgggagaggcatggctccagtgcaacgaccggtcgcactggacggtaaccgacacgtccgcaccttggaatatcgacaatccgctatggtggcggcatggacagcgtcggcgaggtgctgagggaggcccgacgtcgtgccgggctgacgcaggcggaactaggtcgacgcgccggggtgacgcagagcgtcgtcagtgcgtacgagtccggtgcgcgccagccatcggtgtcgatgctggctcgtctggtcgccgccgcgggcgccgagctgcggatggagctgtccgaacctgcgggggccgcagcgccaggcggtgaactcggccagcggctgcgagaccgccgcgccgagctccagaggatcctggcccgctacggactgcgcaacgcccgcttgttcgggagcgtcgcccgcggcgatgcgggtccagacagcgacatcgatcttctcgtcgacgtgcctggcggagtgggcctcgtgactcttggacgctgccaggctgaggtcgaacagctcctcggagtccacgtggacctggtaccggcgagcgatctcaaggctggcgtcgctgccgaggttctcagcgaggcagtgccactgtgagccctcgggaacgtcagcgccttcaggacattctcgtcgccatcgccgtcatccgctcacacctcgagcgtggtgacctcaatgacgggctcgtcgtcgacgcggtacgagtccggctcatcgagatcggccaagccgtcaaggctctcccccaggagctgctcgcacaggagccagccctcccctgggcgcagatcgccggcatgcgagaccgtctcgcccatcgctacttcgacgcctcgcacgccatccttgccgccaccgtcaacgaggacctccccatcctcgaggcggctgttggccgtctcgagcggatcgtggcggatgcggccgtctggccacggccgtgaacttccgccgagcgagcctcgcagccgagagaccggctggcgaccacggccgtcgctcgggtctggctaggtgtctcgttcatgccttcctcctctcgcaggtgtcaccctggaggggggacagcaacggtcgtgggaggatccgctgcggcgatgagatcgcctccgtggacgccacgccctcgaccatggccgccggtgcctgcgccgtgcgtgggcggcccaggcgatggcgatcgcaggaggtgaggcgggggagcgagctcaccaggggcgtcgtcgacgcagctacgccctctcgcgcagtgcggtgaggaactcgatgagccccgccatgtaggtcgcctggtcgtcgtacatgcacatgtggctcccgttcggacataggaggaactggccctgcgggagacgctctgccatctggcgcatgtggtccgggtccatggtgtcatgagtcgcgccgatgacgagcgtcggcacctcgatggataccagatcgtcgaagcgatcccagtccttcagcgaggcgtcgcccgccatgcccatctcgctcgggccctgcatcggcacgtagatgtcgcgattggtgtgggcgaaggcgcgtaccaccggctcgggccactcgtcgagcggcatgcgcagcgtgtgttcgaggtagtagctccccatgagcagttcctcgtagcggccgctctcggtgtcgccggcggcctcgagcgctcgtgcttcggcgacgatcgctgggtcgagggccgggatgaggacctcgtcggcgtaacggttgtaggcgggagcactcgccatcatgttggagatgaccagccctcggagcgtgtcgccgtgtcggatggcgtactccatggcgaggatgcctccccaggagtgcccgagcagcacgaagttggacgcgtcgaggccgagggctcgtcgaacctgttccacctcgtcgacgtagcgatcgagtgtccagaggctggggtcgtcgggacggtcgctgcggccgcagccgagctggtcgtagtagatgtactcgatcgcagcgagcggcaggtagctgtcgaagcactcgaagtactcgctcgtcgcgccgggaccgccgtggagcagcaggactcgcaggtcaggggcgttgcccactcgcttggtccacaccgagaaggtccctcgaggcgtgtggatcgggatgcggcgggcaccacccgagagagcgtcgtcgcgggtgcgcgcgtcgagatagtcgtgcaggtccatcgctgcccccttgcggtcgagacgtctcgacgctagtgcgacgagcggggcgactggggccgaaacccctggcgagcgatcgcacgtaggctcgatgcatgacccaagcagcaacgtggcgtaaccgtgatgtgtggctgatctcgttgtccgctggttttgccgacctcggctaccaggcgatcgtcgccggagtaccgctgctgatcgtcgtcgacctgcgtgcgagcgccctggtgtacggcgtcgccgccggcctcggctacgggctggggacgttcgcgtcgctcgcgggtggtcggctcgccgaccgcatcggtcgacgtccggttgcgatcggcggcaacctcggcatcttgctcctgtcgctgatcgctctggcgagaagtgtccccatcgtcgtcctgctcttcgtgctgggctggctcgcgcgcaacttccgctcgccggttcgccgggccatgctcaccgaagccgtcgcgccggagtggcgccgcaatgcattcggccttctgcacgccgtcgacgtgggtggcggcgtgctctccgcgcttgcggcggtcgtgctcgtcggtgcgcacgtcgtcggtctgcggggcctgttcgccttcaccgcgatcccgatcgcgatctcgagcctgctgctcgccagcgcgcacccgcaccgtacgggcggcgccggcgcgcgtcgcgacgtcccgacggcgccggcgagcacgcttcgtcgtgcagtcctcgtcgcgaccgccctctatggcttcagctcctatgcgctcggctttccggtcctcgcggtcgcggcgcgctcaggatctgccaccgagggcttcggcgcctatgccttgttcctcggcgcctcggcgatcactggctacgtcatcggtgcgcgccgcgggtccccgatcggttggctcgcgcttggcggctacggcctctcggcacttggctcggcgctcctcgtgcccgagagcgcgatggtctcgatcatcggggttggactcctcggggtggggctcggcgtcatcgagacgttggagccgaccgtcatctcgcgactggcaccggacgcggctcaaggaggtgcgctcggtgcgctctcggcggcgcggagcgtcgggctcttcgtcgctgacgtcgtcgcgggtctgctgtatgcctcccacggaggtgtggcgttcgtctacggtgcggtgctcgcggcggtcgctgcgatcatcatcggcgcccaagcgccgctggcccgccggacgttcccagcgggccagtggtgagcgaagagcgcgtctagcgatcggcgtcgccgcgggcgaactcctccaccgcgcgtcgcgcatcctcgtcgtggagctggcgcggcggtgacttcatgaagtaggccgagggtccttcgaggggcccgccgatgccgcggtcgagggcgatcttggcgcagcgaacggcgtcgatgatgaccccggccgagttcggcgagtcccagacctcgagcttgagctcgacgttcagcggtacgtctccgaagttgcggccctcgaggcggatgtaggcccacttgcggtcctcgagccacgcgacgtggtcggacgggccgatgtggacgttgtgggagtcgatgccgtgctcgatctggctcgtcaccgactgcgtcttcgagatcttcttcgactcgagtcgcgagcgctcgagcatgttcatgaagtccatattgccgccgacgttgagctggtaggtgcgatcgaggacgagtccgcgatcttcgaagaggcgagccagcatgcgatggacgatggtcgcaccgacctggctcttgatgtcgtcgccgatgatgggaacgccagcctcacggaagcgctctgcccagaccgggtcagaggcgatgaagacagggatcgcgttcacgaaggcgacccccgcctcgagtgcggcctcggcataggcacgttgggcttgctcggagccgaccggcaggtaggcgacgaggacgtcagcacgggcctctcgcagacgcgccgcgacgtcgacgggcgggaggggcgactcggtgacgacttggcggtagtaggtgccgaggccatcgagcgtcggtccacgatcgacggtgacacccgcctcggggacgtcggcgaacttgatggtgttgttgtggctcgcgaagacggccttcgacacgtcgaggccgaccttctcgtcgtcgacgtcgaaggcggcgacgacctcgatgtcgcgcacgtggtaacccccgagcgtgacgtgcatcaggcccggtacgtcttggtcgtcagtggcgttccggtagtactcgatgccttgcaccagcgagctcgcgcagttgccgaccccggcaatcgcgaggcgaatcgttcccattctgttccccttctcctttctgagcgccgatggtctgagcgtcgatggctcgccgtcgtcggccgcatgtgacgacgttcgcatcgtcacgaggtcgtcgatgcgccgtagccagccggcgcggcgtcgaggaccgcgagttccgaggccgtgcgtgcccggacgatgtcgagccagaggtcgggcatctcctgctcgagccggtcgagctcctcgagacgctcgacgaggctgcgccgacgaccgcgcagcagtgcgcggcgcgtctctggcgcgaccagcgaactcgccaccagcgcgatggtcgcgatgcgatcgtcggccatgtcggcgaactcgagcgcggtgcgcaggcgcgcacgtccctcgtcggtgatgcgataggtccgtcggctccggccacctgcggtgctggcagccaggaccaactcggccgcgaggacgccggggaggcgagctggatcgaggcgacccaccgcaccgacggaggcgatgagcccactgcgcgccaagcgagcgagcgccggatagatcgaaccgtacgagaagcgaccgatctccccgaaggtcgcctggagccgacgggcgacctcgtacccatgggccggcgccgcctcgagcacgacgagcgtcgcgagttcgaccgccgtcagctctttcgcgcgctcggacgagaccatggtgcgtagcatagtggctgatacgagatatcgattcgatatagcggccgaaaccctgattccggccatcgtgcggtggaggcgctaccatggcgtcgtggatcaaggtcgcgcgcgcgaggtcggtggtcggctggccaccagcgtcgatcaccgcctactcaggtggcgaacgctgcgcgccctcgctgccggaaccatcgtcagagaagacgtgtgtgatgccggtttcgagctctcgcgtgcggcgagcgcgttcggcattccccgaggggtcgtgtgtcctgtgtgtgctgccgatgcgttgcgtgaggttgcattcgccttcggcaaggggctcccgcacgagggccaggtcgtcgggggcacgctcgtcgaggaggcgctcgacgcggtgccggatgttcggctgtttcgtgtcgaggtctgtctggcgtgccgttggaacttcgtgatcgaagagcgcggtcacaccggcgtgcgatagggttggatcgatgccggtgtcacccccggcagagcgcctgtagcgcgaggagcgcacgggacctcggagagggggaaacatggagtcagcgtcgatgagcgaccgtatcgcgacggtcccggccatcgctggatcgaaggtacgctccgggagtcggccactcgtcatggtgaccgcctacgacgcgccaggggcgcgcattgccgacgacggtggcgtcgacatgatcctcgtcggcgactcggtggcgatggcggtgctcggcatgcccgacacgctcggggtgcgggtccgtgacatcgcccaccacgtagcggcggtgcggcgggcgcagccgagagccctcgtcgtcgcggatctgccatggttgagctaccaccgcggacgtcgccgtgcagtcgaggccgccggcaagctcgtgcgcgccggcgcgcaggccgtcaagctggaggggggtcgcgaacgccttgacgtcatcgacgcactcgtgcgcgcgcagatcccggtgatgggtcacctcggcctcaccccccagagcgcgaacgtcttcggtggcatggtcgtccaaggccgttcgatcgtcgcggccgaacgcatcctcgcagacgccatggccctcgagcaggcgggggtcttcgccatggtcctcgagggaattccggccccgatcgcctcggtcgtgacggctcgcgtcggcgtcccgaccatcggtatcggtgcgggcgcaggttgcgatgggcaggtcctcgtgttccacgatctgctcgggttcgccgatggccatcggccgcggttcgtcaagacctatgcggagctcggcgccgcggctcgcgaggcggtcgccgcctgggccaaggacgtgacggagggcgcctatcccgatgacgcgcatgcctaccgcgcctctaccgagctcgctgcgtgggccgagcgacagctcacgagcgaggagcgtcgtgggggcgcgcctcgctcctagtcgctgggcgcgatatctgcgaagcgggtccagtcggcgatgaaggccaggttgacggtgccctggggaccgttgcggtgcttggcgacgatgatctcggcgacgccgcgatcggtggtgtcggggtggtacagctcgtctcggtagatgaacatgaccacgtcggcgtcttgctcgagagagttgtgcacgatgacgccgtcggcgacgaacgcatgcgtctcgggtacctcgatatcgaagacgagctccgtgccgagttcgtcgaccgactcgacgacggtcgtcgccaccgtagtcgcatccaggaggacgtggaccacgtcgccggatacgagggtcccggcctcccgccatcccgacgatgtggcgatcgggtgattgccggtcgcgcggaggatcgagccgttggcgagggtcaggcgtcgcagtggcttgaggccggtggccacgacgcgtgtacccatggcgaccgtcggcacgccctcgggggtgacggatgcgagcggaacggatctcgcccccttgctccagagcatgccgatgggaacctcggtaccgtcggcgaggcgtaccttggcgtcccacgagaggcaaccggactcgcggaggtccgcgagttgcgggcgacgatcgctgcgtgattcgaggttgcgcgacagctgggagagcgcgatgatcggcacgtcgagctcgcgggcgagcagcttgaggccacgggagatctcggagacctcgagctgccgtgactcgctctggcgtcgactgctcatcagctggaggtagtcgatgacgacgagcgagagtccttgctcggccttgatacgccgcgcgcgcgtgcggaggtcgaggacggtcaggttcgggtcgtcatcaatgaggatcgggcgcgtggcgagttcgccggcggcgttggagacctgatcccactcgcgttcgttcagacggccggagcggaggcgttgcgaattgacgcgcgcctgcgacgcgaccagccgctggccgagctcgatgcggttcatctcgagcgagaacagcaggacgggctcgctctggttgcgggcgacgttcagcgccatcgagagcgcgaaggacgtcttgcccatgcccggtcgagcaccgacgatgatgaggttcgatcgatgcaagcccgtgagcagctcatcgaggtcgcgaaagccggtcgggacggcgaaggcgcccagatcgtcggagccggcgacctgctcgagctgctcgaggacctccatcagcacctgctcgaggtgcgccgcggactcgtgactcgtgccccgcgcgacgttcaggatgctggcctcggcgtgatcgagcagcgcgcgtacgtccttcgggaggccgtaggcctcctcggcgatgtcagaggcggtccggatgaggcgccgaaggatcccgtagtcgcggacgatctgggcgtagcgcccggcggacgcgatggctggggtctggatgaccagacggttcagcccctcttgaccaccgagcgcctcctcgatgcccaggcgacggagttcgtcgcccaccgagaccgggtccgtggtctcaccgcgggcgtagaggtcagcgaggacgcgaaagagctctcggtgtgacggtcgaaagaagtcgtcggcttcgacgagttcgacggcgtccccgatcgcttctcgcgacagcagcatggccccgaggagcgactcctcggcctcgatgttgtgcggcggcagccgatcctcgggcccttgcgagcgggccatcgcggaccggggctcagcgctcgctggccgcgaccgaaacggtgatcgccacgtcgacgccgtggcccagcgcgatcacgacggggtgctctccgacctgcttgatcggagccggaatgcgcacgtgctcccgttcgatcgtgacgccggtggcttcggcgatcgcgcgcacgatgtcggcggccgtgatcgacccgaacagcgtgccctcctcggaggcgcgagcactgagtgcgagctcgatgccggcgagctgacgcgccgtggcctcggcctcggcacgctcgcgctcgcgtgcgagctgtgccttcgctcgcatcgcctcagcttggtgggcgatcttcggcgtggcggcaacggccagccgacgcgggatcaggtagttgcgggcgtagccatcggcaacgcggacgatgtcgccacgatcgccgaggccttggacccgcgcgcgcaggaggacgttcatgcctgttcctcctcggctgctggcgtctcttcctcgtcggcgctggtgcggtcggtggcctgggcgcggttccgcgagcgcagctcgcggtcaccgacgggctggtcgccctggttgcggcggcttcggtcggagaccggacggatcacgtagggcagcagtgcgagctcgcgcgccaccttgatggcgttggcgacgtcggcttggtgctgggcacagttacccgtgacccgccgggcgcggatcttggctcgctccgacgtgaaacgacgcaggagatcgacgtccttgtagtcgacccagtccacgtgctgctggcagaaaacgcagggcttcttcttgatgcgcttggtctcgggtgcctcgcggccccgacgcttgcgcttggtcgctgtcttcggcattgcttagaacggctcctcttcgtatcccacgcccccgtcggcgacaggggacggctcgttcgtcacgggtctgcccgatccggtccgacgctcggtgcggtgcacctctgcggttgcccaacggagcgacgggccgacctcttcggccacgacctgaaccttggatcggcgctctccctctggcgtttcccagctgcgctgttcgaggcggcccacgatgatggcgcgagaacccttctcgaggctcgtcgagacgttgtcggcgaggtcgccccagcagatcacctcgaagaacgaggtggactcttcccactcctgggtctgctgattgaggcggcgtcggttcaccgcaatggagaagagcgcctgggcccgaccctgggcggtgaagcgcagttctggctccttcgtgaggttgccgacgagtgtgacggagttacctgctgacatggtggcctttcgctcggttcacccggcctaggcgcggcctggcgcgccgaggagggggatcttgccgttcgcggcgagcgcgtcagggagccgaatggtcttgtgacgcaggacaccgtcggcgatcgagagcacacgatcgagttcatcgatcgtcgctggttcggcgtgcagccgaaggaagctgtaggcaccatcggtgcggtgtgcgatcgggtaggcgagcatgcgccgaccccagtgcgcttcttgggtgatggctccaccgccctgattgacgatggaacgaattcggtcgaagagcgcggtgcgcgcttcctcgtcgagcgctggtgacgtgatcagcgcgagttcatactcccgcatgtgggttcctcctgtggacctgggatgccagggccccatgatggggcagggtggcgccgagcgccacagcgagcatagcgcacctaggagtgcgcccgcgcctgaccgatcggcggttcgtcgtgtcgatggaggggaagttgcgcctcgagctcgtcagggatcagtcgactgagggaatggaagaggaggaacgagaagccgatctggaagatcacctcaccctggaacagaaccatgatcccgtcgttcggcagcgagagcagcgccatgacaccaccgacgatctgcatgacgatcatcgtcgcgttgaaccaggagcgcgcgtagcgccaccagatccaccccgacatgagcagttgctcgacgaagaggatggagccgagggtctggtgggtccagtcgaagagggtgccccaggtgtagggggtgaacgcgatgccgacgatcagcaccgccatcatccggagcgcacggcgcagcacgccgagcccgccggtcgtggggaggtcacgtccagccctccacgagaggacggcacagagcacgaagccgatcgcgagcgggatgaagctgtcgaggtgggtcaggtagtagctgatgccgtagccatcgatcgccgaactcgggtaccagatcgcgacgagcagcagggcgccgaagagggcgaggtcggcagcgaggagccggtcgagtgtcttcgtccgaagcatcgctcgcctcccttcgcggtcaggacttcatcgtcgctgtgccatctcccaataacgttgcattatacaaccgtaatcccgccccgcgaagccacagctggtgttcggtcgctgaactgccagcatggctcatcgatggcgtcctagactcctcgcggaggtggtcgtggtgggacagcggtgggccgccctcggtacgtcgggccggatcgtcacggtcgtctccgtgatcgtgctgatcgctctgttcctaccgtggtacggcgtgagcatcggatcgctgagtgtgtccgtcgatgggttgcactcctacggcctgctgaccgccctcggtgtggtcgtcgtcgccgtcggtgtcggcgcgaacgcgccatgggtgcgtggtgcgcgtcttgccggggtcgtgctcgaggcggtcggcgcagtcgcgttcctcgccgcctaccatgcggcagggtcgacgagcgcgctgtcggtgtcgttcggacccgagatcggggtgtatctcgcgctgctcgcgagcctggttggcgtggtcgcggcgttgaacgaacgccggcgtgccgtctgatgcgtcgcctcgcgtggatgatggttgctggcgccacgctcgcggcgtgtggtactgcgaccgcccaggtgaccggtccggtcgctcgtgcggctcgcgcgctcgcatcggtgccgttgcacttctgtttcgtcatcgacgcgaccgcgcaggacgcgcaggagcgcatctcgggttgtggtgacgagtccgccggtgcccgtcggttggcgctgacgcagaacctcctcgagcaggtcggaagccaacgccagcagagctcggagggtgtgatcgagattggctcgaaggagtgggtgagctcgagcaaggtctggcaactcgtgacgccgaccacgaacgtgatcgagccgctcgccgtcgcggacctcgtcgacgcagcgcccggcttcgtcgtcggccgtggcagcgtcgtcgacggtgtgcaggcgctcgcctactcgacggtgctcgagggatcgtcgctcagtcggacgcttgcgcgccttccggcggcgctcgcggagcagtatcgcggtgagaacctccgcagtgacgacctcaccgtggagctcagcccgcaggggcggttgctcgaggtcgaccagcaccagtcgctcgtcgtgtcgggtcaggcggtgaccgcggtctcggttctggtgctgtcgcgtttcggccagtccgtgacggtcacgcccccgtctccggtcgccggctgagtcggtggccggccagcacggcagcaacggtggagagcagcaccacggcgaggagcgcttcgccgcccgcagcgccgatcacactccgcagcgccgtcgcgatcgcgatcgtgacctcgccgcgcgggagcatcccgacggcgatccagcggtcggggcgtgcgatgagcaggtagaggccaaggcgtgagatggcgagtgcgaccaggaggccgacgacgacggcgacgttcatccgccagagcggaccgagcgagccgagcacgaaccctgccgtcgcaaagaacatgaggccgagcgtccggcgcgaccacgtgaccacggcggctcgaggaacgaggtcgtggaggagcgcaccggcgagcgcaccggcgagcgcgggtgacgtcccgaacgcacaggtcgccgtcacgacgagcgctccgaggagtcgtggtgctcgcgcacccgtttgtcggaggaccagtgcgatgacgacggcgacgacggtcgcgaccacgctggtgggacgggcgccggtcgggagcacgaaaggcgcagcggcgagcagtgccaagctgacgaggtcgtcgccgatggctgcctgcaggatcgacgtccgggagcctcgtggaacgtgggcgagcgggaggacggtggccgccaacgccccgctcgtcgggatggctgcaagcgcgatggcaagggctcgaacggcacccacgccacttacgaggacggcaccgaaggcgccgaggccaaggaggctcgcgccgatcccggcgatggcgaggccgcggcccgcgatcgggtggctgccagagccttggagctcctcaccgatcccgaagagcacgacgtagacgccgagcgactctgcggtcgtcgcgatgtgggtagcgacggccggatgggggagcagagcgacgagtgtcccgacgacgagcatcacgagtgcggttgggatgcggctcgaggagtgccgcagggatccgacgatgctcgcagcgagcaggaccccgagactgagcgccgtcatcgccgacctccaccgtcgaggtgctggcacgcgagattcagagcctagcctggaggggtatgcgacgcagacctcgacgcctgagcgcgcttgtcgtggtggcagcgccgttggtgctggcgagctgtcacttttccaacggcgactacggaccggcgggtgccggtgggggcacgacgtcgtcggcgagctccggtccgatcggcgcgaacacgaccgcgccggacgcaaagctgctaggtggctcagccgccccgaagacagcgtcgacctacgacggtgctggctttccgattccgacgtatccgccggttccgtgcccgagggcaacctgcctcaacgggtcgcctctcgagccggtggagatctcgtggcgcaactcgccgtatgggccgatcctcacgacggcgagcggggagaccctctacctgcgccttggcgacggctttcgggagtcgggctgccatggcatctgcctccgagcgttcccgccgttgctgacgaacggcgccccgcaggcggcccctggtttgctcgcggcggatgtgggcgacttgaccgcgtcgaacgggaaggagcaggcgtcctacggcggtcacccgctctacacctaccgtggcgatacgaaaccgggtcagtacggtgcagagggcaagggcggcatttggtacgtggtctcgatcacgggcctaccggtcaaggcgccggtgcattctggcacctcatcgagctcggccactacctcgacctcgaacggctgatcccgccctggggcgccctcagtcgactggggtcgacggcgtgcggagagcgccgaggagcacctggctgatgtcggcgacccgcacatgctcgggtgcgtcaccggtcgcctgacgagccttcagcccatcgtcgagcatgatcatgcagaacgggcacgccaccccgacgacgtcgaccccggtggcgagcgcctgtgtgacgcgggcgtcgttgacccgctgtcccttcgcctcctccatccacatgcgcgccccgccggcaccgcagcagaagctgcgcgaccgattccgctccatttcgagtggatccgcaccgagtgcggcgccgacgacggctcgcggtgcgtcgtagacgccgttgtgacggccgagatagcacgaatcgtggaaggtcgctgaggcgatgctccctgcctcgaccgggagacgaccgtcgcggacgagctccgcgagcagctccgagtggtggcggacctcccagttgccaccgagggctgggtactcgttccgaatggtgttgaagcaatgcgggcacgaggtcacgatgctccgcgccccggcctcggtgagggtgtcgatgacctggcgagcttgcatctggtagaggtactcgttgcccatgcgtcgtgctggatccccggtgcaggtttcccgcggaccgagcacgccgaagcggactccggctttggcgagcagcgtcgccgtggctcgggtcaccgcctgggcgcgttcgtcgagcgccccggcgcacccgacccagaggagtacctcgacatcagctgggatctggccgtcgaagacgggtacctcgacgtcgagccccttcaaccagtcgagccgatgcgaagcgccgagaccccacgggtcgccgcggttttcgaggttgcgcagcatgccaccggcctcagtggggaaggacgactccatcaggacctggtagcgccgcagatcgacgatggtgtcgacatgttcgatgtcgacaggacaggcggcgacacacgcgccgcaggtcgtgcaggcccagagcacctccggatcgacgacatcgggcacaagggacgtctcttgggcttcagggttcgctccgtgggcgagcaccgcctctcgcaggctcatgatgaggagcttcggtgagaggggcttgcccgttccccatgcgggacagagctcctggcagcggccgcactcggtgcaggcgagtgtgtcgagccggtgcttccagtcgagctgaccgatggtgccgacgccgagcacggtcgcttcatcgaacgcttcggggtcgaggtcgggtgtcgttgcgagcgctcccagggctcgcgggcgccgcgcgaaggcgacgttgatcggtgccgtcgcgatgtggaggtgcttggagtgcacgatgaagacgaggaacgcgaagatcaccgcgacgttcgcaacgaggaagatcgattcgagttcgtagttcgtatgggcacccatgtgccggaatggcagcgccacgatctctgacagccaggcaccggaacggtacgggaagtcgccgtcgttcacctgggttgctcgataggcgacgagggtcacgatgacggcggcgatccacccgagcgtgagccacgccacaccggtgtgcgaaccgtagaagcgcgatgctcgttcgcggcgctggggtgcctcccgaagccgaatgacggcgaagacgacgagcgaaacgagcacgaggaacgccatggtgtcctcgagggcgccaagccagggctcgtggccgatgatcgggaaggcaaagtggcggtcgaacagcgccccaaccgcctccaccaccgtgacgagcaggatcgtaaagccccagaacgtgaagaagtgggcgaggcccgggacccgtttggtgaggagccgacgctgaccgagcacctcgacgacctcggcgcgggcccgtcgcgcgaggctcgctcgacgcccgggggaggcgggcccacggcggacggcgcgtatgagcaccacggcccgtcggatcgtcagggcgagcgcgacgacgatgatcgcaaggccgatcgcaaggcgcatctgagcctccttgggcgtcaggaacgaatggatgttaccactcagtagcttcgtggtggcggcggtcgcccttgatgtcgtcgtgatcgaggtggtaacgagacggcgtcgggccgcgttgaccctggtacttcgaggccagtgcggcactaccgtaggggtgctcggcagggctcgtcatctgcaagaacgagatctgcccgacccgcatgccgggatagagcgtgatcggaagctgagcaacgttcgagagttccagggtgacgtggccttcgaagccgggatcgatgaagccagcggtcgagtggatcagaagaccgaggcgtccgagggacgacttgccctcgagtcgtgcgacgagatcctcgccgacgcgcacgtgctcgatcgtcgagccgagcacgaactcgccgggatggagcatgaacgctcgcccgaaggggacctcgacgagctcggtcaagtcgtcgggaatggcagcaaggtcgaggtggccggctgagtagttgcggaacacccgaaagagtgcatcgagccgcaggtcgatcgatgacggctggatggcaccgggcgagagcggatcgaccgagatccgaccagccgcgagggcgtcgcggagcgagcggtcagagaggatcattggcgctacactatcgcgacgcagctcctgtcgcggaggcagggtgcccgcgggcgtagttcagcggcagaacatcagcttcccaagctgagaacgcgggttcgattcccgtcgcccgctccacgcgtagcaccagctcaggggcatcctcgatagagtgtcgactccgccgagaagccgagcagccctgctcagaccacaaatagaccacatctgcggctgggagcacaccgcgaggtgtgcttgcgcgacggggtgcgcctcgtggcggcgtcgtcggcgctacgaaggagagcgcttccacactgcctggcccgaggttcccccaagacgtcggtcgcttcggtctcgtccgatgggcttgcgtgggcagatgcgaggtccgacagagccgcagcgattgccttatcgcgttccgcggtggcgtgctgatagatcagcgcggctcgtggtgacgagtgtccgatgcgtgccatgaggtcgcgcgtgctcgcacctgtcgccgccgcccacgtattactagagtgacgcaggtcatggaggtgcaggtcagctctcccgatactgcgccgtgcgcgatcccaggtgctctggaggacgtgcacgcgaagcgggccgcccatagcgccagtgaacagcagggcatcgggttctgccccgacatagcggtcgaggtgttcggcgaggccccggatcgcgtgaggaggtatcgcgaccgtcctcagcccggcttgcgacttcgggggccggtgatcacggtgccatcgcgaagctgatggctggtgcgttgaatgcggagcggtccgtgcggcaggtccacgtcggagcggcggagggcgagaagttccgatcgtcgcaggccgctccaagcagccagcacgacgagcatcgcgagcctctcgggcatggctgcggtgagtgcgtccacctcccggatgctggcgatcggacgctccgtgggctgctcgacgcctgcgccctcgacgcggcagggatttcgcgtgatccgctcgtcggccaccgccgtgttgagaattgcgcgcagcaaccggtaggccttcgccgctgtggatggatgctgcccagccagctcggcatgccacgtacggactcccaacggggtgatcttgctcaagtcggttcgcccgaaggctggcaggatgtatcggtccaagagatagcggtacagttcgacggttctcggccgtagatctggacggtgtgcgagccacagctcggcgtaggcacggaatgcgagctgacctagccgcgggtcgacccactctgcccgttgcatgtccgctcccacccgctccaggaagcgacgtgcttcgatcttcgtgggaactgtgcgtccacgttgacgcccgtccggatctcggtagcgggtttcccagcgtccggatggcttgcgctggatgcttgacaccgatcgctcctactcgtgcgtcctcagttgggagatgctgctggcagactgatcgcaaccagtgtcttgtcgtcatggcgcttggcccgagggaggagcgagccgttggggtctcgctcgctctcccagcgatagcaacggtctcgcgcaaggcagccaaccatgtcttcgcccatggcagcggtcgtctcgtgtacggagacgtgcgggggatcgagcaagcgaccaaggggcgccgctcagccggtcgtcatcaacgccgggagccttcgcagtggtcgagaggacgccacgaacggtacctcgacgacaagaccggcctgaaaggagagcacgtagacgaagctgcttcaacgaagacatgcccagcgtgtggagcacgcaaccgaccgagcggtcgggactaccggtgtgcgaacgctgactgtgggtttgcctaccaccgagacgccgtaggagcgatcaacatcctgcagaaagcgatccacgggacctatgtcccaattggaccggatgtcacgatccatgtcacgtatctccgggctgtcgagcgttggtcaccacgccagagcgaggcacaccgcaaggtgcagtaccgaagggcgagagccctgagtagcgcccggaaccgggcttcgtcaggagcagtcccgacgtgcgagcaaaggcaagcccaatcatccaccagcttctcggggccagaccagttagtcgcggtggcatgaggacggcgatgtcgagcaaccccaaccgtatggacgggctagaagccccgtccgtaagggcgggaagggtccccgacggcgcgcctgtgtggctcaagagggacgtggctgctcgagagaatgaggtaaaaggtgtccgaaaagctcttcgaggaggaagcgggttcttgcaggcacgggccgattgggatagacggcttcgagcagcgcaagtccgtccgctgccgtcctcatgccgcaaagaccatagagcagtttgatgtcgtcgacgtcctggtccgctcgcgatgcgaggagtttcatcgccaagagctgacgtggggaggcaacagaaacggtcagacccggtcggcggatgacgacagtcgatgcaggatcaggaccaggaaagaacgccctcgctccgtcgttgagccagtcctccggtagacccatctcgatggctaccgttgatgcggcctcacgaacggttgccttcggctcaaagacggcatccacatcccgcgtgattcgccgagcctcgtacgcgagcgcaagggcgttcccaccgacgacgtagatctcggctacgaccccacggcgctcgagctcgtcagcgagacggttgaacgcttcgagaatgagtgtcgcgttgaagcgtggcctcggttcagacacgatcgaacgcgccttcgttgacgaacacgccgtggcgtttgagctcgaccgggctgtctcgcagggccatcgcctcatagcccggcaagccagccacgaaccaccacggctcgacgtagcgtgtcgcttcggtcgtccacgacggcgcagcaatgccagcctcgttgcagaggaactcaacgatacctgcaagcgccgcgtcgaatcgtgtgtcgccgcacagcggtggcggatctgcgaccagccacgccttcccgagacgggacgatcctcggacgtcgtcgacgaagtcgagcacctctcgccacgccgaacgcacgccctcggtgtggagaagttcggtgatggtagtcgcgacatccgcgactggctttgcacctcggcgcacctgcggacgcaggaccaaatccacatcgaagccagcgacggcaacgatgcgttgcagcgtgctcaacctcggctcgatcctgccgcgttcctagttggcgacagtcggttgcgaggtgcccgcgagcagtgctagctcctcctgtgtgagctgtgcttgggcgcgcaggtcgcgcagcaacacgctgatgcgctgatagctgcgcgacgcgggcatatcagaaagcgtatcgtgcccgatgcccggcactgttgagtctgagtggggaggagcgcctcgacaaggagatccgccgacgtacgaacgtggtgggcatctttcctgaccgagctgccatcatccgcctcgttggctcggtgctcatcggcgagaccgaggagtggatggaacagcgtcgctccatgagcgctgaagcccttgccaaggtgacccgggtcactgtggccgagaccgaggaccccgccacagaacaagcacaacgcagcctgccagagccgatgggggcgtcggctcgagggaggatccgcggtggccaatacaccactcgtttggacgcgacctggcgagtacaggaacaggttggtgggaaggaccggcgtcgtcaggtgcgcacgcacttcgtgcccgaggaaggcgaaggatcggtgccggttgatcgcgttccagaccgatggcttcgtcacaccgatggcttcgtcacaccgatgacttcgacgtccgatcactcgggacgccctcgttgagcgtggcgacgaagttttcaggaccagacgtcggcatggtcttcaggtcagcggtgagctcggcggcggtcagctgcgggtagagcggctcgagccgactgaggtcgatggtgcccgggtgatcgacgcagaccagtccgtctgggcactgcatcgacatcgccggcacggagaatccgagcggcaccgtgatgtagagcgggtcgaaggaccgtgccagcggcgcctcatagggtgcaccgacctcgcagcccaatgatgcctctgagctcacgtgcaggtcgcagtagaggcctcgggtgtgcatgaacggtgcgaggtgaccgtcgcagagggcgtcggtcacgccttactcgttgacgccttggccggcccgcacggcgttgctcgggggcggcgtggacgccgccgccgttgcgatgcctgcaccggtcgcaagggcagcagcgaaggcgactgctccgttccgcattcgtcgtcgtgcgactcgtcccatctgtcctcctcttccctccgtcggggtctcgtgggatccggattcgaggcggtccttggatggagccagaggcgccgttgaggcggaagggaccgaccttggagcgtgcggtgaaccgctgggcgtaggtgcggcgcgggtgagtgctgaatactgctacagtacgtcacgtaatgatatgcggagagcatggaatcgagagggtcgacccctctgcaaccacggctcggcctcgaccgggacggcctcgggatcggcgtgtcgacgcctccgtcatgggcgcaaccctggcccttctcgacgaggtgggctacagcgcactcagtctcgagatggtcgctcgtcgtgctcgtgttggcaagccgagcatctaccgtcgctggccgggcaaggcttcgctcgtcgtggacacgatcgtcacgatcgcgggcaccgatccggcaccggacaccggttcgctccgcgacgacctcagggcggtcgccctggctatggctgcgctgtatcggacgccgctcgctcgcacggtcgtgctaccccttctcggggatctcgccgacgatcctgatcttggcgagcgcttcaggcggcgctacgtcgcgccgaggcggggctcggtccaccgggcgctcgagcgtgcgcaggagcgcggcgagatcccgcgggtggacgaccccgagctcatctgcgatctgatcgcagggccgttgttccaccgtgcatttcttgttgccggagagatcgacgaccgcttcgccctggcaacggtcgacgcggtgctgatcgtgctggagtcggggcaagccggcgaccgcaactcgggaacaggaaaaggagcctcccagtgagcgcagatgcccagagggcgttagaggcaaccagagcgcccggtacacgtccgccgctgtggcttcgaacgtcggtaccggtcggggttgtgtcccagtgcgccgccgcagcgctcggcacggggctcatcgcggttgcggccgactcgtaccggctgggggttgacctccgaggggcagcgctgatcgttgggttcatactcatctatctcaacacccatgcggtggctcactggttcgtcggccggatcgtcgggatcaggtttcgaggcttcggactgcgaggaacggatcacccggagaactatccgccgggccttcgccacctcatgggggtactgccgatgtgggtggcgatgaccgagcccgagagtcggcgccgcgcgggtccccgagcccgcgcggcaatgtacgcagccggggagacgtccaccacggtgtgctcggtggcagcggctgcggctgcgttcctcgcgcacgcaccatgggcgcgcggcctgctcgtcttcgcggtcctgtggaaccttggtgcctcgattgtggtcagcatgatcgacaagggggactacgcgaaggcgcgtcgtgccctgcgggcgcggtagcacgtgcgccccactcgggccgtacttcttgcgatcgcgttctcgttcaagcggaggtttcgcggcggttcgtgtcccgcctggcgccttgtgagtgtgcggctggacgagctggacacggggctttgccgcctggcagcgtgctcgatgagggctcaggtcgccgctggcgagtaggagatgagacggccgtcggcggagctgcgtaggtgcagctcgaaggtgtgtgcccgcaggatgagtgagaaggcgtcgaagggctggcgcgaggccgcgtaggcaacgccctcgatgtcgatcacccactcgctgcgcgcgagcccgagcacgccacgctcctgcccctgtggtgggcgcgccaccagccactgctcctcgtgggtctccgcgagcccgaagtggtgctcgagggcggcagagagcggatccctcgatgggtcgaacaccgcgtccagggatggggcgaggaccgtgggcacgagcgcgcgctcaagcgcgatggggtgcgccccccgcagacagcgcagagacctatcgcaaggcgcaagtcctcgctggatgcaggggagtcccgggcgagcgtcatcgtcgtaacctgctcttcgtgcaggtcttccggtccgggatcgcctggatctggagtcgtagcggcgtaccgacgtcctcgggatggcctctgatcgcagtgctgtcatgcaactgcctgacctagtgacggcgaggccacgactcgcaatggcccaggcgctcgaagacccgcaatggtggtcgctcagaccgacgagctgcttggggtcgtggtctgcgttgggaagctcgccgctcgggcttccggaggtgtgcatggttgggttcgggtcgggtcgtgcggaggcaacagaccacgtcggttggcgtaactcgacattcgggtacgcgttacctgccgtctgtgcgcttcgccgaggtcgcgagggcgtggctcacgctgcccgacgcccgaagccaggtagcaggcgctcgacggacgaggtgacgagatgcaggcccgcaaggccaggaaggcgttcgatacgacgatcgatgcgtgcgaccacctcgggtcctcctggaccggtgaagagtgtgctgatgagcgcacgtacttcctcgttcgacttgacccccgaccctacgggtgcccaaaaccgcgcgagagccgatcgtacgatgcgctggtcgcggggacgctcgagcagggcgcgggcctgcatggtgtagaagtcgatgtggcgaccctcttgcttcatgatctcggtgagcacccccgtgagggcggggtgctccgctcgtgccacgagccgcgcgtaaccagcctgcgtcgtgagctcgttgaccatcccccatgccatgaggagcccgggcaacgccggagcgatgggcgagaagacggagaagccaacgagccggagccaatctcgagcgcgacgagcgcgtcggagcgttgcggccgcatcgggggcacctgccagcccatgcgcggtgaggatcttcccgatggcgtcaccgtgaaactgctcttcgtagacccagcacgcaagaaaccgcgtgatcgccgggtcggcgtggacgggtgtggcgaggagttcgcagaggtagcagaccgtatggctctcgatgtcacacatgtaacgaaggcatgcgaggctcgcgtcatccagcgggtgcgatcggaacgcatcgatgtcgatctgctcgacctcaatgcgtcgagagcgtgcgacgagggcatccaaggttgtcggcatacgtacctacttcggagcaacggtcggccgtggatggtacgaggactgtaggcaccggccttcttttgacccgagatcaccggtcagaactgacccatccgcgacacacgtttaggtgatgaccttggggtcggggtgctcggcctcacctccctgtaccatgccagcggcttcctgccgcagcacggatgggcttgtggagcgagaaagcgtagcggtgccgcgcaggacagcatgggctgacttgctcgccgcagacgggagagcacgtcaaggaagcgggggccgtaggctgcctcgagcgagggcacggctcgtcgcttccacgaccaggcctccctcgaatggccgcccggcctcggtggcaatcagggagggaaagccgcaccctccatcccaccaggcccacgccgtccagccgatgccgtgtccggcgaggaagtccacgatgtggcgttccaggttgagcgggtaggggttgctgcagccgaggacgccgaactcggtggcgatgactggccagtgtcgccacgtcgaaccgagctcgtgctgccagagcgcgggccctgtcggttgtgctgcttgtacgtagaggtgcagcccataggcgacgttggtaccggccaggtgccagcgcgtcaggcccgcaagcgtccccgcccaatcgatgccgtccgcgatcacgaggtttcgcgcacccgtggcccgtacggtgtcgaggagcgtctgttcgccgatcgcgtcatagcgtcgtccggtcgctgggcaggtgatcaaccctccgtcgcgccacgtcgaccacgtgatgtcgtggggttcgttgtagagctcgaagaccaccccgggccaggtgcggaagcgctccgcgagggtcctccagaatgcgatgctcggagggtctggcgcacacgaaggccctgctgcggccggggcagtcgaggtgtcagccccgatgacggtgtgcaggtccaagatcacgacgagaccgactcgtcgtgcggcacgaaccgcgcgctcgacgagttccccgtactccggatcgtagcgtggggatccgcgtaggaggaaggcctcgttgagcgcgatgcgaactgcgttggcgcgaaagcgcgtcaccatcgagcggagctcagagaggtccaggcctggggctccgtcggcgtgctgccctgcgggtgcccagtcgagactcggccagtcgacgccatggaggtagatcggcgttccgcgctcgtccacgaccaagggaccccgactcacgagctggccggtgacggcacccggcggcgaggggctgaaggtgggccgcctgtgggaatgcagcacgacaacgaggagggttgcgatgccgagggcgaccaacaccacgagcgccgccacaccgcggcgtctgcggacgcccgtcatggtcggtagatgtcgatgcgggagagtccggagccgaactgcgcgacgaggtggtcttcatgctgaacagcgctaatgaacggtaactgtgtctgcaccgcgcgcatctgaggagtcacgacaatgaggtgcatcgccttccagccctgagggttgagccgccccagattccgttgacacgtcgtaagtcacacgtaccatggcagagggaaggggaggtcgatggggacgtcgagaaggaagttcaccctggagtaccggaccgaggcggcccaccgggtcatcgacagcggccggagcgtcccagaggtggcccgtgagctcgcgatcggggagcacaacctctatcgatgggtgcgggaggagcgcaggcggatcgaagcagcaaacgccactggcagcccgcccctcacggcgcaggagcgcaccgagctcatcaggctgcgcagggagctcgaggagctgcgcaaggacaacgagttcctgggaaaagcagccgcgtacttcgccgcgaagccaccaagcaagagagattcgcgctgatggaggcggagtacgctcgcttcgagatcaaacggatggcacgcttactcgaggtctcccgggctggctactaccgatggcgacgcacccaggtagcaccgtcgcgtcgggcatgtgcaagacgcgacctcgagaaccgagtggtcgcggtccaccaggcatcctctggcacctacggcgcacgacggatcacggcggcactcctcgccgctggcgtggtgacgagccacaacacggtggcagcagcgatggccaggcgcggcatcgccggtatcagccccaggaggttccgcccagcgaccacccacgccgatccgaaggcgatctacccaccagacctcgttgccaggaagttcgacccggggcgcctgcacgccctctggacctcggacatcacctacctcgctctcgccggcgcgatggcatacctgtgtgtggtgcgcgacgagcactcgcggcgggtgctcggatggagcgtcgcggagcgcatggagaccacgctcgtgctcgaggccctcggccaggccgtcgcggtgcgtgggtcccacgcgcagggggtcatctggcacaccgaccgagggagtcagttcagcgaccatcgagttgtggccttctgtgcccgacacgggatcacgcgctccatggggcgaaccggcacctgctacgaccacgcgagcgcggagtccttctggtcgatcttcaaacacgagttcttctaccgccacgcctttggcgacctcgccgagctgcgccgcggcatacagagctacatccagttctacaaccaccagcgcagctgctcgaagatcggctaccttgccccagtcgtcttcgagcacctcgtcgcggaggaggctcgcgtgaagtaacctgggtgtctacgaaatctggggcacctcaggtagcgacgttcgacctccgggtccgtcgtgatcttccaataccacaccacggcctggtaggggtgccaacccatgtcgacgacgtcgacccacatcgtatcggcgacgaggatgggggcggaacggtcgccatgggcgcgtagccaggcctctgcggcaagctgggcctggtctcgaggggcgagcaacgtctccgcgtcccgggcggaccaggcgaaacctaacagcagcgtgagtgtggtgacgagcacaccaagggcggttcgagccaggcgtcgccaggagacactctggctgaggagggagtcgaagagcccgccaccgaccagtgcaaccgctgggaacgcctcgactgggtaggtcgaggggagatacccaggacggaaggccatggcagtgtagacgagcgcagcgatcccgaaggggcgcgttcgtcgagcgatgacgccgatgcacgcggccggcaccaggaggacgagaaccgggtcgaggtgaagccacccctggagcaggccccaggcggccgtgccgtggcggaggatgaagccgctgcccgcacgctcgaagacttgccacgctgcgctcccgagcaaactcacgtgaccgggtccggggaggagtgctcccttgagcgtggcgtagagcaggtacaggctcccgatactcccggtgacgaggagaaaggtccacattgcgaccgagcgccgttcatcgcggtagcgccgagcgaggagccagagcacggtgggagtccagaggagggccgtctccacggacaggatcgctgcgccgaacgcgatgccagcgatcacgacggcgtgcaagcggcgccttggatccgagagcgaccagatcgcgacgagaaccagagccatcgcgacgttgtcgagttcgacgaggcgctcgagcgtgatggcaagcggggacaggccccagaggatgacggctatggcggcagcaccagggtgccagcggagcctcttcgccgctccgaccagcgcgccgagcgcgacgagcgaccagatccacatcgcgaagcggagctgggcgacggcgtcgaggccctggggcaggacatgggcaaggagccaccacatgccggcaaggaggatccacgcgagcggtggatgatcgtaccagtacgtgtaaggggcaagccgcccgaggtgcagcagagcccacgcctccgcggcataggtaccctcgtcgagcatcggggtcgggttgtgtgcggcgcccgcgacgtgaacgagagcgacgatggcagcggttccccaggcgagcgtgttgcccgccaccgaccaggtgccccgagccgcggtctgtgtcgaatccggggcttccggaacctcatgcgttcggacgagagtctcaaccacggctacgccacctgctgttcgctcaggacctcgtcaggagttgacaagcgacggtgtgcgccgacatgctccgtctttgcccaaccgcgctcaccgcggagctcgcgcaccagcgctacgagcagggcggtcacgagcacgagctggtaggggatgagaccgaggacgagggagagcgcatctcggatgcgtggccgctcaccgcgtaggcgacgcaagcgagctgcggcgatgacctcgaagctgagggcgccgagctccgcgaagagagataggaaggcgaagaggacgaggtcgacggggagtcgacgtgtcaagccccaggcgagcattgcgaccgggatcagcacgcccgtgagggcttgctggaacggtgccgccaatgtgaagagcgcaagtgcccttctccgccaggggagtttgcgccaagagcccttgcggagcacctggatgaagccctggtcccatcgggtgcgctggcgaacgaaagcgcgcaggctaaggggtgtctcctcctgcgtggcgagtgcctcctcaaagcggactgcgatctgagcgccgcaggtggcgagtcgaattcccatgtcggcatcctcggtgagcgcgttggggtcccagaggccgacctcgtgcagggtatgggagcgaaagacgcacgtgttcccaccgagcggtacgacgccgtggcgggcttgccacggaaggcggctcgagtaccacaggtagtactcgaccgcggatcgggttgcgaaccacgagctggacaggttgacgaggaggacgcctccctgaagcacgtcgagaccgggacgcatggcgaactcggcggctgcaagcgcaaagaagccttctgcgacgtcatcctccgcgtcgacaatggcgatgagctcggcgctccccgccgcctccatcccagtgatgagggctgcaggtttcgatttaggccagtggtggtcgacgacgacctcgatgcgatcggggtgcgccgaggcagcacgttccgcgaccgcatgggtggcctgatcatcgtggccgacgatggcgatgatccgcagcgcgtcgtacggttgtcgcgcgaggcgctcgagggtcgccccgaggaccgtctcctcatggcgggctggtatgagcacagccatcgtcggcagggtcgtcaaactgtcggcgctgatttggaaggatagctgacgtcgaagctgtgggtcttcccacccgaatgctgcaagtgcaacagcggagagcgaggctgttagcacgattacagcgccagtcaggtagagccaatccccgatcgtcattgagaactcctcgatccccaggtcgtccgctgacgtagtgtagagccagctcagaggggatggaactccaggcagatctcgcaacgatgtggcaatgaaagtcgggcactggtgcatgggatgcgcttgtggcctctgcacgtgatccatgaacaactcgaaacagattggtgaacagtcgcaatgattgtcatcaaatcagtcggatcggcgcggcatatggccgtgaaatggtcgctcagagtggtgagttggctgcggaaggtcatgcttccagatgcgcaccgccgcagcgacggcggtgtcgaggttgaacgcatggtgatcccgtgggcagatgcgacgagtgaatccgcatcgatcgacggtccttgcgacctacgagccgtgatgccgttggtatcggcgatccttcgtcgctcgttccgatccgtctgcaccgccgaagtggtcgaaacgccccaactacggatgagaggcgtagcggagttggtgatgaggcatgtggggtcagtccaagtgacgtggggtgaggtctcacctgccacgtggcgtcatcggttcacggagagcattccctgggtcgcggcatcgacagcgctctccgatcggcgacgacccagcgaaggccctgtccgtctgcgcgtcgaggtggtgaggagtgtcacgggttggtcaagggcgaggcatcagctgcacgaacgtggcggcggcgaggatactcctgctaacgcctggctaacgctcgtccaggtgagccgctggcgagcgaggtaggacttgagtcccgaggaccgatcgagggaaggggggctcatgcgcaggtgggcgggtgtgccggtcgtgaagaagctggcaagtatcggagcaggactcgggctggttggcgcaggtctgtcggtgccgttgacccatgcggcgctcgcgggttcgaactcgtcgagtgagacgttctactacaccgggagtcaacagacctttactgtgccgatgggggtcacacagcttgactacaccgtggctggtggggcaggaggagcaggttacgcagcgctcgcaggcgagttaggtggctcgggtggcgacggttcggtcgtcaccggcacgctgacggtgacgcccggagagcagctgatcatcgaagtggggtcttctggtgcgaacgcgagttccaatcagcagagttgtggtggtcccttcagcctctatgtcggaggtgccggcggatcgaacccggattcgagcttcagcggtggctcgggcggcgacggcaattgcgacctcttcaattctggcggtggtggcggcggtggtggagcggcgagcgccatcctcgacagtagtaacgctgcgctcgtcgtcgcagcgggcggcggtggtggtggcggcgctggtgcggccgcgggttacgacggcggcgcgggtggcgccaatgcctctggtggccccggagggggcgacggagcaggtagtgggggccaaatcggtgctgccggcagcagtgctggtgggaccggtggatacgacgacgtagcgggacatgagtccggtggtggcggcggcggtggtggtggcctcgacggcggtgacggcggcagcgcaggacagattggtggtggcggcggtggtggcggcggctccgggagttcgaccacgggtagcggcgtcaccgtgtctgcgaccaacaacggcaacggctacgtgacgctgagttggtccacctctccaccgccccccgcgctgagcgccacgctgagcgccaccagttcgccgagccctgcctatgcaggggacaccgtcagttttgcggttcacgtgtcggggagcgggtcgtcaagcccggtgactggggaagccttcattgaagccccgggcaagaccgatcagacggaattcatccccgttgccgaggtcccgatctccgacggggctggaaccgttcaagagtcggtggatcaggtggcggcggtactcgaggcggagggcgagagcgttccgtacgggacattgaccctgccggtctacttcatcggttcgggggcctggcagggggtcggcgcgacaggttccgtcggtgtcgacctgtccatcgaccccacgaccacgagcctctcgctacagccgtcctcgccggtcgtcggccagccagtgacgctcacggcgacggtgacgaaccagtcccaggccgcacccggccttccgccgaccgggagcgtgaccttctcggcgacggacagcgccggcacgacgacgaaactcggtacggcgtcggtcgacggttcgggccaggccacgctctcgggcctggagctgccagcgggtgcggacaccatcaccgcgagttactcgggggatcccacccacgatgcctcctcgaccacgagctcgatcgatgtctcgaacgcgctggcgctgttcgcctcgagcaccccgtaccctgcgtacttcggcaatgacgtggccgtcaccgccaccgtggccgggggcgggtcgctcggtgcagcgaccggcacggcgtgcatcgagggtccgtccggaggagtgacgcttggctgcttcgtcgtcgaccagggttccgggagcttcacgatcccggtcgaggaagcggcgacgctgctgggtgcgagccgggcctacggtccccgggcgttgcccgttacgttcacgggttcgggcgcctggcaaggtgtcgacctcaccggctctgtgaacgtcgacctctcgctcgaccccacgaccacgaacctctcggtgcagccgtcctcgccggtcgcccgccagccagagacgctcgtggcgacggtgacgaaccagtcccaggccgcacccggccttccgccgaccgggagcgtgaccttctcggcgacggacagcgccggcacgacgacgagacttggcacgtccacgctctcgagctcgggccaggcgatcctcaccggcatcagccttccggctggcgtgcacgtcgtcaccgcgagctactcgggggatcccacccacgatgcctcctcggcgtcgagcacgatcgtggtgacgacaccggtacggctcgacctcgcggcctcaccgacatcgtcgtccttcggttctgcggagacgctcaccgccaccgtgcatggccaggcgcgtgggtccgtcaccttcagtctgatccagggcaggaagaccaagcggctcggcacagcgccggtgacctcgggccatacggcgcagctcgtcacctcgaacctgcccgtcggcaccgacgagatcgtcgctacgtacacgccgtcgagcggctccgacgtcgcgcccgcctatgccgacaccacgttggtggtggtgcaggacgtgcccgcgatcacgatcctcggaccgacgagcgtggcagcggggtcgtccgcgtcgtacaccatcctcgtgacggcgaacgggagcccggtcgacggtgggacgctgctggtccagctgggcgacacatcatccaccgcgaccgtggacgccaacggactggcgaccgtgacactcaccttccccaggaccggcggcacgcaggtcctctctgccatgtacctggggtcaccgacggtggcaatggcgtcgaacaccctctcggtgacggtgacgtccccctccccatcgacgtcggcgcagagttccagcacgccgcccgctggctcgtcgtcgagctcgagtacgaccaccgcgtcgtccaccagcacgagcacgtctccgacgagcccgggaacgaccagctcgacctcgacgcaagcagtgcggccggtgacggcgagttcggcagtgacggtcccgaccgcctcgaccggagaacccttcgcgtccccgtggtggtgggctctctccgggttcggcgtcggaacagggtcgacgctggcagcggtccagatccgtcgccgccgcaacacgcgcgaggccgtgtaagcggcagcagggactcagccggtcgtctcgcggttcggccgtggtggctccagcatccgaccgagagctcagtctggttcgtacagccgaagcctctctatcaaggggttgagggaactcgagggcttcgtcgttgtggctgagcgcgtaacgtcgtgccggagccggcggtctcgcccatgtctcgagcaccggctcccgggtgacgagctcgtgagcggacctgtccggtgtcggagacgcgcactcaccgcggagtcatcgaacgagtcgatgcgcccgaacgtgagcacgtcccgtacgctcgcaccacgctcgccgctggggcggggacggagatcgtcagcccggcctgcgccttcgatgtcgcggcatcctcgagcgctcgcgggccgtgatcgccgagggtccccagtggatctccgagtccgtcgagcatcgggaagctcgtcgaccgagcagtgaccgatcgggccttctagcaggtcaccgacttgctacagtccgtcctgggggtgatgcagggcggcggagggtgcacaggtggcgacttgggtgttcgcagatcggaagcacgggacgcggaccgctgcgcacgacgcacggtgaatgggacagtgttccaccgatgcggcacgacgatgccagcgatccggaggtgaccgtgcgtcagcccatgggggcgtacgggcgcagcgcaacagggcgacggacgggtggtccgcgggtgaaggtgcgtgtcctcggacagccgcgcgtagagaccagtctcggatccatcgcggtcggaggtcagcgggccaagttcctcgtcgggctcgcagccgcaggaggcgtcctcagcgtcgaggaggccgcgacgcttctctggccttccgtacgtccaccgagctggcgcggcgcgctgcgcgtcctcgtccatgagcttcgcgacgcgttctcgcgagttggcgcaccacgggggctcgtgcagcgttccggccccatcttcgtgctcgatactggcgatggtgaggtcgacgtcgacctctggtttgcgagggacgccgcgcgggatggacgtgcggcctgggaggcgggcgacttcgtgacggcacgcgcgcgagctgaggatgtcgagtcgatcctcgccgagggtgtgctgcctgggctcgatgacgaggccgtccgtgacctgcgcggtggcgtcacggcggagcgcatacggaacctcgaggtgctcgcacgcagcgcggcagcactcggcgactgctcgagtgcccttgagactgtcgagggtgcgctcggcctcgaccccaccaaccagcccctgtgccaagtcgggctcatggccgcggagacattgggtgcagtggctcgcgggctcgcgctctacgcccgtctacgcgccgccctcgcatcgggcctcggcgtttctccgagccccgcactcgccgcaagctacgcgcgtctcattgctgcgcaaggtgggcaagcgcgaggcgccgacgagccccactccctgcccgaggccatgaggtcccgtcaccgtgtcgttggtcggacgaccgaactcgctcacctcggcgtgttgtggggcagggtcgagcgcggcgaggggctcgcgtccgtcgtggtcggtcccgcaggcatcggcaagacagccttgctcggcgagctcggtgcggtcgtcgtgagtcgaggaggcagggtgctctacgggcgcgagtcggatccgccttcgcatgagctcgcggcgatcgtcgaggcactgcgcgcctatcagactcgctgtgcgcgggtcggcgtgccttgcaacctcggaccgctcggagcggacctcgaaaccctgctcggaagcggctcggacaacgttcgtctcgcaccgcggagccgacgccttcgactctcgcaggcagttcgcggatggtgggcggcagtcggctctgagcgcccgacgctggtcgtcttggacgatctccactgggcctcggcgacgacgacagccatcctggccgatctcgccgtcgatggcccccctgagggtgttctcgtcgttggcgccgcacgctcgacgggatcggcgctgccaccgagcatcgggtcattggtctcgtggggcgctcggaccatcgaactcggaccactggcgctcgacgccgtcgccgacctcctcggctcgaccggacatgacgccgcacgagtcgctgcggaagtctggctcgcgagcgggggcaatcccgagagagtgtgggaactcgctgagctcgtcgtgaatcccggagcccgaggtcgcagcggtctcgcgcgcctcgacgtcgatcgcctctccccacccgcacgacggatcgtccgagctgcggccgtgctcggtcgcgcaacgcccgcgtccgtcgtgttcgacgttgccgacactgacgatgtcgccgcgctgcaggaggcgcaggctgcgggcgtcctcggcctctcgcaggggggttccgtcgtgctacgacacgacctcctccgtgaggacgtcctcgcgcaggcagggaccgatgagaaggtccgcttgcacgcccgagcggccgaggcgcttgccaagggaggtacgtcgtcgcacaccctcgtccaccacctcgctcgagcggcccccgtagtgtcgcccgagcgactcgccaaggcccgtctctcggcggcgcgcgaagccgccagcctcggcgcgtacgaggatgcactcagtgcactcgacgcttggcgggtggagcggtcggacggtggagccgatgacctggatgccctcgtgctgcgagtggagtgcttgagtgccctcggcgatccacggctccgagacgccgtggtcgagctcttggagcgtgccgtggttctgcgtcggatcgctgcggcagcgacggctgccgagatcgtcaccgcggcgctcatcccgaccctcgtgggtcgagaggatcccgccatcaccacgcggttgcaggccgctctcgagcgagcccgtcgaccggagcacatcgcctccttggcgtctgcgcttgccctgtcgcgggtctggacggcgtcggccagggatcggcgagcgctggcgaggcgtgcggtcgcggccctcgaccgtcgcggcggccagggtgccgacgccctcgcactggcgaccttgacgcgagcgcacctcggcagcctcgaggcagcccacccagcccatcgcctcgccagcgctcgccgcatcctcgcgcttgcgaggtcgactcatgacatcgagggcgttgctcgcggccatctactggcgcacgacgcgctggtggagctcggtcatctcgacgaggccgacctcgaactccaggctgcccggctgtgcgccgcagctctcgacgaccaggtgcgctgggaggtggagatccgtgaggcaggacgtcggctcatggcggggaggcttcgcgatgccgaggcagccgctgagcaggcgctggtcacggtccgggccgagattctccgcgaaggcgctgcggcggtctacggggcccagctgatgatggtgcgcgaggccgagggacggcttggcgagctcgcggacgccgtcgcagagtttcgtcgggtccagcacgagtggacggtgtgggacgctgccgaggcgagaatcgcggtcgcgctcggtgatcaaggccgtgcgcgcgagctcctcgcgcgcggtgtcgccgagctcgaggatcctgtgcgcaccgacatcacgtggctcgcgcgtgccgtgcagtacgcgtgggtcgctggcgacgtccgcgacgtcgagatggcgcagcgcttggtggcactccttgcgccctaccgagggacggtgcactggtcggtgtgcgtcagcctcggtccggtcgacctactcctcgcacggctgttgatgctggccgacccgcgacgtgcctcgacaccgctcgagcgtgcgcgtcggctcctcgccaacgatgggctcgcatactggcgcgcacggcttgccgacctggtgagctgagtcttggcgaggtgctgagcgctgtcggtcgtcctcggcgctggcggggcgttgtctcgtctctgggccttcgctctcctcgcgcggacgctgccccgtgactaccccttggcaggggcgtgtcgcgatgtcgccgagcgcggcgtgatcgtgtcgtccccggggccgaccggtgaccccttgtccttggcgcgaggcctgacgcgcacggtgccgttagtgcgccgttagcgccgacccgcggaactggatcggagacgttgggtgtgagtctcctgcgagcacggtccgggcggtcgcgtgcttgattggcgaagatggtcgcggtgctggaacgtgcgggactggggcagcatcgagggcgtcgattcgtcacgcgtcacccgaggtcgcgacggcggttcgctgtggcgagcctcggctttgtgctcgcggggcttggcaccgcaggcatcgtgtggccggtgacgtggctgcagcacgccgaggcgcgcgggacggtgtcgattcgacgcgtcgtgcggtctgagtgtgacgccgtaccagcgggagcgatcggcgtgttggccatcccttccgtaggcgtcgttgcgccggttgcccaaggactggcccaagcgaccctcgcgtgggcggtcggccatgatccctccacaccgttgccaggtgaactgggcgtctcggtgctggcagctcacgacgtgagctacttcgcgtcgaacgcaacgttgcggaggggggccgccgtgctctacgcacagggttgccggacctacgtctttaccgttgcagatcgcttggttctgcaccctggccaactcattccgccgccaggtccgcgtgggctcgccctcgacagttgttggccgagcgacgcactgttcctgacccctgatcggctcatcgtcacggcgcggttggtggcgatcacccggggcgatcgactcacgctggcgagcacaggcgtgacgccaagcctcccagccggtgtcccccagcccccgaacctcttcgcctcggggtggcttggcgggacgctcaccatcctgggcgcagcgtcagtaaggtggcgagacagtcgtgctcccatggcgtgggaggccgaggcattggccagcttgtcagccgcccgggtgggcctcgcgcaggacgcgcgctggacttccctcgtcgtcgcggccgggaccgtgcgcacggggctccttctggctccgtatacgtccgggacaccagtgagcgtacgtgaggtcgtcctaggggatcgcgttctctccgtcgccgtcacggttaccttgggcggcaacccgctgaccgtgaccgaggttccgagcgcgggcacgctccgcatcgtctcggtcgatcccgtctaaggatccggcccctcgctcggcctcggagacgacgccatcgagtgtcgatggaccaggtccggccacgtggcgggtgtcccgcgacgctacggatgggtcgtgatgtcggtggcgtctgcactgggacggatgggccgtagcgacaggtggccacccgtgcttcggcccagccacgtggtcggacccgcacgaagacgccccttgcgatgcttacgcaacggacgcggcctctcgcggaccgtcgccgctcgtggtccccggtcgtcgagatggcgcggttcgactctgtggaactgccgtggacgccggttccgtcgccgttggcggcgtcgagcggttctggcactcggaatgcgggcggtgcagagtgcaacagcggcctcgagaccggtcgcttcacgatcgtggtcttgaccagcagctggggggtccggcttccgaggacgaaggttgtgctatcggctccggggaggtaccgccgaggcggcgtgcgtccagacggcagaggcgcccgaccacggcttcgcgaaggcgcgcatcgagggacgccgggacggccctcgacgtgggtacccgagaggtggcaacggctggccggtcgtgcagcagccgctgcctccgtctcgttcagcgtgcggcttctcgtgcgggcgtgccttccagtgaggcggcgagggtccgcaccgccgtccgatagcccgactcgatgagcgtcgatgtctgagagaagtcgagggcatcgagggcgttggcggccgggcactccagcacgatcacctcggcacgttctcgtgcccacgcgagctcagtggcgagctgtgctcgcttggtgagcgtgatcgagcgcaccagggcctcgagagggcgctcgtggacagggagcggatcggcgagcgtgcccgtcaggagcacgacgatgcgcgtcgcaccgagatcggcggcccttgcgaccggggtgtcgtggaggacaccaccgtcgacccattcgcgtccatcgtgaacgagtggcggcaggacgccagggatcgcggcactgccgtagagcagggcgacggcgggaccttgacgctcccatcgtgcttcgccggtgcgcgggtcagccaagacgagttccatcggcaccgtggtatcggcgaggtcgacgaccggcacgtgggctgcgataaaggtcatgagcggttcggcggggaagacgctcgcccggcgcgtcgcgtaccggaggagtgtcacgagcttggtcgccgggaacaggcgcgcggctctcagcgactgccagatgctctcgaggcgctcgacactgcgcgacgtcgggtcggctgcaacgatcacgccgttcagggcgccgaccgatgcgccaacgacgagatcgggtctcacccctgcttcgaacaaggctcgtagcatgccgacgtggcatgcgccccttccaccgcctccggcaaagacgaacgccgtgagctcgtgctgctcgtctcgcatgcctgcaacgctagctcaggacgtcggcgtgtctttcgcagtctgtgggcccttggtccgctcgtcgtcgctgccgcagttcgcacacgaggacgcgacgtcgagctcgcggacgaggtccgcgaggagggcaagcagcatctcgcgacgatccggtccccagttctgcagcgcgcgctccagaactgcatggcgccgagcgcggagctcttcgaggacctgcttaccgctcggcgtgaggcgtaccttggcgacacgtgcgtcctcggcgtcagcgaccttctcgatgaggccacgatgcgcgagggccttgagctggcgtgagacggtggagatgtcgaggttgagttgggtggcgaggtcgctgactcggatctcgccgtggtgggcgatggcgacgagctgccagaaaccggctccgatggcgtaggtaaacgtggcatgctcgcccgagctcacgcgaagtcgacgcagtgactgccccagtcggaagagcagttcgtcgagcgtgcgcgaggcatcggagtcgggggatgacgccatcgggtccgagcatacccgtcgcctcgatcgacgctcgggctcggcgcctcatgcagtgttcgcatactttgagggtcgctaggatcgccacgtcttccctcaccagagaaggaggggtcgtgcaccgactcgatgatgaactccggtcgctccaagcgtcgatcgttcgctacgccatggaacgcattgctctccagccaccaccgctcgacgggccgaagagcgccgacgaactgcgcgcgctctacggcgcgaacgtcaccgaggacggtatcggcggcgaagaggccttgcgccgcttcgtcgagggctacgcgccggccaccctcagctcggatcaccctcggttcttggcgttcgtcccggtcgctccgaccaaggcagcggtgctcttcgacatgatcgtctcggcctcgagcatctccgggacctcgtggctcgagggcgctggcgcggtgtacctcgagaacgaggcgctgcgctggctcgccgacctcatcgggttccccgagacggctggtgggacgttcctgtcgggaggttcgctcgcgaacctttccggtcttcacgcagcgcgtcaggcggccaaggagcgcctcggcggtgtgcggcccgatcgctaccgcattcttgcctcgaccgaggcgcactcgtcgattcgcacggcagctgacgtcatggatctcgaggtcgtcgaggtcgaggtcaacgatccgggacggttgcgcggtgaggacctcgtacggacgtgggcaaagctgaccgatgccgagcgcaactcggtggtcgctgtcgtggcaacggccggcacgacgaacgcgggcctcgtcgatgcacttgacgaggtcgccgactttgccgaggtcaacgggctctggatgcacgtcgacgctgcctacggtggtgctgcgctcgcgtcccatcttcgcgagcgctttcgtggcatcgaacgtgcaggctccgtcgtgatcgacccgcacaagtggctgttcgctccgttcgatgctgcggccatcgtctaccgtgacccgaacgttgctcggcgggccctgacgcaagaggccgcctacctcgacgagatcaatcgtgcgcccgactggaacccgtcgagctacggctatcacctctcgcggcgagttcgaggtctgccattctggttctcgctcgcgacgcacggcacgcgccgttatcgcgaggccatcgaagcgtcgatcacgcttgcccacgagagcgcccacgagatcgagcgacgtccctacctcgagctcgcgatcgagcccgaactgagcgtcgtggtgtttcgacgcctgggatgggatgccgaagcgtacgagcgatggtcgcggcaggcgctggtcgacggggtgggcttcgtcctccccacggcctatcgaggggagaagctgttgcgcttctgcttcgtcaatccactgaccaccctcgacgacgtacgggccatcctcgacacgctcgcgatcgaccctcggccctggtgagagccgtgagctgtccgttgtgcggcgcggcggcgagtgcgctccgccgttcgaccctcgccgcggtcgtcgcggatcgctatccggtcgcagcgggccacctcttggtgctgccgctgcgtcactgtggccggctcgtcgatctcgacgacgaggagcgagcggatctctgggcgttggtgcacgacacgctcgatgctccaccgccggtcgttggtgaggcagatggctggaccgtcggtgtgaatgatggagcggcggcaggccaggtcatcgatcacgtccatgtccacctcattccgaggcgagctggcgacgtcagcgacccgcgcggtggcgtgcgctgggtccttggggcgaaggcgccgtggtgggacgacgtcggagtcgacgacgcctcgcgtcaccgttgacgtcggcgagctgccagggcgagctgtcagcgatatcagggaggggccgcggctcatgcggacccgagtcgccggctcgacgatcggccccgacaccagcagcggagcccccatccccgctgctggtgcgtgcgccgcgacccatcggcagcggcgcgtggccccccaaaggctgcctaggcgatgcccttgagcatcccgtgccagtagagcgcgggcagtccgtagcgcttgagcaaccacattgagtagtgctccttcgtcgtgtcgatcagcggcacggtcgggtgcggattgccggtgtagtcgaactcggcgagcagcatgcggttgcgagcggtcacgagcgggcacgacccgtaaccgtcgtagtgcgcttcgggtgtgcgccctgccatcactgcctttaggttcgcgaccacgacgggtgcctgcttgcgtacggcggcaccggtcttggcgttgggcgtgttgccggcgtcgccgagggcgaacacgttgggatagcgcacgtgctgcagcgtctccttgttgacctcgacgcagccgcctggcgtcccgtcggacagaggcgtcgccttcaaccagtcaggagcgctctgcggcggtacggcatggaggaagtcgtaggagatggtctccttggtgccctccttgttgtcggagatgacgacctcgcgcttggtgccgtcgatctccaccatctccgattggaaccgaacatcgatgccgtagcgcgcaacgaccttctcgagctccttcgcccacaccggcacgccgaacatcgtcggtccagggagcacgaggatgacgtggatcttgtcgagcacgccctcgatccgccagtagtccgccgcgaggtaggcaatcttctgaggcgcgccggcacacttgatcggtcccgagggcatggtgaagaccgccgtgcccgagcgggtccgctggatgaagtcccaggtgcgtggcgcgagatcgaacgtgtagttgctcgagaccccgtcgtggcctaccgcctcggtgagtccgggcactcgatcccaattgagctgaatacccgggcacacgaccaggtagtcgtagtggacgggaatgtcgctctcggtgctcacgacctggttctccggatcgatggtgaccacccggtcacggatccacttcacgccacgcggcatgaccgaggcctcggagcgcacggtctcactcgccttggcgagccctccccccacgacggtccacagtggctggtagtagtgattctccgatggctcgatgatcgcgacgtcggtctcgcctgctcgtcggaggcgtgccgccaccgtgatgcccgcggaacctccgccgatgatgaccaccttgtggtggagccccttcgcttcggccatgtcccctcctcgacctcatgaaggttgtgctgataccgacaagggtacaccactgagggaccttagttgaatttggttcgggactttcgtcccttgttcacgtcgattcaggtctgcggtcggctcggagcctggtgacgtagcgcgacgggcagtcgtccatgacgacgatgagaccgccctcgcgcgcgatggcggcagcctcgtccgagacgatcccgagctggagccacagtgctcgagcgccgacaccgacggcggcgcgagccaccgcggggcacgcctccgggcggcggaagacgtcgacgaggtcgatcgagtgctccgcggcagcagcctcgagcgtggggtaggcgggcaggtcgtgcaccatggtttcgcgagggttcaccggcagcacctcgtagccgaggtcgaggagctccgccatgacgtggtgggaagcccgccacgggttcgaggacgctccgaccatggcgatggtgtggaccgagcggaggacgtcgatgggctgctcggcgccgatcacgatcatcagtactctcccctcacgacgttgagcaggggaagtccggccatgtagcggcggacgttgcgctcgacgagcgccgacgcgcgcgtctcgaggccggcgacgtctcctccgacgtgcggggtgagcacgacgttcggtaggtgccacagcggatggaaaggcggcagcggttcggggtcggtgacgtcgagaccggcccggagccgaccgctcgcgagctcggcgaccaacgcttctgtgtcgacgactgggcctcgggcgacgttaacgacgaccgcgccgtcggggagcctggcaaggagtgctgcgtcgatgaggtgcctggttgcatcggtgaggggaaccacgacgacgatgccggcgagcgtgggaagaatcggggcaaattcgtcgaaggcgaggacgtcagggttgaaccggggtgtacgagccactcggacgatctcgacgccgaacggcgcgaggcgagcctcgatggcgcggccaatcgcgccgtagccgatgatggcgacgcgcgcacccgcgaggcttggcatgacacgacgctcccaccgcccctcgtgttgggccagggcgaactcggacaagccacgcgtcgcggcgaggaggagcgccaccgccaactctgcagtcgcgtcatcgtgcacgccgcgggcattgcagagcgtgacgccttcgccgatctgcccgacgacacgatccacgccagctgtcaggagttggaggacttcgaggtgacgcatacgcgggagcggctcgagggcggcgccgccggcagcgtaggccggcacgaagaaggtcgtcatggccaatcgatcatcgatcgggtcccctggatcccacgtcacgatcggtgcgtctgggatgcgtgtgatcagttcggtgagggctgtcgggaccacgatctgcatgaatcggagcctaggccctcacctccacagaaggtcagctgatgggcgtggctgaacggggacgtggcaactcgccacgtcgtgctgctggggacgtcgtcggtgcgtgcagcgtgagccggctgcccactcccgcttcgcctccgcgacgacgatccgcgtgtcgcccacacctggttcggcttgaccgctccgtcgcgtcgttctcagctctcggcgcccacgcacgctgctggccttctccctccaggttgacacctgcgatcgggggaatggatgggccagcattggaaggccagcattggaaggccagcattggaagaggacgacgcccttcgccactctgggcagactcgtggtcgatcgggaacggcccttgttcgtacccacggacgacgggccgcagttcgcgaagcggtacctctgacctgggagctggcggggatggcgtgtggtggttcgctgatgctggtctgtacggctctcaggatgtgactctcaggatgtgaactgagtccgcctcgcgctggcgatcatcgcccagatgaacctctcggtccctggtcatcacgcagcagcgatgagccgcggttcgcagcgccgagccgtcgagcagcgcggcctcgggcgtcttggtgcccgaggccgtccctgcgacgcggccgctcagtcgccgagctctctcgggatcgcggtctggaagctgcggaacagctgcgtgaggtccgcgtagccgaggcccgatcccggattgaacacggcgccttgtgagccggtgtagaagtcgttcgtgttggtgaactcaccggagatcgcaagctgggcgttgccgatctggccgctgtagtaggccgagccgtcgatggtgttcgaatcgagcggcgtgaacggcgacgacgtcgaggtcgcgaagcggtagatgttcggattccagaagccgagccgtacgcccccgagggcgctctcgtagacggcgtcggtcccgttgagctgaggcgcgatgaagctcgtgccaccgaagtccaccagctttgacccgtagacgctctggaactgtgggtcgtagaccgcatagccggtctgggggtcggcgttgaacgccaggtccggcgtgacgcggccaccgctcatgcccgtctgaagcgtcggggcagggttgaacgagaactgcgtcggctcgacgaggcctggtgcgacctgctgtggatcgatcggcgtcaagaactcataggccgagtagctccctgcccccaccatctgaccctgttggtagagcggacggccgaagagggtggagtagccaccgcctgatcccaccggcaagctcgtggctgcttgggcctcgttctggaagccgagtgcgatgtacatcggccacaggtagtcccagccccaggtcatctgctgcgggatggtcaccgactcggtgccgacttgggtcccgttcgccatgatcgggtaggtctgagtacccgggagcgtcgtgccgccagcggcggtgtcgtagggggagtcggaggggttgtcgataccgaggttggtggtaccgatatcgccttgagggtcataggcgccgttgtcgccgctcgcgatgaagttcgactgtccctgcgccgccatctcgaggaaggcctggttgaacgaggccgcataccccggtgactcctgcgctgcgtccaccgcagcttggatcgcggtctcggactcaccccagctcgacgagacggagccggcgacgttctggctggccgcctcgtagaaggcgtcgacgaagccgtagtcggtgttgggcgcctggtacacgacgatcttggccatcggcgcgatcgtgcccgactgctcgacgtcgagggtggtctcgtcggagccagcgttcagcgacaccggccctgcaccgccgtcgacgttgacgagcgcaagacgattcggcaacgtcacgacgtgcgcgatgttcctccagaagtacatcggcaccgaagggttcacgctcgccaaggtcacgatgccgatggtctgcccctgaccgaggtagcccgcttgctggagcggtgtgaggttgtagtcgctcgtgaaggcctgcggcagctgatcggtgggtgctgcggtttgcgacgacccagccgtgggtgcgacctggttgatgccgggcaccgcgagcgactcgtagggcgcgtagttcgacaacccgagcacggccagaatgttcgacgccaggttcaacggcatctgcggcgcgctgcgcgtcccgtagaccgtctgggtcgtcgcgggcgcactggctgcgggcctggtggtgacggtgaagttctcgagcaagatcccaagggccttgtcgtactgtgcggccgtgccctgcgaggtgacatcgaggccatcgctcatggcctgggagctgatgccgaactcacggaggaacccacgcagcgcgaggatgtactcttcggtctggccgtactcgagcgcgaactcatggggcgtcaggtacggaccacgccaaccagcagccacccgagaggcaagctgtccctggttgcgcatcttcaggatgaacgacacccgcatcatcgtcgacccagccgtggtgcccgtcggggtggcgtgcgagagcacatcggcaccgatgccctgcgacaccggcaccagcggatcagacgccgacgcgagcgactgcgcgcctggcatcgccagtgcagcgccgacgaggccgatggatcccaaggtaccgagcatctgcagacgacgactgatacgcctcatagcccaacccccctcatacctgagcgcagcccacacccatgcaggacctgcatcagcgcgacactagcacgcgaagtatgccgcatcgttgtcgagacggtccgtctttcggttggctcgactaccgagcgtgctggtccgtcgcggcggatgcgtcgtgggttcggtcgtgacgtgctcagtgcatcaggagacgcggctcggcgtcgacaccgagtgtgaggtgccagaaggagtcctgcgatccttccgccttgagttcttctgccgcgagtgcaaggcgcttcatcggggagcgcgccgtgtgatcgtgtgggagcagggttacgaggtagccgtcgcgacggaagtgtcgagccatccgcaacgcctcggcaatctgagtcgtcgggtcgaagatgagggtgaggcggcgtcgcggcgtggcgaggtggatgccgagctcttcgagcagggagagaatgcgctcgaacccaagcgagataccgcaggccggctcgtcgactccgaagcgtgcgaggagtccgtcgtagcgcccgccgccgccgatcgacgacgaccagtgagggtgaacgatctcgaacaccgacgaggagtagtagtccagccctcgaacgatgagcgggtcgatgacgacctccgtgtcccggaccgaggtccgcacgtgcgtcgcgatcgcgtggaggctctcgagcacgcttgcatcgacatcgagggtctcgaggacatcgaggggatgctcgttctcgacgatgtcaccgagcgttgcgaggacgtggtcggcgagctcctcgccgagcccagccccgaccatctcgttacgcacagcgatcggcggctccttgtcgagcttgtcgagcgcgacgagcacactgcgccaatgatctgccggcacctcgagacgctccaggacatgctcgacggcccgtcgatcgttcacgtgcagctcgaagccctcgaggccgagctggtgcaaggccgccgtggcggcgatcagcagctcgacctcggcgagccagctcgcctcgccgaggatgtctgcgtccgcctgcacgaactggcggagtcggccgcgctgcggacgctcggcccgaaaggcggggccgatctgcatcgcaagaaagggcttgggcagcttcgactggttcacggcgtagaagcgagcgagcggcaccgtgaggtcgaatcgcaggcccgcatcgacgaggtcgtcggggctcgaggcggacccgaggtcgagacgctcgccgcgcttgagcaccttgaacatcagcttcgcattctcgcccgccccggaggcagccagtgcttcgagggtttcgacgatcggggtctcgatctcgaggaagccgtgcgaccggtacgtcgagcggatcacagacgctgcggcagagcggacctcgtgctccccggggaggatgtcgcgcattcctcgaaacggacgcacctggagcattggactcctctctgactcgggcgccgatgtgctgtcatcaggcagtgtcatcctacgcctcgatcgggcccgaaccgtggcccttgggaagggatgcgctctcaccggtgttgtccggacaaaggaggggagccatgcgcaagtccttgcacgtccgttccgtggttaccgtcggggtcttggcgagccttggtgtcgtactggccgcctgtgggtcgacgtcgtcgacgtctacctcggcgaagacgtcgtccagctctgcgaccgtcgccacgtcgtcctcgagctacggcaccatcgtgacctcgggttcgggagtcacgtactacgtgttctcggcagactcacacgatcattcggcgtgcacgggttcgtgtgccgctgcgtggcatccggtgctcgcgacgcaccccacggtcggtggctcggcccaggcatcgctcgtgagcacgttcgtgcgcccaggcggagagcatcaggtcgcctatgacggccaccctctctacaccttcgtcgacgactcgggcccccacgtcatcagcggccaaggcatcaactcgttcgggggttcctggcacgtgatcgccccgagcgggaccccgatcaccgctgcgtcgagctcgtcgagttcgtcctcgagcggctatagcagtggctactagacggcgtccgcaccacgaccacgacgcccggtggctctaggctgcgagcgcacggcaccatgagcgtgccctgtgcctgatcgacgaacgaggaggccctggtgcgcagcgcttcgccacggcacgacagtcatatgatcgccctggcgcgaggtgacgggaacgtcgacctcgtcatcaacggtgcggaggtcttcagtcctctgacgcgaacctgggtctcgacgtcgctcgcgatcgccgacggggtggtggtcggatggggcgagcggccgaccaaggagcggctggacctcgcgggcatgatcatcgtgcccggattcatcgatgcccacgtccacatcgaatcgacgaagctgtggatcgaccgcttcgtcgaagcgaccgtacctatggggacggtcgcggtcgcgagcgatccacacgagatggccaacgtaaaggggctcgagggtgtgcgtgcgatgatcgcagccgcccatgatctccccatcaccatcggagtctgtgggtcgtcgtgtgtgccagcgtcgcgattcgagagtccgggggcgacgttcgaggtggaagcgatcgccgaggtgctcgccgagaccgacgcgctcggtgtggccgaggtcatggacttcccaggcgtgatcgctggcgacgagaccttgctcgccaagatcgcgctcgctggttcgcgtcgcgtcgacggccacgctccaggactgcgcggttcggatctcgatgcgtacctcgtcgctggcgtggaatccgatcacgagatggtcagtctcgaggaggtcgacgagaagcgtcacaagggcatgtgggtcttcctccggcacggatcggcaagccacaacctcgctgcgttcgccccgtcggtgcgagcctacggaacgaccaacgttgcgctttgctccgatgaccgggagccggatctccttctcgagcgcggtcacgtgaacgacctcgtcaggatcgccctggaggcgggcatcagcctcgaagacgcactcgtgctggcgacgttgaaccctgccacctaccacggtctcacccatctcggccatctggggcccggccgtcaggccgacttcgtggtgtatcgatcgcgcgccgagctcgaggcgggacggcctcccgccatggtgttccaccgtggtcggctggtcgccgaagatgggcggctcgtcgtcgagctcccccgtcgcgaggtgcccgagaccctcctcgccaccgtgcgtcttgctcgagcgctcgtcgagggggactttacgaccccgatccccgagcgcgttcgagtgatcgtcgccaacgaccactcgctctggaccaaccagcgcgtcacgactcgtgacgagctcaccgggatcaatcggctcgcggtcgtcgagcgacaccacgcgaccgggcgcatcggccatggtctcgtcgagggtttcggcctcgagcgcggtgccatcgcgtccaccgttgcccacgacgctcacaacctgatggtggtcggtgcgctcggagccgaggccgacatggcgaccgcagccaatcgcgtcgctgcgctcggcggcgggcaggtggtcgtcgtcgatggccaggtgatcgcagaggtgcccctcccgatcgccgggctcatgagtgatgcgccgattgccgagacggcgcgcgcggtcgtcgaggcgacgcaggccgcccatgcgctcggatcgacgctggaggcgcccttcatgacgctcgcgttcttgggtctgtcggtcatccccgagctcaagctcactgaccagggactcgtcgacgtcggagcgtgggacgtcgtgagtctcgaggcctgacaagccaccgctcaccccggccggtacgctaggagcaaggccaaggaggtcacccgatgcgtgatgccgtcatcgtcgatgtggttcgaaccccagtcggtcgtcgtaatggtgcgctctcgggctggcacgcggtcgacctcgcctcgacggttctcgaagcgctcgtcgcacgaacgggcatcgacccggcgctcgtcgaggacgtcatcatgggctgcgtctcccaggtcggagagcagggcatcaacgtcgccagaaatgccgtcctcgccgcgggttttcccgagtccgtccccggcacgacggtcgatcggcagtgcggctcgtcacagcaggcggtcgcgttcgccgcacaaggcgtgctcgccggtgcctacgacgtcgtgatcgccgccggtgtcgagtcgatgtcgcgggtgccgatgggctcgaacggggtgggccctgggtcgccattcgggccccgtgtcgaggcgcgctacgcagcgcgtggaggtctcgtgcctcaggggatctcggctgaactgatcgtcgaacgctgggggttgacgcgccaggagctcgatgcgttcgcgcttcgatcccacgagcgtgcttggacggcgacgacggaagggcgtttcaagtcggagatcctgcccatcgaggggcgtcgtgccgacggtgcagccgccccgaccgtgctcgaggcagacgagggcatccggcccgacacctccctcgaggcgctcgggagtctgaagcccgcgttcgtgcccacagggacggtaacagcgggcaacgcctcgcagatctccgatggcgccgccgctgctctcatcatggacgccgaacgggcgcgtcgccttggcctcgtcccccgcgcgcgggtcgttgccttctcactggcggccgacgatccgatcatgatgctcaccgcacccattccagcgacccgtcgtgtgctcgaacgcgcccatctcagcctcgatgacatcgacctcgtcgagatcaacgaggccttcgcatcggtcgtgttggcgtggggtgctgagctgcatcccgactgggatcgcgtcaacgtcaacggtggggcgatcgcgcttggccatccgctcggggcgtctggggcacgcctgttggcgaccttggtgaacgagctcgagcgccgtggcgggcgttacggcctccagaccatgtgtgagggcggcggcatggcgaacgcgctcgtgatcgagcgcctcgggtagatgagcgccccacgcgtcctcatcgtcgacaacgtcgactcgttcgtccataatctctatcagtacgtcggcgagctcggcgcagatccagtcgtggttcgtgacctcgagattcgagatcgtgtcgatccgcgcagtttcgacgcgatcatcatctcccccgggccggggcatcccagggcgtgcgtcggaggacggtggatcctcgaggatgcagctcgcgaggtgccgacactgggtgtgtgtctcggccatcagctcatcggtctcgtcttcggtgcaaccgtgacccacgcaccacgcatcgtgcatggtgagacctccagcgttcgccacgacggtcgaggcgtctttgcggggctgccgaatcccctcgtggcaacccgctaccattcgcttgcgatcgacccgacctcggttccggacgagctcgtcgtgacgagctggagcgaggacgacgtgatcatgggggtgcggcaccgatcgttcccgatcgagggcatccagttccatcccgagtcctacgccaccgacctcggccaccagctgatcgggcgattcctgggtctcgaggtgcctgcccgcactcgctgatccttgtgcgggcgtcgttcgctcggatggccaagccggcgcgccaccggagctgctcagggtggcgaccttcgccgtggtggcacttggcacgaggaaggcgggcatgcacgtccgctgcggtggcgttgacaccgacccgggcgccgcgctcgtctggtggcgctggccgtgcgacggcacgggctcagcgccgagtcggatcagccggctgacggggttggccccccgctggcaggaccgcccgaagcggtcgtcgtccacgtgatggtcacgctggacccaaccggtgcctgggtccctgcggccggcgacgtcgactcgaccaccgcggcagccggagggttcggctgcgagagtgtgtaggtgaagccagcgttggtcaggtcttgctctgcggtggcgaccggatcgccgacgacgttcggtaccgtcgcctcgttgccctgcgacaccaccaacgcaacactcgatcccggcgccaccttcgtccccggagcggggctcgtcgagatgacgtcaccattcggcacgctcgagcttgcctggtacgtcaccgtaccaacagccaattggtcggccccgagcttgttggacgccgatgcgagcgagagaccgacgacgttcggcaccgcgatcgagctcggaccgttggagacggtgaggacgacggtcgaaccgtgcggggcggacgtcccgccagtcggcgactcggcgaccacggtgccctgcggcgcgctcgctgcctgatagttggtggagacgttgaagcccaacgcgagcagcttcgcctcggctgtcgatgcggtctcaccgacgaccttcggtaccgtcaccgccgccggtccgctcgagaccacgagatcgacggtggagcccttctgaaccttggtgccagcccgtggcgattcggcgatgacggtacccgaggaggccgaggccgcccggaacgacagtgcactttggaggccaaggttggagaggacctgcgctgcgccctgctcctgggagccgacgacgttcgggacggcgacgcgagggagcggcgctgcgacgtgatggttcgagccggcgagcttcgcgtacagaaggcctcctgcgagtgcgagcagcaccacgatgacgagtaggatccatggccagcgccgccgccgacgagctgtctcgaccggcggcgtcaccgccgggatcgatgccgtgtcctcgacacgactgagcaactgggtccgatcgccaacgccctcgaccgctccgatcgccatcgtgcgctcgccgagcgcggtctgggtggtcgtcgtgcgcaggggacggtgctcgagcacccgctgcagatcgacacgcagtgccgtcgcgtcggggtagcgctggtcgcgctgcttggcgaggcagcgcatgaccacggtctcgagttcggcactcacccgagggttcacgttccggagcggggtgggcgcctcggtgacgtgcttgtaggcgacggcgatcggtgtctcaccgaggaagggtggcgtcccggtgagcatctcgtagaggacgatcccgagggagtagatgtcgctgcgtccatcgagatcctcgccacgggcctgctccggcgagatgtaggtcgcggtcccgaggaccgagccggtctgggtcaggtcctcgtcgttggcgaccgcacgtgcgatgccgaagtcggccaccttcacgatgccgtcctcggtgatgagcacgttggagggcttgatgtcgcggtggacgaccccgtggcgatgggcgaaggcgagtgcgagcgcgacgtcggcgccgatcgaggctgcttgatcgggggggaccaccccgaccgtgcggatgagctgcgccagcgtctgaccgctcacgagctccatcgcgatgaagtaggtgccgttcgcggggccccagtcgtagaccgacacgatgttcgggtgcgacagcgccgctgccgactgcgcctcacgccggaatcgctcgacgaacgtcgggttcgtcgacagctccgcgaagagcaccttcagcgccacgaggcggtcgagcaggaggtctcgcgcttcgtagacgtcggccatgccccctcgggcgatcttcgcgatgggctggtagcgcgtcccgaagacttggagctggacctcttcggtcatgtctgcctgccttcattcatcacagaggcacgctcggagcgcgcatctcccgtcatgacgacctcttccgcttagcgtgcgccgtggcggttggtgctggcgctcgcgcgatcaccaatgtcacagctgatccaggggcgacctcggtgcccgcggccgggcgcgatgcgagcacgtcaccgctcggcacggtggtgctcgtttggtaggacaccgtcccgaggacgagttggtgggttccgaggaggttcgaggcggccgcgacggagaggccttggagggtcggtacgaccacgcgaggtggtccggaagagacgatgaggttgacgcgagatcgtatcgcaacggtggtgtcggcggtggggctggtcgcgatgacctcgccgggtggcacggtggtgctggcctcggtcgtcacggtcccgaggacgagttggtcggcaccgaggtcgttggaggctgctgcctctgacatcccacgaaggcgcgggaccgcgacgaccgcgacggccgtgaggcggcttgcgatcactccgatcgcgacgccgagcccgagcaccacgaccagcacgatcgcgagccacggccatcggcgcgaccgtcggggcggcgttgtggaggctggcgagctcagcaactgcgtccgatcgccaacgccctcgaccgctccgatcgccatcgtgcgctcgccgagcgcggtctgggtggtcgtcgtgcgcaggggacggtgctcgagcacccgctgcagatcgacacgcagtgccgtcgcgtcggggtagcgctggtcgcgctgcttggcgaggcagcgcatgaccacggtctcgagctcggcactcacccgagggttcacgttccggagcggggtcggcgcctcggtgacgtgcttgtaggcgacggcgatcggtgtctcaccgaggaagggtggcgtcccggtgagcatctcgtagaggacgatcccgagggagtagatgtcgctgcgtccatcgagatcctcgccacgggcctgctccggcgagatgtaggtcgcggtcccgaggaccgagccggtctgggtcaggtcctcgtcgttggcgaccgcgcgcgcgatgccgaagtcggccaccttcacgatgccgtcctcggtgatgagcacgttggagggcttgatgtcgcggtggacgaccccgtggcgatgggcgaaggccaatgcgagcgcgacgtcggcgccgatcgaggctgcctgctcgggagggacgaccccgaccgtgcggatgagctgcgccagcgtctggccgctcacgagctccatcgcgatgaagtaggtgccgttcgcggggccccagtcgtagaccgacacgatgttcgggtgcgacagcgccgctgccgactgcgcctcacgccggaatcgctcgacgaacgtcgggttcgtcgacagctccgcgaagagcaccttgagcgctacgaggcggtcgagcaggagatctcgcgcctcgtagacgtcggccatgccccctcgggcgatcttcgcgatgggctggtagcgcgtcccgaagacgtggagctggccgtcgcgtcgagttcggcgtcctcggtccctgcgaccgagcgagaggggggcggtcgactcgtcggtcatccctgccctcccgtgataccgagcgcagcttccagcatcgccttgacgaccgggcccgcatactgagcccccgtcgggttcgcggacagcccaggctgcttgggtacgacgacagcgacgacgacgcgcgggttctcggccggagcgaaggcaaccatccagttgtccgatgcaccaaggaccgaggagtgactcgtcaacgtggtctgggccgtaccggtcttcgcagcgatctggacacctgggatctggatgccgaccgccgtcccgtagcggacgacgtcgatcatcagctgtgtgacctgtgcggccgtggacggactggtggcgaccctccaaacgtgcgggtggtaggccgtgacgaccgcgtcttgaggattgaggacacggttgaggacgtgcggggtcatgatggcgccgtggttggcgataccggctccgaccagcgccatctgcaagagggtcgcggtgacgttgccttggccgatcgcgctgaaggcgagctgggggagattctgcttgaagaacgatgcaggtgggaaggtcgacgcagccgctccgggcaggtcgatcggaggaacctgattgaatccgaaggccgtggcctcctcgctgagcgcggtcgcgccgagcttgaggccgagctgcgcaaaggcggtgtcacacgacacagggagcgtctgggtgagcgtaccgccacaggactcgtaggcgtaattgtggagttcgtgcgtggtctcaggcaaggggatctgcgacactgcagggaagttgatcagggcgagtttcgggtcgtggtcgaagattgccgaggtcgtcaccatcttgaaggtggacccaggcggataggcgcgcgaaatcgcccgatccaggagcggatcacccggattggcgagatcggccttccaggccgcgatctcggtcgtcgtcgactgtgccgcgagcggcgcaggatcgtaggtggggttcgatgcaagggcgaggatcgcaccggttcggggatcgagcgcgatgaccgctcccttgagtgacccgagcgcctggtacgccgtgcgctggaggcgcgagttgatggtggtgacgaccgagtcggtctgctcgctcgacccgaggagctgcgagatcgagtcgggtaccaccacgtgcgggacgaggtagcggttgagctcgtactcgaggcctgacaggccgtagatgagcgagaagtagccggtgatgtcgccgtagagtgatccggccgggtaggtgcgctggtagctgttgccaccgggaagcggcacggactcggccatgacctggccatcggcggtgaggatcggccctcggttctccgagaagatgcgctgcatgcccgcggtgttaccgggcgcgtcggcgagcttggacgcctggaccacctggaggttgttgagctgcacgaagaccaaggcaaaggcgagcagcagtacgagcgtgacgatcccgatgcgcctacgcatgcagcacctccaccacgccgaacgcggcaagggatgcgtgctgctgcgcggcctcgcgtgtcaagttggcgacgagcgtccttgccgcagccagcgatccctcttggacgccgtggccgagctgcaggcggagcgctggcgtgagcgcgcgctgctggagggatgtcgtctcgacgacccgcgggtggaaccagaggatccctccgatgcgtccccgctcgatcacgacgtgacctgcgacgatggtcacgatgtaggagtggtcgttgtagagcgcgaccacacccaccaccaccgccgctaccgcgccgagtgccacaatgagggccgcgagtcggagcgccgaacgtatccaggtcggacgttcggtcatctgggagggaagaggacgggggagcttggttgcgagggatgggtccttcggtgccgacgacgatcgcctcgtccggcccgacgcagcgcgggaagcctcggacacgaccgaggtcgacgctgtgtccgcggggcgggcgtgcgagagctcggacgtcgcgccgagtgcgctcgaggctcccgccggcacaccgtcttcgtgcgcgctgacgacgatcaccgagacgttgtcggagccgccgtgctcgagcgccgcctcgaccaacgccgagacggcgtgctccgggtcatcgttactgagcaggtgcgcgatctcggtctcggtgacctcgttgacgagcccgtcggaacagagcagcagcgtgtctcccggtccgagcgtgagctcgaagtggtcgggttcgaccccttccaccacgccgagcaccttcgtgaggacgtgacgcgcctggtggtgctgagcttgctggcttgtgatcgtcccggcatcgaccagttcctggacgaacgtgtgatcgttcgtgatctgacggagttcgcccgcgcgcaacaggtacgcgcgtgagtcgccgacgttggcgagatcgcagcgcccgtcggggtcgacgatcgcgagggttgcagtggtgcccatccccgcgagctcgggttcgtcctgggagcgctcgaagatcgcgacgttggcggctcgcagcgcgtcgactgcgctcgctccagcggcgacggcgtcggcgatggcccggatcgcgatggacgaggccacctcacctccgacgtggccacccatgccgtcggcgacgacgaaggaccggccgtcggcggcgacggcgtcttggttggacgaacggacgcggccagtatggctggcggctgcccaacgcaactgcatcacccgaccacccgaaaggcgctctggccaacctggagcacgtcgcctcgcgtcacgcgcatcgagccttcgacccgctcgccgttgacgaacgtcccgttcgtggacccgagatctcggacgatgatccgccgtccctccttgaccacctcggcgtggtggcccgagacgaagcggtcgtcggcgagcgtgaggtcgcaggatgcatcacggccgatcgtcgcgggggtggcgagttccagtcgacgtccctccagcggccccgccaccgcgagcacgacgagcgccccggtcttcggaccgccgctcggggtgactcgagctgcggtctggtgggcctctgcctgggcgcccgagcccgccgaggcgaccactggccgagcattcacgctggccggggtgcgctgggctcgacgcgtctcgcgccagacggcgcgcagtgcgaacgcaaagaagatccagatcaccacgatcagggcgtacttcaggatggtcaggaggacgacgctcatggaatcagccgcgctccactcggacttcgaccgcaccgagacggaggacgtcgccggcctggagttcggtcggtcgagcgactcgctccccgttcacgaacgtcccgttggtcgagccgaggtcggtcaccgtcgcggtgccttcggcgatcgtgacctcggcgtgtcgacgagagacgcggttatcgtcgatgcggacgtcggcaccgctctggcgcccgatgatgtaggacccaggtccgagctcgacgggtgcgccgtcgggcaggatgaacctccaccggttgcggtaggtggcgtcttcgacgaaggccgtgtcgatgtagaaggtgccggccttgagctgggggtcggcgtcgatggtcagcgcgatcggccccaggagctcgaagccgttgtcgtcgaccgtctcgcgcgcgagctcagcgagttcctcctccacgcgagctcgcaacggcccgagctcttcgaggtcagagggtgcgagcgcgacgacgatgcggttgggagcgatctcagagcgaaccccgatccgcacgtcacgctcgatctcgcgcaccaagcgtcgcccgatctctgccggttcgatcccacgcggcgcgcccttcgagaaaatcgactcgaccgcgctcgcgatgcgacgctcaaactgttcgagtgccaccccacctgcactataccgagcccacccgcgtacccacttaggaatccccagggagctggcgcgcctgcacacgcgcgtgagctccctcgctaagctcttggcgctcccgggcgagtggcggaattggtagacgcgcaggattcaggttcctgtgagggcaacctcgtgggggttcaagtcccccctcgcccaccgcatcggctctctggcatgggcgtcggtcgacggattgggcatcgccgcggtcgcgcgtgtgcgaagctgaaagcaacccgaggagggcggcatcggaactgtcacgctcgcagccctggtggtggcgacgtccttcgtcggggagctgcccgacaagacgatgatcgcggcggtgatcctcggccggcgtcaccacccgacgaaggtcgtcggcgcggccgtgctcggtctcggcgcccaggccgcgatcgccgtgaccctcgcaaccgtggcccgacgcctgctcaaggcctcggtggtccatcaggtctccggtgcgatcttgctcgtggttgcggccgtgctcgtgtgggtggcgcttcgggccaaggaggacgctggcgacaccatcacgccgaaccgccccttctggcagctcgtcggcgtgttcttcctcgctgaactcggtgatgtgacccaagcaaccacggctggcttcgcgctgtcgtcgtcggagcccgtcgtggtcgccgttgcggcgacggccggcatgacgctcgcgattgcgatcggcgctaccgcgtcctcagcgctcagtcgcattcccgagcgcgcgatctgggcgagcgccgccgccatcctcatcctcttgggcgtcggcgagctcaccggcgttctcatcctctaggtgctgattcctcgggatcggcctcgagcggccaggtcctcgccaccatcgtgagcacgtcgtagcgagccacgatcgctccgtcgccatcgcgtgtcacctcggcatcccaccgaacctcgtcgtagggcatccccgcgcgaggcgtgatctccttcgcggtgagcgtcaccgagagcgcatcgcccgggcgtaccggtgtgaggaagcggaggttgtcgaccccgtagttcgccagtactgggcccggctctggatcgacgaagagtcctgcggccaagctgacgacgagatagccgtgcgcaacgatcccgccgaagagtgggttggccgcggcggcctcggggttcgtatgggcgtagaagtgatcgccgctgagggccgcgaaggcggcgatgtcgtcagccgtgacgatccgcgggcctgcgctgatcgcgtctcccagctggagcgcggaggtgggcttgcgaaacgggtgctcaccgaggtgccgcggggcgcctggaacccactgggcggcgatgcgaccaagcacgctcggtgtgccttggaccgcggtccgtgcgaggtgccgcgtgacggctcgcatccctccgagttcctcgccgccaccggctcgtcctgggccgccgtggaggagccgaggcaagggagagccgtgtccggtggacgcgggagcgctggtcgcatcgagcacgaggatgcgaccgtgccagggcgcaagctccatcacgagctcgtcgacgacgcgcgcgtccgcgctcaccaccgaggccaccaggctgcctgccccgcgcgcagccagcttcgccgcgtgctgtgggtcctgatagccgaggacggtcgcgaccggcccgaaggcctcgatgcggtggggctcgtcacgatcggcgtcgcgcgcgacgagcaacgtgggggcgacgaaggcgcctcgctccgggtccgcgccgaggacatcgtccaggtcgccgccgaccacgacgtctgctgcgcgggcgagctcgtcaatccgggcgcgcacctccgcacgctgggcgaggctcgccagcggtcccatcaccacgtcgggacgtcgcggatcgcccacggtcacggccgagagccgctcggttgcggcctcgaccaccggtcctaccaggcttgccggcacgagcgcgcgtcgaatcgcggtacagcgctgccccgccttgatggtgagttcgtccacgagctgggagacgtagagatcgaattcgttcgtgccggggaccgcgtcaggcccgaggatcgatgcgttgagcgagtcggtctcgacggtgagatgggtgccgcgggtacgaacgctcgggtgcgagcggagcagctcggccgtcgccgccgaaccggtgaaggcgatcgtgtcctgaggcccgaggtggtcgaggagatcctcggcgccgcccgccaccagttggagcgcgccgggcggcaggaggccgctgtcgatgatgagctgcacgagtcggtgggtgaccggggcggtctgcgacgctggcttgatgatggtcggcatccccgcgagcagggctggagccagcttctcgagcggcccccagacggggaagttgaaggcgttgatctgaacctcgacgcccctgcgcggcacgaagatgtgacgccccgcgaagcggccaccgcgatcgagccgttccacctcgccgtcacgcaggacgttgccctccggtagggatcgcttggcgaggcttgcgtagctgtagaggacgccgatgcccccttcgacgtcgaaccacgcgtcgcgagccgttgcgccagcgacggccgatgcgtcgtggagggtgtcgacgtgctccgagaggtacgccccgagtgcaccgagcagtgcgcccctgtcttggaatccgagggcgcggagcgccgggcccccgacatcgcgcgcgaagcgcaccatcgcctcggtcgggagtcctcgcgtcgcgaggcgagccacctcctcgccggtcgtggcgtcaaggacgggttgcccgggatccgtggagaaccaccacgagtcctcgacgaagctgccaagcgtctgcatcgatcacctccgaggccgcgcccgaccgaccggtcggtcggggtgatctgaggctatcgcagactgggccgcctcaccgcggccttgtcgtcgtggctcgacgcacgtgtcgccgccggcgatctgcgtgcagctcggtgctccgggagcctgcggtccgaggtgcgatcagccagcgtgaccgatgcacatggcgctagacccgatcatgaggcacggatcgttggcggagagggagggatttgaaccctcggacccactttcgcgggtcaactcattagcagtgagtcccattcggccgctctggcacctctccttgggctcctaaggctagcgcagcttcggccgccgattcgccccggtggcccagacggcacgggctacgggccggcgtgtgtcggcggcggtcggatcggtgatggcccatccacggagcggggtggtctcgaagaccatgcgacgcccagcgatcgtggggcgggagggagaccacacatgagttggatgagacgacatcgcgtgcgcctgggtctggcggcgcttggggcggtgctcgcaacgggtgcgggcgtggcaacggccgcggcggcctcgccgccgccgagcaacgctgtcgttccaggcaccggggtaggcgagtacgggatgacgagcgccttctacgacggtcacatcgtgcacttcacgtattcgcgtggcttctactgcgacctgcacgtgtcctcgggcgcatcgtccgggtgtgaggtcggcgcgaactacgtcgtgccgccgtcgaagtcgttcgacccgctctacatcgcggtcccgatcgggatctcggtgccggccatgtcgatggactgcccgagcggcctcgtctgcgtcgatcaccccggtaccatcgacctgagcaggctagagcctgcgctcaagccgttgtatccgaacctctcggccgcgcagctgaccgccgccctgaagaacgtcccgacgccagggcacgagcacttcatcaccaccgtgaacgaccgcaagcctgagtggtgggatgtcaaggtgatcggggtggagaagctgtcggtgtggaacgccatcaatcggcatcgctcctttgccttcctcgagaaggaggttcgcgcaggacagaccacgccgatcatccccaccaacctcttcttgtacttctcggttaactaggcgtaaccgccccggcggtgctgcgtgcaccgccagggccgaccggagctcaccacccatgcacctcacacgtcgccgcctgcaacttggcctcggatggctctggctcctcgacggctgcctctcgttgcagggatcgctgctcggaaagagtttcgtcacggcggtcctcgagccaacgctcgcacaccagcccgcgatcgtcgccgcaccgctgcgaaccgccatcgaactcgtcgcaccgcacgctgcgctcgctggcttggcaatcgcgctcgtacaactcggtctcggccttggcctcgtcgtcgctcgcgacactcggcgatggcttgcgctctcgattgggtgggccctcgtcgtctggtggatcggggagggactcggtggcctcctgaccggggccacgctgctcagtggcgctccaggggcggcactgctctacgcgctgatcgcggccgcggcctggccgcggcggggccgacaggagcacgttccgccctcgccgttcgccgtcgcggcgtggagcgtcctgtggatcgtgaacggcgtcgcgcaagtcctggccgatcgttcgagcacgaacccgatcgcctccacagcgcagatgggccaagttggcgccccatcgtggatcgcggccgtcgaccaacgactcgggacgatccacggcgatgccctcggcacgatgctgatcgtgctcgaggttgccgtcgccatctggggactcgtgcctggcggaccacgcacgctgtcggcgctcgtcggatcaggtcttgcggtcgtcgcctgggtgttcttccaggggatgggggcactcacctcgggcctggcgaccgatccgaatacgggtccgctgatgctcctcctcgctggcgccgtcgtcgcggctcgtcctgcgaccggcgctctcacggaagcgatcgggcgacgccgggagcggagggcgccggtcggcgcccacgtcctgctcggcgtgcaccgtggcgagcgttcctcgtccatccccgcccagacgaagtgaggtgtgtccagtcgggtcgtgagcgtctgcgtgctgctgtcgatggctccgggggcatcccggctgtgcaggcagtccgtggaacgacttgcgtgtggcgcactgcggctcgcgccatggcgcccctccgcctccggcgacgtcgggtggcgtggcctcgcccgcctcgctgccgtcgtcggctcaccgcgaccgcatgcggggccgttggcatcgctggcgcaaccttgtgccggcccggtccacgccacctggtgcactgccatcgtgacgatcctcgactcgggcgctcccttgcggtctcggtgcccatgggggtcgatctgggctcgtcgatgaaggctccgtcggatccttcgtcgtcccagccgaggccgcggcgcccccgcagttcgatgcgccatactcagataggagcacgatcggtgctcacgagggtccggggggccaccgtcgagcaacgactggagagcacacagctaaccgccgatcacgactctcgagctcatcggtccgccggctgggatctgtgaggcccgtgcgagccgctgccggcgtcgccgcccatggtctcgcgaagcccgtctcgagtccgcagctgtcacctcgcagcgcgagcctcagctcgtgcgcaccaggtactcgagcctgggccgtggctggtgcgtgtctcggtgtcggcgaagtgccaacattgagccttgtgttgcggagggagtgggattcgaacccacggggctcgtggcccaaagcatttcaagtgcttcgcattcgtccgctctgccatccctcctcgaggacgcgagcctagtccggcgagtgcaggctccgcgggaggctcgggtcgagcggaaccggcggtggcgatggtgccgcctcttcgcggtggcgggggcgtgcactggcgaacgagccgagcagcttcgctcgtacgccgctcgcggcgaggtcgtcgagtgcactcgccaccgctggatcggtgacgtgaccctcgagctcgatgacgaacaggtaggcgccgaggctggttcgggttgggcgcgattcgagtttggtgaggttgatgccgcgagcagcgaaggcgctgagcagcgcgagcagtgagcctggtcggtcggtgacctgaaagcacgccagagcggtgcgatccgatccggtgggttccgggagcctgcccttggcgagcagccagaaacgcgtctcgttgcgcgggtcgtcctcgatgtccgacgcgagaacgtcgaggtgccagaggtgtgcggccgtcatcgttccgatggcagccgtggttggatcgttggcgtctgcgacggtgcgagctgcctcggcggtcgaggccaccgcgacgcgggtggctcccgggagcctcgtgcgcaggaacccgcgcgactgcgagagcgcttgggggtgagagaggacgcgggtgatgcgatcgagggaggacccgacgacgccgagcagctggtgatggaccgggaggatcgcctccgccaccgcaaggaggtcgaaacgatggaccagggcgtcgagcgtcgcgagcaccgctccctcgagcgcattctcgatcggcgagaaggcgaggtcgacgtcgccgtggtcgaccgcttcgaggacgtcctcgatggtggggtaggcgaccggctcgacgcgatctccgaaggaccgccggagtgcttcctcggtgaaggtcccggtcggccccaggtagctgacgcggtgggtgggcatggccggagcctaccgagtgggggtgaggtgcctcgccctaggctcggcgtgtgtgcagcccatgagtgaggacggtctcgtccgtagcgatgccggttggttcgacactgcacgccggaggcggatcggcctgccggaggccatctacgcaccgggcaaagccgagaccgacctcgtcgccctcatcgagcagagtctcgcctccggcgagccgaccatcgtcacacgcgtcgagcgcgagctggccgagcggctcgtcgaccggttcgaccttcgcccgtatcccgcgctcgaacgtcgtgcacccatggtggcgctcgccggcaatccggtgccgtcgtcgtcgctcgaacgcgtcgggctggtcgggattcttgcggcggggacctcggatcgcccggtcgctgccgaggccgcgtgtgtcatcgagacgctcggccacaggacccgcttcgtgctcgactgcggcgtggctgcgctcgcgcgatcggtgcgcgccatggaggaggtggccgacgcggacgtcgtcgtggtcgtcgctggtttcgagggtgcgctggccagcgtggtcggcggttcgatggcccaaccgctcattgcggtgccgacctcgaccgggtacggggcagcccgtggcggtgagaccgcgttgtgggccatgctcgcgacgtgtgcccaaggggtctgcgtggtgggggtcgacaacggattcggcgccgggtgcgctgcggtgcgcatcgtcggtgcggctgggcgcaacgcatgagtcgacgtaccctcgtcgtcaatgctgcggcaggagtcgcgggcgacatgctcctcgccgcgctgctcgcgctcggagcatcgagagagcacgtggaacgagcacttcgaccggtcggtctcgacaccgccctcgagacctcgctcgtggaccgagcaggcattcgcgccacgcagctggtcgttggcgacgacatcgagcacacccccctcgacgaggctgggctgcgcgcagcctgtgaggcggccagcctcgggcctcgtggacgcgagctcctctcgcgcgcgctcgatctggtgctcctcggtgagcgcacggtccacggggggcatgggcacgctctgcacgaactggggtcgctcgataccgtcctcgacctcgtcgggacggcggccgcgttcgaggcgctcgacgtggatggggtgctcctcggccccgtcgccaccgggctcggggcggctccgatggcccatggggtctacccgatcccggcgccagcggtcgcggcgatcgccgccgcgacgggcctcgtggtcgaggtccgttccggtgcagaggccaccaccccgaccggcgctgcgctgctgggtgcgctcacgatggtgcgggtcgccgaagcgagcggggccgttgctgccgtcgcctacggcgccggtacccgcgatgacccggaccgggccaacgtgctccaagccctcctgctcgatgggagcgacgcggttgccgagcagatcggcgtcgtcgagacctggctcgacgacctgagcggtgaggacctcgggcgcatcgccgacgaggcgatcggccagggcgcgctcgatgcgtggttgcttcccggactcggcaagaagggtcgtccgggtttcgagctgcgtctcgtgtgcgcaccgtctgccctcgagagcctcgtggcctgggtgcaccgacggacccagagtccgggcgtgcgtcatcgtctccaagagcgcagcgtgctctccgcgtggttcgacgaggtcgaggtgcacggcgtgtcgtgtcgcatcaaggtgacgccggtgggggccaagtgcgaggacgacgacgcacgcgaacttgctgcggtgctcggggcatcggtggcgacggcccgtgcgttggcattggcgaggtggcgagagagcggtgtgtctcgatgaccgcgactggagggagcgacgtggcacttgacccgacgatcgcgagcttgctcgaacagctcgccgcaaccggagcgacgactccggtgtacgagctgtcgctggccgatgcgagggctggcctcgatctcgtcggcaccatcgggatcgcaaatcctcctgcggttgcccgagtcgagcagcggaccatcgacgctggcgaccacgccatcgcggcggagctggtttggggctctgaggcgccacgggctgccctgctcttcgtgcacggcggtgggttcgtcctcgggagtctgcgtggctacgggccgatggtccgccatctcgcggcctcgaccggcgcgttggtcgtgtccctcgactaccggctcgccccggagcaccgtttcccggcagcggtcgacgacacgctccatggtttgcggtggctcgcggccgagcgagatgcgctcggcgtctcggtgctcggtgtcgtgggggactcggcaggcggcaacctcgcggccgtggcgagcatcgccgcgccgtccgaggggatcgacctcgcgctcgccctcgagctctatcccgcgaccgatctcagcgaggacctcgcctcgctcgagcgcttcggcgagggttactacctcaccgccgaggaggctcggtggttcgcgtcccagtatctcggcgatgacgaacggctgctcgcagattggcgtgccaatcccatggccgccaccgacctcgacgacctgccactcacgatcgtcgcgaccgctggctacgaccccatcggtgacgcgggccgccgatgggcagctcgtctcgcagcgctcgagccgcgcggtagcgtgcccgacgacctggacgagcgtctgcgacaggcgggggtcgaggtctcgggctgggcccgcggtcgggtcatctcgctggactttcccacgctcgtccacggtttcgcatcgatagcccagctcgcaccggcggcgggggccgcgtgcgagctgagctatggcctggccgcctgggtgctcgaacgggcgtgagcggcgtcgggacgcctacccggagttcttctggacggtggcgatcgcattgatcgatcgcaggacgagggtgagatcatcggggttccgggaggaccgccacgcaccgagcgccgtcacctgcaacgggttcagctctgcgaggacgcggttgcgcacggtgagcgagtcggcgagcgtcggactccaggcgaggagtcggcgctgacccgtggcgcggagcgtctcggccacggtgcgctcgtactcctcctcgatcaccgcgaagatcgccgctgcggtcgtcggatcgtctgcgaggtcgaggtagcggcgggccaagcgcatgtcggccttggcgagcgcgatctggacgttgtcgagcatgccggcgacgaacggccacgaggcccgagcctcccggatggcgtggtcgccgtgcgcctcgcgtgctgtggcgagaccggtcccgatgccgaaccacgcgggcagcgtgtgccgtgactgggcccacgcgaagacccaggggattgcgcggatcgtggcaagtccggtatcggcctgatggcgccgggcgggtcgtgagccgatgcggagctgggtgagctccggaaagggcgtgaccgatcggaaataggcgtcgaaaccggcgctcgtggtcaaggcccgataggcgtgctcgctcgagcgtgccaccagttcggtgaccatgaccgcgcggtcggtgggtgcggtgtcgtcgtccgcgccgccgaaggctccgagcgcggtgagcaaggtcgcgctggcgcgatcggtcgtggcgtagcggtgcgagatggtctcgccctgctccgtgatgcggatggtgccgcgcagcgcagctcgcgggtgcgctcgggccacctgggcgatcggtccgccaccacgcccgacggtgccgccacggccgtggaagagttcgacggtgatggcgtggcgttctccgaggccgatgagcgcctcttgcgcccggtagagcgcgtacgcggacgccgccatgccaccgtccttggtcgagtcggagtagccgagcatgacctcttggcgcagcgcccgacgctcgaggtgggccaggtaggcggggagggtgaagagttgctccatgaccgactcgagacactcgaggtctgcgatggtctcgaagagcggggtgatgtccagatggtcggcgccgagcgcacgggcgatgacgaggaccgcaatgacgtcggcagcgtggtgggtcatcgagatcacgtaggagccgatggcggcgggcccgagctcggcctcgacggtggtcagggtgtcgaacagggcgacgaggtcggcaacgagcgtggtcctcggcgtgcgagcgtgtggcggatgatccaggcaggccagcagcatcgacaggcgatcgtccgcgtccgcctcccaatagccagccaggcgaggatcgtcgccaaagagttcgaggatcgcttggtggtggaccgtcgactcctgccggatgtcgagtgatgcgaggtgggtgccgaacgtcgcggcttgccacacgaggtcctggaggggcccctcagcaagcgcggtgtcgccgtgagcagccagcgagtcgcgtatgagtcggagcgcagtctcgaggtcggggccgaccaggggggcgatgtcgagcgcctctgggtcgttgtggagccgatggagctggttgtcgatacgcgcaagcaggtagtagatcttctgacggtagggctcgtcgacgtagtgggtgcgcacgtacggtgcgaggtggacgaagtcgtgctcgtcgttgcggatcgactccacgatcgcgtcggagacggcggcgaagtgcatggagtgcgtgagccgtcgcttgacggcgtcgagtcgcgagcggaacgcctcgaggcacgcggtcgcgttcgcgacgaaggcagccttggtgacctcggccgtgaccaacgggttcccatcgcgatcgccgccgatccacgaaccgaagcgcacggggacgccgatggcatctgcatcgaccccccgtgctgccgcgagctgtcggtacacgactgggatggcgtcgaacaggctggtggtgaggtagaagaggccggtgtgcacctcgtcggcgacctcgagtcgtcgggagcgcagctcctcggtgaaccacaacagacggaggtcggacgggtcgacggcgttcggcgcgtgcgcgatgcgctgcagggtgtgcaagatggtgcgccgcttggtctcggtcgggtgcgcggtgagcaccggagtgaggcggatccgtccgagactcctcggtgcgagcttggcgaggtccgtcacgtcgtcggcgccctcggcgacgttgaggacgttgaacacgacgttggcgaggcgcagaagctgctccgtgtcgttgcgatcgagcggctcgtgctcggggccatcaccgagcgcgaagcggagcgcggcgaccgcccgcggcgtggcgagcgcccacagcgcgtccagcgggagtgaccacaggtactcgttcgtgcgcgacagcgactgcctcctcgcgggccgtggcgaccagtgcgcccgggcggcgagtgcgccgcccgggcccgagcggaggaggtgggattcgaacccacggtgggttgccccacacgcgacttccaatcgcgccgattcggccgctctcgcacccctccgtgcccgtctcggtgcacccaaggttcgggctgctacgctagcctacggtctacatcgcgcccgggccgccggcgtgggcgcggaagccgggccccacgcggcgggtccccgtgaaccgggtcagggccgggaggcagcagccctcagcggagcgattcgggtgccgtggccagcctggcttccgcgcaacgccggcggcctcgtaggcctgtccggggctgaagctaggatgccaccgtggccgagccttaccagtcgctgtatcggcgctttcgaccgcggcgcttcggcgaggtccgaggtcaggagcgcgtcaccgagaccttgaggcgcgcggtggccgaggggcatgtctcgcacgcctacctcttctcgggcccgcggggaaccgggaagacctcgactgctcgtatcctcgcgatggcgctcaactgcgaggcgcccgtcgatggtgagccgtgtctcgcctgcgcgtcgtgcgaggccgtcgtgcgcggcagctccgcggacgtcgaggagctcgatgcagcgtcgaactccggtgtggactccattcgatggatcacccagaccgttgcggctgcgccggtcgggcggtggcgcgtctacatcgtcgacgaggtccacatgctctcgcaggcagcgtcgaacgccttgttgaagacgctcgaggaaccgccggcgcacgtcgtgttcatcctcgcgacgaccaacccggccaaggtgctcgcaaccgtgcgctcgaggacgcagcacttcgcctttcgcctgctcgacgacgcatcggtcgatgcgttggtcgccgaggtcctggaggcgctcggcgccagcttgtccgacgaggcgctggcctacgtgcgtcggcggggcggaggatctgcgcgtgacacgctctcggttcttgagcaggtcctcgcgctcggaggcgtggtgaacgacgcggccgacggcgccgtcgcgctcgcacaggcgatcgcagacggtgacctcgcgtccgcggtgcgcatcgcgagcgatgccttcgagggcggcatcgacccgacagaactcgtcgccgacaccgtgggcgatctcggtcgacggttcgtggccgaggcgctggccggtgcgcgaggggcggagctcgctcggctctcgcggccgctcgagaccctcggacgcttgggggcgggcctgcgcgatgcgttggacccacaggtggtcgtgctcgcagggctcgccgaggcgctggcgccggacgcgaggctcagcgcgctcgaggctcgcgtggccgcgctcgaggccgacctcgcaggagccggtcacatgccgagacccaagccaccgaccggcgagccactgccggcccggaccacgagccccgagcccgccgggcactcggcgtcgccaaacgttgcggagcctgagaccagccagccagagacccgggagcgagcgtcccgcgcaccagcgcgcggactccaagatgctcggcgtggtggcgacgagcatcctggtgcgtccaccgagcagcggccctcgtcgctcgatcgcgtgcgtgctgccttcgcgaggaatcagcagcgggccgatgtcgaccgtggcgagccatccgagcccgtcgcgaccaccccggcccctcatggagacgatgaccagcccgcggcggcccccgacgcgcacggctccccggtgccgagcgggctcgctgacgaagcaacgcgagccgctgggcccgcgtcgctcgaggcccgtcggcagcgactgcaggcacgctggttcgacgacgtgatggccaaggcgccccgggtcctgcgtccgctcctcgcgcacgctcgtctcgcgatccgagacgagcgcatcgtggtggcggtcgacaaccgaacggttgccgagcggctcgtcccccatctcgccgagatcgtcgcgctcgtcggcccggacgagtttgccgagccgcccgagatcgtcgtcgaccctggatcgagtcagacgtcgtcccgggcgcccgctgcgagcgtcgacgatcgcgatccaggcgacgaggacggcgtcgatctcaccgacgccccctcgtccgatgcgacccccgtgcgcgacctcagcgagtcggtgatcgaggccaacgtccgcagcatcttcgaggatgctcgacggctcccatgaactcactgcctccaacgctggacgcgctcatcgaggagctcggtcgattgcctggcatcggtccgaagtcggcgcaacgcatcgcgctggcgctcatcgtgcgcggcccggccgctgcgcaccggctcgcagacgtcctcgtcaccgcgaccgagcggctcggtcgttgtgaccgctgcggggcgctcgcagagggggcgcgctgcccgatctgcgacgatccggcccgagatccgcgcatcgtcctcgtcgtcgagggcgatcgcgacgtgtgggccttcgagcgggcgcgacgtttccgagggacctaccacgtcctcggcggcgtgatcagccccatggacggcgtcggacctgatgatctcgccatcggccggctcatcgctcgcgtcgaggccgagccgatcgaggaggtcgtggtcgcgacctcgccgaccgtggagggcgagacgacggcgacctacctcgccagagtgctggccgggcgcgtcggtgtctcgcgtcttgcgaccggcgtgcccgtcggcggcgagctggagtacgtcgacgagctgaccttggcgcgcgcgctcgagggccgacggcccttcgacgacgcggggccgcgccgctagtcagtcggttgcaggcggttcttcgacgaactcgatcaggacgccaccggtggagcggggatggacgaaggcaaccgtcgtgccgcgcgatcctcggcggggtacctcgtcgatcgggtcgaagccctgacgtcgagcctcctcgagggcgtcgcgacacgattgcactcggagggcgaggtggtggatgccgggccctcgacgggcgagaaagcgagcgaccggcgagtcctcgcgggtcggagcaaccagctgaatgaagctcggcccgaccgcgagcatgacctcctcgatgccgtcggagtcgacgtgctcgcggtgggcgagtcgtgccccgagcgcctcccaccgggcgatcgccgcgtcgaggtcgtcgaccgcgatgccgacgtggtcgatctcaggctcgtccatcgtcgcctccgcgctgttcgggtgccgtcgtttgctcggccgcaaagcgcgcgaagagtgcgatgcggtcttcgccgatcgcggtgcgtgcctcggggtcgtcgatgccgagccccggcgtgggcgagaggcagaggatcccgaccttgccttcgtgacggttctggcggaccgtgcgaaccgcttcggcgacctcctcgagcgggtacgtggccgacaggaccggttggatgcgtccacgctcgatgagtcgattggcttcccacgcctcgcgatagttcgcgaagtggctgcccttgatggtcttcagcttcatccacaggtggcggttgtcgtaggagatccaatgtccgctcgtggcagcgcacgtcacgatcgtgccgccgcgcttggcgacgtagacggacgcccccatggtcgcgcggcccgggtgctcgaagacgatgtcagggtcttcgcccacgaggtcacgtatgtcttggccgaagcgtcgccactccgtttcgtcctgcgtgtcgtcgtcgcgccagaactggtagttccgctcggaacgatcgatgacgtactcgcagcccatgcgtcggagcagcgctgccttgcgcggcgaggagaccaccccgacggggatgcctccgccgttcaggacgtactggacgccgtaggagccgatcccaccggtcgcgccccagatcagcaccacctgtccttgacgcatctgggcaccgttgggcgagacgagcatgcggtaggcggtcgagttggtgaggggattgacggccgcctcttcccagctgagatggcggggcttcggcatgagctgattggctcgcacgatggtgaactccgccaagccgccgaagttggtctcgtaaccccagatgcgctgctcgctggcgagcatcgagtcgtcgtgggcgctcgggtcttggtcgtcgaccgcgttgcagtgcacgaccacacggtcaccgatctgccagcggcgtaccgcgggtccggtgcgaacgatgacaccggcagcgtccgatccgatcacgtggtagggcaggttgtggcgctggtcgagcggccgcggtgagcgtccgagtcgggcgaggaactgaaacgtcggcaccggttcgaagagcgccgaccagatcgtgttgtagttgatcgagctcgccatcaccgcgacgagcacttcgtccggcccgagctcgggcatggggacatctccgatgtgcaaggtggtgccggggtcgcgtacggcaggatcgaggtgggcaacacgctcgatgtcggactgctggacgtagcaggcccggtagtggtccgggaccggtgtcgccgccaactcggcgggatccgcgccagcgagcacagcctcggtgaggaacgacggcatgctctgacgttagccgctggcgacctcggcgtgtgggcagcccatctcgacgctgcgacgccggtgttctagactcgcgaggtcacaaccgtgtgctcgtgctggcgccaccaggtcaggcactcggaaggttggaggaggtcgtatgtcgaggtcggtcattgtctcgtacgctcgcacaccgatcggcaagctccagggtgcgttggcgtcgctgtcggcgatggagctcggtggtcgcgccatcgcgggcgcgctcgagcgagcgggagtcgccccggactcggtggactatgtcttcatgggccacgtgctccaggcgggccaaggccagatcaccgcgcgtcaggcggcggtggccgccaacattcccatgaccgttcccgccaccacggtgaacaaggtctgcttgtcgggcttgaacgcagtgttcctcgccgatctcctcctcgcccaaggacgcaccagtgtcgtggtggcgggcggcatggagtccatgtcgcgggcgccctacgtgctccccggcgcgcgaggcgggctgcgcatgggcgacgcggccctcatcgactcgatgctctacgacgggctcttctgtgcgttcgatcgcatggcgatgggtgcctcgaccgaacactactgccgggtggatcatccggtgtctcgcgatcgccaggatgcctttgcggcacgttcgcacgaactcgctgctcgagcggcgaaggagggccgtctcgccgacgagatcgtgccggtcacggttgcggggcgccgaggcgaggtgcacgtggtcgaggacgacgagggcatccgtcccgagaccacggtcgagacgttggcccgtctgcgtccggcctttgccgaggacggcaccatcaccgctggtaatgcgtcgcagatctccgacggcgctgccgcgctcgtcgtcatgcgggccgaggaggcagagcgacggggcctgacccctctcggagagatcctcggttatgggcaggttgccggtcctgacgcgtcgttgctgcaccaaccctcgaacgccatccgtgctgccgcgagcgacgccggcctcgacccggcctcactggacctcgtcgagatcaacgaggcgttcgccgcggtcgcgctcgcgtccatggacgatctcggtatcgatcccgcgcgtgtcaacgtcaatgggggcgcgatcgcgctcggccaccccatcggggcctctggtgcgcggatcctcggctcgctcctgctcgagctccgtcgtcgtggtggcggtgtcggcgcggccgccctgtgcggcggaggaggccagggggatgcgatgatcgtgcgcgtgccccgcaccgagtcctgactcaagccgccagaggggcggtcgatgacctcctcgggaggtcccgcatgcgtatcttcgtcgagggggcaacggcccacgacaactcctacggcatcgtgaacctgcgccttgccgaggcgctgcgcgctcgtggtcatgcggtgtacgtgcgcccgtgggaccaatcgttgcggggagctggcacgagcgcacgtgagctcgacatcgagcccttcgatctcggcgtcggccacgccgacgtctgggtgcgacaggtgtggccgccgtcgttcgagcgtcccgacgccgagcgcgccttcgtcatccaacccttcgagcttggcgcggtgccggcgaggtgggtcgtcgaggcaggtcagctcgatggcatcctcgtcccctcactctttgccaagcaaacctggctccaaggcggggcggatcatcgccacctctgggtcgttccgaacggcgtcgtcgtacctgccctcgtcgagtcctcagaaccgaacggtgatcgcctgacggtgggctacgtgggcggcgccatctggcgcaagggtatcgacatcctcatcgctggtctcgacctcctcgatgacgccacgctgcaacggatcgagctcatcgtcaaggtcgcaggtcatgacacctactacgccggccagtcgttgctcgagcgcgagctgctcgcccatcctcgtgtcgccgctcggacggagatcattcgcgcgagcctgtcgcaggcgcggctcgatgccctctaccaacgcttcgacgtgctcgcggctccctaccgtgccgaggggttcgcgctgccgatcctcgaggcgatggctcacggggtcgtcccgatcgtgccggacgccgggcctgcgccagagttcgtcgaccggagctgtggcgtgttgctcgcgagtcgccccctcatggtcggtggccctgccgatgagttcctcggtccggcgctcggaccacggtgggccatcgaggtggacccctgtgacgtcggctccgctgtggccgcgctgctggaggaccccggcgcccgggctgggcgtgcgcgagctgggcaggagcgagcccgggcctggagctgggatcgcgccgcaagcatcctcgaagacgtcgtgagggcgctggacgccgacgaggcacccaccgatgcgtcgtctcgactcctcctccgtgcgacacggggtggtccgcaggcgatcggtgcgctcgtcgagctgggtgacctccacggcgcccgcgagctcgctgcggtgaccccaggcgccgaggcggtgcgagcgagactggaggggctcgcggccactcgcccggacgtgtggtggggtgcgcgccatcgcgcgccgatccccgctcgggccgaagcacggtcgtcgtggcacgccggcgaaggcgacctcgccatcgtgacgcgtgtcgcgcgctacctcgctccactgcttgcgatcggaggcggtcgcgtcctcgacgtcgggagcggccatggcgcgatgctcggtcagctccggtcgctcggggttcgtgcacttgggatcgaactcgatccagcgagagtggagcacctgcgtgcgagtgggttcgacgtcctcgagggcgatgcgctcgaggtgctcggcaccttggagacggggagcttcggcggagccttcgtgggccacctcgtcgagcacttcgcgccccaggaggtcgtcacgttgctcgccgagctcgctcgtgtcgttcgcacgggtggcgtcgtggtgatccagaccccggatccgcaggcagagggagtcatgcagcagacgttctggctggatccgacgcacgtgcgcccgtatccggcgatgacgatcgccgcgatggcggccgaggccggttttgccactgttggggcactcgagcgatcgctcgcaccgctcgtcaccgacacgctcgtcgtgctgcgtcgtcgtgccgatgcgcccgtcatcgcgcctcggagggtggcagcggtggcgccggcggtggtcgtggtggccgaccctcacagtggattccggcgagccagcgacgcgctcctcggcgagctcaatgcgatgggcgtgggcgtgcgggcagagcccctcgtggggccgcggtcggaccgcgtgttcatgcacgatctcccgattggttcgttggccagcggcctcgtgggtacggcgctcgttgcgcgtaccgcgtgggaggcgaggggcctgccacgagagctgcgccgtacgctcgcgcgctatcgccgcatcctcacctactcacactggagccgcgacgtgttcgtcgaggccgggctcgcgcccgaccaggtcggcgtctgggcgccgaaggtggccctggacctcgatccagcgtcagtgcgagccctgcgaggttcgagggagccctcggggcgcgtcctggcggtcgccgagtggggcgctcgcaagaacatcgaggccctggtgcgcgggttcgtcagggctcgtggtcgtgtcggccagggttcgctcgtcgtgaagctacgacggatcgaggccgagagcgcggcgcgctggctcgagcggatcgtgagcgaggagcggggtgaattggcggcgatctcgctcgtcaccgacgacctggcgcctgcggcgctgcgccagctctatctcgatgccgacctctactgcatgccgacgcgtggcgaaggcttcggcctccccttcctcgaggcgatgagctacgggtgcgccgtcatcgcgccggccgacggcggtcaccgtgacgtggtcgatgcgtcgcaatggctcgttcccggtcgctacgagcctgcgcacgtcgatcccgcgtctggctacgccgatagcggggtcttccgaggagccgagtggttcgagatcgatcccgacgccttcgtcgaggttctcgccgaggcgctcagcgacccggacgcggtgcgctcgcgcgccttggctgcgctcgggctcgccgaggctgccgctcaggcctcgatcgacgagcacgagctgaacgtcgtgcgcgcgctctgggaggacgcggtcagctacgtggatgttcgatgatcgtgacgtgctcgatgaccgggacgcgctgtggccgaccctcgggagtgccgagcgcgtcgaggcgtgcgagcgtctgcgaaccgtcggtcatctgaccgaagaggctgtaggcgggcggcagtgcgacacccgagggtccggagacgatgaagaactgcgagccattcgtgttcggaccggcgttcgccatggcgagcgagccgatctggtaggcgcccgctggcgggagctcgtcgcggaagcggtaaccaggcccacccgcgccggacccggtgggatcgccaccttggacgacgaagccggggatgatgcggtggaacccgatcccgtcgaagtagtggtagcgggcgaggaagacgaagctgttgaccgtcgtcggcgcgcggtcggcgaagagctcgaagcggagctcgccttcgctcgtcaccatgagcgcctcgtaggatgcaccgtcggcgaggcagaagctcggcggcgcatcgaaccgctgtgtcttcgggctcgagccgtcgggctcgggacaagggtacgaacggtcacgacgtccgaacgccacgggggctcctttcttcgtgctcaccgcacgacgtgcggcacgtgccacacgctcgggtggactacgagctcgcgatgtgccagtggatcgacacgatccggtaggtgtgcttcggggggatgccgttgttctgggccgagccggcgtcgttgatggtggtgatgacgttgaggccgctcgtcacctggccgaagaccgagtagtcaggggggagctgctcgcctgcgggacccgacacgatgaagaactgcgagccgttcgtccctggcgccccggagttcgccatggcgagcgtgccgaagcggtacgagccggcaggagggttcttgtcggcgtaggcgaagcccggtgatccggtgtcggtgttcgtcgggctgccaccttggatgacgaagcccggaatcactcggaagaaggtcgtcccgtcgtagaagtgatacaggctgaggacgtagaaggcgttggcgctcttggggcccaggttcggctcgagtcggaaggtgaacgtgccggcggtcgtgtcgacggtggcggtgtaggtatcccctgcgacgaggcactccttggggtaggcgccaaagtgcgttcgcttgggtgcggacccgttcgggttgggacagccgttggcgaggaggcccttggcgggctttgcggtcgggcgcgtgagctcgtagatcagcgcgaggagggcgacgaggatgacgaggacgatgactcctcgtcggatgaggcgggtgcgacgctgacgggctgcgcgctcggcgcgcagtcgctcttggttggcccgaatacgggctcgcttggcgcttggcacctcggcaaggctagtcgccaaggcctcgggactggcgcgaccacaacgcgccgcgcgtgctcccgcctcgaggcgggaggtaagcggcgctctcatgctggtcggcgctgttactcgacgtagtggcactacctcgaacagcccctccttgcaggtatgacgctgacgagcgttggtgacgtgggcgagtacgtcggtcggagctaccggctctccccgagcccgcaccaggcagccagaatgaccacctgggcacatactcgccgtgccattcacaacctcgccatcgagcatcggcaactggcgtggtcaagagcgagggcgcaggtgacgtaccgcgaacaatgtcacgagctggctgaactgcgctcgtgcgtcgagtgggtggccgagccaccggcacaccttctccaacaagcacttcgtgacgtggatcgggcacaccagaactggtggcaaggacgcgcccgtaagccagccttcgagaggcgcggccaactccgcttccggccctcggcctccgatctccagatccgccacctcaaccgaaaatggtccgaagtgcgcctccccaagctggggtgggtccggttccgacgctcgcgctcactcgatggtgagcttgcctcggccacgttccgctgctcggtggcgtgtggcaggtgaacttcaccgtcctcgccacgacccaccgcgcgcccgtgaacgacggacccacggtgggcgtggacttcggtattgcctgcgccgcctacgtcgctggcgagtctgccccgaggatcatgcccccgacgctcaccccaggcgaagagcgtcggctccgtggcctggaacggcgtaaggctcgccagctcacctacgcgaagcgtcacaacggaggccggtactcgaaccgactccgtcggacgatccgtgagatcgcacgtctccgggctcgccaagcccggagacgccaggacttcacccacaagctcacgagcgacttggccaagaaccacagcctcgtcgccatcgaggacttgcgggtgacccacatgacgagctcggccaagggcacggtcgaggctcccggcaccagagtccgtcagaaagccggactcaaccggtccatcttggacatagctcctggcgagcggcgtcggcaactggactacaagtgcccgaagtacggctccctgctcgtggcggtgccaccggcaggcacgagccagacctgtcctgcatgcggggtccgagacccagcgagcaggccagggtgcgggagatcgttcgcatgcgtgcagtgtggtcataccgcacatgcggacgcggtggccgcacggaacatccttgatcgggccatcgccctcgttggtggtggtattgccgtggggcgcacggtggacagcgcgggcagggcttctggcccgagtcgccgccgcacggcggcaggcgtttccgcgaaggttcctcctgcggtaggagccacaggtgcgtgaacagcgcacccgaagcccccgccttcaggcggaggtggagtcacgagccgctagccttgggtgcccgtggccctgctcgtccagaagtttggcggaacctccgttggcgatgtcgatcgcatacgcggggtcgcagaccatgtcgcgcggacggtacaccgagggaacaaggtcgtcgtggtcgtctcggcgatgggcaagacgaccgacgacctcattcggctcgcgcacgaggcgacggacggccctgcgcccgcgcgcgagatggacatgctcctgaccgccggtgagcggatctccgcggccctcgtcgccatggccctgagcgacctcggcgtggaggccgagtcgttcaccggctcccaagccggcatcatcactgacaccgaccacacgcgcgcgaagatcctcgagatccgcccccatcgtctcctcgaggccatcgagtcccacatcgtgccggtcgtcgcgggattccagggcgtctcgacggagcgcgacgtcacgaccttgggcaggggtggttcggacacgaccgcggtggcgctcgcggctcggctcgacgccgacgtctgcgagatctacaccgacgtctcgggcgtgttcaccgccgatccgcgggtggttccgcgcgcgcgcaagattccccggatctcgttcgaggagatgctcgagctcgcggcctcgggagggcgggtcctggcgttgcgctcggtggaggccgcgcggaacttccgggtcccgctccacgttcggtcgagcttcacgtgggagccggggacgtgggttgtggaggaggagccatcgatggaacaggccgtggtgtccgccatcgcgcacgacgcgagcgaggtcaaggtgaccgtggtcggtgtcccggatcaccccggggttgccgcccgtctgttccgccacgttgcggagcaaggcgtcaacgtcgacatgatcgtccagaacgtctcgctccaggggcacaccgatatctcgttcaccgccccgaaggccgatcgcgctcgcgcactcgaggcgacccgtgctgctgccgcagaggtgggcgccgtcgacgtcatcctcgatgaagggatcgggcgcgtctcgctggtcggagccggcatgaagacacaccctggggtgacggcccgcatgttcgagaccctcgccgagaaggggatcaacatcgagatgatctcgacgtcggccatcaggatctcctgcgtggtgcgggccgaggtactcgaggacgcggtccaggcgttgcacgaggccttcgaactcgatcgtgaggtgcaccaatgaacgggctcgccctcggggtggtcggcgcgacgggccaggtcgggtcggtgatgcgtcggatcgtgctcgagcgcggtctgccgattgcgtccgtgcggttcttcgcctcgtctcggtcggcagggacgcagctcgacttcgatggcacctcggtcgaggtcgaggacgttgcgacggcggacccgagcggcctggacgtggcgttgttctcgatcggggcttccgcggccgagcgctacgcgccgcgcttcgctgcgagcgggtgcgtggtcgtcgacaactcctcggcatttcgtatggacccagcggtaccgctcgtggtggccgaggtgaatcccgaggcgatcgaggcgatgccgaagcggatcgtggcgaacccgaactgcacgacgatggtcgcggtcggggcgctcgcggcgatccgtcgcgtcgcgggccttcggcgcgtcatcgcgtccacctaccaggcggcttcgggtgccgggcgcacgggggtggccgaactcgccgcacagctgtcgcgccccggcctcgaggcgctcaccttcgacgggaaggccgtcgacttcgggacgccagcggtcttccccgcacccctcggggccaacgtcgtacccctcgcggggtcgttggtgggcgacgacacgaccgaggagcgcaagttcgtcaacgagagccgcaagatcctcggcatggaggacctgcgcgtgggcgcgacctgcgtgcgcgtgccggtctttaccgggcacgcagtgagcgtggtcgccgagtgcgagcggcccgtcgaccttgccgcggtgcgtgctgccctcgaggcggctccagggctccagctcgcggacctcccgacgccgctcgacgcggcaggtcgcgacgaggtgctcgtgggtcgggtgcgcgccagcgacgtcgtcgacaacggcgtcgcgttcttcgtcgcgggagacaacctgcgcaagggtgccgcgctgaacgcggtccagctcgctgagctcgtcatcgagcgcggcctggtcggctgagcaatcctcgcgagcgctcagagaagctactcaagttcgagatcctcgtcgtcgatgccttgaatgcgcatcacggaaccaccgtggagcgtctatggacagcgggcattcaaggaggatccatgtccctctcggtcaacacgaacctctcggcgattcaggcctacaacaacctgaatgcgacgtcgaaccagatgcagaccacgatcaatcagctgtcgtcaggtctgcagatccagacggctgcggacaacgctgcgggctacgtgatctcgcaggggctgcagacccaagcgaacggcctcggtgtcgcgatcaacaatggccaggacgccatcagcgtgctgcagatcgcctctggtgcgatgaaccagcagatctcgatcctgcagaccatgaaccagctggccacgcaggctgcgaacggcggcgcgaacaactccaactcgctgagcgcggatcagcaggagttcgcggcactccagagccagctcgaccagattgcgaactccacgagcttcggtggcacgaacctcctgaacgggagctactcgaacgaggtgttccagatcggggcctacgcgagctcggtcgaccaggtctcggtcaccatcgcgaccttgaacaccacctcgctcgggatcgcgtcctcgacggtgtcgatcggcacggtgtcggcggcgatcagcgccatggctgcggtgcagtcggccatcctcgcggtggcgagtgccgaggcggtggtcggtgctgcgcagaaccaggtccaagcgatcatcgcgaacgacacggtcgctcagcagaacgtgcagtcggcgaactccacgctggtcgacaccaacatggcgcaagcgatgaccgcgttctcgtcgcagcaggtcctcatgcaggccggcgtcgcgatgctgtcgcaggcacaggcgctgccgcagctcatcctcaagctcctcccgtagcacatccgatcatccccggtcgttcgtcacgggcccaggccgtcggggcctgggcccgtgatcgtgcgatcaggactccgaaggaggccccatgtcgtcgatcctgccaacctcatcgacgagctcgacgtcgtcgacgtcgagtggctccaacgtctcgacctactccgacccgggcggtcccccgatcacgttctccagcctgttctccggtatcaacacccaggcgatcatccaggcgctcatggccgcctacgagcaaccccaggtcgatctcgccaagcagatccagtcgctccagacgaacctgtcggactaccagaccatcgtctcggacctcagttcgctccagacccaagcgaacgctctgctccagccgtcacagctctcctcgatgagcgcgagtacctccgacgctgccgtggccacagcaaccgcaggtcaaggcgccatcccgtcgtccttgacgttcaacgttaaccaactcgcccaggccaacatcctcgcctccagcggcaccgtgtcgtcgctgtcgtctcaggtcgcctccgggaacttcctcctctcctcgagcgcagcgggcgccggcgtcacctcgcttgctggctcctcgctccaggtcgggacgcactccttctccgtgacgagcgcgctctcgggcgccaccgcgacggggacgtcccctcttgcctcgtcgatcaccatcggctcgtccaacgacaccatcgccgctaccgtcaacggcaccgccgagacgttcaccatcgcctcggggacctacacgccagctcagctcgccgccgcgatctcgcaggcgagttcggtctcgggaacccccttgctgcaggcgcaggtgaacgcccagggccagctcgaactcggcacgacgctgctcggttcgagtgcatcgctccagatcaccggtggtaccgcactgtcgacgttgggactcgcggcccaagcgagtgcgtccgtcgggaccgcggggtcggtcacactcgatggcaccgtcaccgccgtgaacaacgtccaagcgggtcagacggtcagccttgccgacggcaccggggggtcgatcacgatcggtatcggatcgttcggcctcagccagggcagcttcaccgctaccgaggtggcggccggcaacgggtcgctctcgcaggtggtgagcaacatcaatgccgctggcgccggtgtgacggcatcagcggtccaagtctcgagtggtacctacgtgctccagctggtctcgaaccaaacgggcaccgcatcggccatcaccgtcgaacaggcgcccttccagagtgccctcggtagcttcacgaccattgcagcggcacagaatgcccaggtccagatcggtggccagagtggttacctggtgagttctcagacgaaccaggtccagggcgtgttgcccggagtcacgctcaacttggtgtcggcgcagcctcccggctcggcgccggtcaccgtgagcgtcacccccgacggcaagacgctcgcctcgtccatccagtcgctcgtcaacgccgcaaaccaggtgctcagcgacatcaacacgtacgcgggctacaacgagcagaccaacaccggcggaccgctgatgggcgactcgacgctgaacgggatcacgagccaggtgctcggtgtcatcgctcagaccctcggcgaggggggcatcaccgccgcccaagccggcatcacgctgaacaagaacggtaccatcagcttcgacgcgcaaaccttcgcccagctctacgaccagaacccgaccgccgtcacgtcactattcgcccagtcgggcaccttcaacccatcgagttcgacctacgcaggcgacgtcagtctggtctacgcgggtgatggcacgcaagcgggctcctaccaggtcgtggtgagccagtcggccacccaggcgacggacagcgggtccgtgctcgcgagcggaacgatcaccaacgccgagacgctcaccgtcgcccagggttcgcagtcggtgcagtacgcagcgagcgcgggcgagtcgctcagcgccatcgcccagggcctcaatgccgcgttcgcccaggcaggcatggggatgcaggcctccgtggtgagctcgtcgtcgggttcgcagatcgtgctcaccgcgagtgcgtacgggacccagggcgacttcacggtgacgacgacggcgacgggatctgggcagaccgggctcgcaacgagcgcgaacacgccggagtcgttcaccggcttgaacgtcgccgggacgatcaatggtgtggcggcgaccgggaacggtcaggtcctcgccgcgccgacgacggaccccacgctcgccggcttgtcgctgcaggtgagtgcgagcgggatcacgagtgcgacgaccattggctcgttcgtgtattcgccagggatctcgggccagctcgccctcatcgccaacggcgccacagcacccgtgaccgggagcctcgaggcgcgcatgagcggtatccagcaacagatctcgatgctgcagcaacagtacaacggctatacgccgatgatccagaacgagcagaagatgctcgagcaggagtactccgcgatggagtcacagctcggctcgctccagagcgtgggctcggagctcgccgggcagattgcacagctgccgtagcgcccgccggacgggtgctgtcgacgacgaccaaggagggagaccgggtgccttcactggctcaacgcgcctacgtcgagaacgcggtggaaaccgcgacgccggcccagcgcctgctcatcctgttggaccgcctggaagcgaatctggtggccctcggtgacgcctttcgggtgcgtgacctcgaggcgatccacgtcaacgccaaggctgcccaggcagcgttggcgttgttgcgaggggcgcttcgcgaggacgtgtgggagcacgccgcgacgatcgcgaccttgtacacgtgggcgctggagcgactcgtccgagccaatgtggacaaagatccggctccctacgaggaggcccgctcggtgctcgagccgctcatcgcggcgtggcgacacgctgcgatggaggtctcgcatgagtgagcgcgatccgtgggaggagtacctggacgcgtacgcggagcacctcgcgcgcgtctcggcgagcctcgaggcgggccgggtgctcgagacgccgttcgatcgtgcgcgtccttccagcgcgatgccggcgcgtcacgctgagcgagcacgcgccctcgtggaggcgaccgaacagctcgcggcccgcctcgagcatcgtcgcgacgtggtcgggaccgtacttcggtactcgagagtccgcgaccccgagcgggtggtgctcctcgacgtgatcttgtgaggatgccatcgcttcggtttgcgtgactcggccgatctcggggacctgctcagacgctccacggggctgcttcctcgcgtgagctgacgcgagaactcacgggaagggactcgacggtgatcacggtgacgggacccaccaagcgcttcggagaggtgaccgcggtcgacggattgtcgttcgaggtgccgcccgggcgcgtgaccggattcctcggcccgaacggcgcgggcaagtcgaccacgatgcacatgatcatgggcctcgaaaggcccagtgcggggtccgctctcatcaagggcgtcccctacgccgagcttgccgcgccactgcggcaggtcggtgcgttgctcgaggcgaggtcgttccatccggggcgcagcgccagagcgcatcttgggtggctcgcggcctccaatggcttgcccgcccacggggtcaacgaggtgctcgagatcaccggactcaccgacgtcgcttcccgacgggccggcaccttctcgctcggcatgggcagcgtctcggcgtcgcggctgcgctcctcggtgatcccgaagtgctcatcctcgacgagcccgtgaacggactcgatcccgaggggattgtgtggatccggaccttactgcggggacttgctgctgaaggtcgaacggtgttcgtctcgagtcacctcatgtccgagatggctcagacggccgaccatgtcatcgtcatcggccgtggcaagctccttgccgacaccgcgatggcagcgttcatcgcatcgagttcgtccgcgagaacgctcgtacgcacaccgagcccagatgcgctcgcgtcgaccctgcgcgagcgcggcggggtcgtggtcgtcggcgacgacgggagtctcaccgtccggcctcgtggcagccgagatcggcgagatcgccttcgagcacgggatctgtctccatgaactgtcgccccagagtgcctcgctggaggaggcgttcttcgctcttacgggcgaggacacgagctttcgcggccagccggccacggttcacgaaggagcctcacgatgacgacgacggtcgaccgtagtccgagcacgctcggcccgacgttcgggcgctgctcgccgccgagtggatcaagatcaagagcgtgcgctcgacggtgctcacgctggtgttcatggtggtgctcggggtcgggatctcggcgctcggcgcgctcgccgtgcacgcagccgtgtcgcaccaccgcatcggccccggcttcgatccggtcgcgcgctcgctcggcgggatgctcatcgcgcagatcgccatcggtgtcctcggcgtcttggtcttcagcgctgaggtcgcgagcgggacgatcagccagacgttcgccgcggtccccaagcgctggcacgtgctgctggccaaggtactcgtctacttcgtgatcgcgctcgttgcctccgaagtagtgtccgtggcgagcttcctcgtgggccaggccgtcatgcacggagtcgtcccgacgaccagcctcacgaacgcgacggcgatgcgggccgtcctgggcaccgggcttctcgtcgcgatcgtgggtgtccttgcgctcgccatcggtgtcatgatccgtcgtactgctggggcgatcaccaccttcgtgggcgagtacctggtgctgcccttgctcgtgaccgcgctcccgtcgccgtactccaccgacatcgaaaagttcctgccgttccaagcagcccaggtcatgatgtcctcgcagctcgtcgcgaacagcttgtccgcgtgggtcggcctcgccgtcgtggcgggctacgccgtgatcgccgtcgtcgtcgcagggtcgctcctctcgtcgcgcgacgcctagacgcccggccatcgcgccccgcgcgaggcctgcagcttgccgcccgtgccgccttccatggaggggacacgggcggtcgtgcgtcgcgggtgcggctcaagaacacgtaagtactgatttaaccaaatcacgaaaagctcgatgattcggtttagggaaaccgtcacccgtaccgctaccgtggtgcccatcgcgttggggatgtgaggaacacgccgctcattcgagcatgaccgcgtcgaccaccagagggtgcgaggccgcggaaaacagcggggcgttggtcgacggccgctccgagccatgacgagcgagcgcacgagaggcgtaccgacacgagagaggaaagaggatggctggcaatcgctacgaggctggcgtcaaggagtaccgtaagacgtactgggcgccggactacgtgcccttggactccgacctgctcgcggtgttcaagatcgtaccgcagcctggtgtcgaccgggaggaggcagctgcggcggtcgccgccgagtcatccaccggtacctggaccacggtctggaccgacctgctcacggacctcgattactacaagggccgcgcctaccggatcgaggacgtgcccggggacgacacggcgttctacgcgttcgtcgcctacccgatcgacctcttcgaagagggctcggtcgtcaacgtcttcacatcgctggtcgggaacgtgttcggcttcaaggcggtgcgatcgctgcgcctcgaggacgtgcgcttccccttggccttcgtcaacacctgcaacgggccaccccacgggatccaggtcgagcgcgacaagatgaacaagtacggccggccgctgctcggctgcaccatcaagccgaagctcggcctgtcggccaagaactacgggcgtgccgtctacgaagtgctgcgcggtggtctcgactttaccaaggacgacgagaacgtcaactcccagccgttcatgcgctggcgcgaccggttcctcttcgtcgccgaggccatccatcaggccgaggcggagacgggcgagcgcaagggccactacctgaacgtcacggcaccctcgccagaggagatgtacgaacgcgcagagttcgccaaggaactcggcatgcccatcatcatgcacgacttcttgacgggtggtttcacggccaacacggggctcgcgcgctggtgccggcgcaacggcatgctgctccacatccaccgggccatgcatgccgtgatcgaccgcaatccgtaccacggcatccacttccgtgtgctggccaaggccttgcgtctctcgggcggtgaccacctgcacaccggaacggtggtcggcaagctcgagggcgaccgagcggcgacgcagggatgggtggacctcctccgcgagtcctacatccccgaggaccgtagccgcggcatcttcttcgatcaggactggggctcgatgccgggcgtcttcgccgtcgcctcgggcggtatccacgtgtggcacatgccgtcgttgctcaccatcttcggcgatgacgcggtcttccagttcggtggcggcaccctgggtcacccatgggggaacgcacccggcgcgaccgcgaaccgggtcgcactcgaggcgtgcgtccaggcgcgcaacgagggccgtgacgtcgaacgggaggggaaggacattctccagaacgcggccaagcacagtccggagctccgtgtggcgatggagacctggaaagagatcaagttcgagttcgacacggtggacaagctcgacagcgtgcatcgctgagcgagcgtggttcgacgaggtggcgcagcgtgcgccacctggacctaaggagcacacatggctgacgttcaggagtatcgcacgtcacggcgctacgagctgttctcgtacctgccccagatgaccccggagcagattcgcaagcaggtgctgtacctgatctcgaagggctggaacccgagcgtggagcacgtcgagccccatcgctcgatggagcgcttctggtacatgtggaagctgccgatgttcggcgagcagtcggcggaggtggtgctcgccgagctcgaggagtgccgccgtgcctaccccgatcacctcgtgcggctcgtgggctacgacaactacacccagagccagggcatcgcgttcgtggtgtaccgaggccaggggtcctgagcggctggcgctcctcgacgccgggaccagcgcgacctcgcggttcgcgcgaggtcgcgcggtggggccgtgaggctgaggcatgcgaagcaaggagatggcgacggtgcgcgcgagcgacgcgagcgagtcgccaagtaggtcgaggtcgtggtggtgacgaagggagggccccgagtgagcgagtcgtccacagccggcggggcggtgcgttctggccgcgcgttggcgcagcagcgtcggcgtgagcaagcgcttcgtcgcgcgaacgcacgaacgtcgccgaggcacgacgcagacgatcgttcgcttcgggtcgcaccgatggcgactgacccggtcgaggcgcggccgacgaccaccgagggtggctcgtgcgggtgcgaccacctcgagccgcccgtctccgcggtcgcgacgtcaagtgaactctcggtctcggtgcgcgggtatgtctcggtggatgatgcgctgcgtggcctgcgcggccgtgaggccgccaaggtgcgtcgccagctcctgtgcgtgcaggggcgaggcgatctggcggcgtgccgtccgacgggccggatgcgccgtcgcgacacggtggcgcccaaggtggaagagggcacgacccttgccggcaccagggtgaccggtacgcaggtcgagctcacggcgaccatgacgggtgcggatgcgggcagctgccgggtgatcagcggcacacagtacgtgggcatcgagcagttcgaggagcgctgcgacgaggtcccggaggcgcccccggccaaggtcagcgtcggacgcacggcggcagggcgccgcgtgagcggcacctccctcgcgccgagccccagcgtgacgggctccgaggcaggtgcgtgccggcgtgtcaccggcgtggactacctggaggcgaacgcggtcgaggaggcgtgtggcgtcgtccccgagccggcgccagccaaggtgacggtgggcgagacggtccagggccagcgtgtcacgggcgtcgtggtcgatcgtccagctgcggtcaccggtgacgacgtcggccggcgccagcgcgtgacgggcagccagtaccagcaccctgagtggattcgaggcgagtcccgcaatggttcgtcggtgccgcacaaggtgagcgtcatgagcacggtgcggggtcggccggtcaccggaaccatcgtgacgcccgatcccaccatcaccggggccgatcgcggggcgtgcgtcgaggtgacggggacggagtacgaggacagcttggccaagtaccaggcgtgcaatcggcaaccggcacctggtccgcacaaggtgagtgtgatgcggacctggcgcggggaagtcgtgaccggaaccagcgtcgagcacgacccgcgggtcaccggtgacgaggccgggcagtgcgaggacgtgaccggcacgccctacgtgggaccaggccagtacgaggccgtctgcgcgaccgatccggttcgccagggcgctcctggtggatcgtcgatcgcgatctcgggaacgcgtgtcagtgggagcgatcgtgtgacgggggacgagcgtggccgttccgtcaccgtgagcgggactccgtaccagcgtgggccctctggcgatgccgagcgcggcgtgagcgcgtggggggcgacgttcagcatcaccacgccagcacgtgctgcgcgtgaacgggcgcgggcgcgcgtcaccggcaccggctaccagcgcggtacggctcggatcacggggccactcgacctcgccctcggtcttgtctcgggtacgccagagtttcgctatcacgccggctcggacgccgaacagcaggtgcccgctcgcgaggcggccgtcacgggagaggggcgcgaggagggctttgccatcaccggcgatgcctgggatcgttcggccaccatcaccgggacagaaggggcctccgcatggcgcaatccgacgttgcggggaacccctcgtcggcgcgagcaggtggccagaagcgccgaccagcgggcagcggcagctcgcgagctccccgccagcgcccgcatcaccggcagcaccggtggcgtgagcgaggggccggtcgtgacgttctcgggcgggtcgcgcggatgatcttcctccagatgaagcggacggtcccatgaacacgcgcaatcgccgggggcgctacggcgggccgactccgtcgcatggcccctacgggctgggtacggcgcaaggacgtctgtcgggccaggacgcgcatcgcgaccacggcgaagcggccggggtcagccgtcgctcgaggaacgcgcatccactcaccgatcacgccgccaacgagcgacttgctcgattcgaacgcctcgtgcgagggcggttcgacgcggtggtaccgacactgaaggcgatcggaacgcttgctccgaccgacgacctcgccgaacgtgctgcgtcgatggctcgggccgagctcggtgtggcgttgccggcagagctgttcgagtctgcctggatcacgggtctcgacatgcgccgcctgtacgcggtcacgatggcagagaccatccatgcggtcgcggccgagacgcatgcgttcgccggcaccgagtcggacaccatgaccggtttcctgctcgagtgcggcttccacgccgtcgacatctcgccctgctccgatgggcggctgaagggtgtcattcgctcgatcctgcgcctgccggacgacgccgtgcgcagtcgcaaggcctacgcgggcgccatgttcgacgtcgaagcgaacgttcgccggtggatcgagacggagctgctgcgctttcgcgaggggagtcccgtgccgccgtcggccgggacgcggtatctgaagatcgcggtctatcactggagcaggtcggatcccgattacgaggggtgcgcggcgcacggctccgaccagcgggccgccgccgcggcagcactgtcgcgcctccgcgagcttcgcgaagccgtcgagaacagcttcttctgcggcgcctccatcgatctgttgttgatcggcgtcgacacggacaccgatgccatccgcgttcacgtccccgatgcgctcggcgacatggacctcgatcgctacgtggacaacctcgatctctatcgccagaccatcgacgatgacgtgacgacggcgcgcatgcgcgtgcatcgcgccatcgaagctgcgagcgccgatcaccctggcgggccgccgcacgagggcatgcgacggctcattgcgacgctgctcatcaacaacctgtcgcagatcgactacgtccgatcgacctggggcgagcgctacccggacgtcggccacgccgaggccttcatcagcgtcggtgacggcttcgaggagttccaggttcgcaacctcgcctacttcgtcttcctccagacggtcgaggaggcggcgaccgacctcgacgtgggcatcgggctgttccagcgtcggcccgagcgccgtgggttgccgatcccgatcgcgatccactttcgctacgaccgtcgggtcccgggcagtcgggagcgagccatcgagcggtgcgtgcgcgtgcgctcggcgatccgagcgcgctatcgagatctgtgcgcggccgggctgctcgcgtgcgacatgagcatccaggagcgaaccttctcgagcccgatcgaggtgatcgaagcgccgagtgacggtccggcgaacgaggatccgctgcgcctcgagcagcgtacggggcgagaggggggcaggcgatgaaggtctaccaagtcgagaagacgctcgtgtccaccaatcgcatccccggtctcaagaatctcccgctgctcgtggtgcgcgagcgcaacggctcccagagcgtggcggtcgacgcggtcggctgcgtccctggcgactgggtcatctgcgtcagcggatcgggcagtcgggcggcgacgggagacaaggactatccgaccgacctcaccatcgtcggcatcatcgactactgggacgaggacggctagcgacgagctgccggtgcgatgcgtcggcagcaatggggcttcctgggcgtgcgagcgcacgaccagggcgcaagggcaggggccacaggcgtatgggcaaggggcccgagcaaggaggaacgatggcaacaggggtgagcggcatcgcgctcggcatgatcgagactcgcggtctcgtgccggcgatcgaggcagcggacgcgatgacgaaggcggcggaggtgcgcctcgtcggtcgtcagttcgtcggtggcggctacgtcacggtgttggttcggggtgagaccggcgcggtgaacgcagccgtgcgtgcgggtgcggacgcgtgcgagcgggtcggcgacggcctcgtggcggcacacatcatcgctcgggtgcactccgaggtggagaagatccttcctgacggcgaggacatggccgccggggcgtagggaagaggcgagaagggagcgttgacgatggcaacaggggtgagcggcatcgcgctcggcatgatcgagactcgcggtctcgtgccggcgatcgaggcagcggacgcgatgacgaaggcggcggaggtgcgcctcgtcggtcgtcagttcgtcggtggcggctacgtcacggtgttggttcggggtgagaccggcgcggtgaacgcagccgtgcgtgcgggtgcggacgcgtgcgagcgggtcggcgacggcctcgtggcggcacacatcatcgctcgggtgcactccgaggtggagaagatccttcctgacggcgaggacatgggcgctggggcgtagggaagaggcgagaagggagcgttgacgatggcaacaggggtgagcggcatcgcgctcggcatgatcgagactcgcggtctcgtgccggcgatcgaggcagcggacgcgatgacgaaggcggcggaggtgcgcctcgtcggtcgtcagttcgtcggtggcggctacgtcacggtgttggttcggggtgagaccggcgcggtgaacgcagccgtgcgtgcgggtgcggacgcgtgcgagcgggtcggcgacggcctcgtggcggcacacatcatcgctcgggtgcactccgaggtggagaagatccttcctgacggcgaggacatgggcgctggcagcgtggcggcgcgctaggcggtcgaggtgacccaggaccacaggctggccggctttgtcgtgcgcgcgttgcgtgcagagatcatcgcggtcgagcactacctcgcacaggcgagcctggtggaactgtggggctaccccgcgttggccgatcgcttctcgaacgatgcgcgtgacgaactcgatcaccagcaccggattctccggcacgcggtgtcggtgggcatcgcgccacgcgccatcgacctgccgccactacggtttggacggagcgtggaggagctcgtaatgatggaccgggcattcgagctcgacgtcgttcgactctacggcgaggcggtcgactactgcgggcggatgggcccggcctcgagtctcgagctcttcgccgggctctacggggaggaggtcgagcacctggcgtcgatcgacgccctgatcgttgagatccgatccgagaggagggggcgggatcgtggctgaggccgccgcgccacgatcctggcgcttcgtgttcgacgactacgcaaccctgcggcgcttcctcgatgagctcgcgtcgatcttcgaggagcatgggtactaccccaaccagagcttccatcgcgccgacgtcaccatcaccatcgatcccgcgagtgccaacggcaacgaccagggcgttcgggcggtcgaagccgctctcgatgcgttcgtggcccgtggggtggggcaggcagatgaccagcggtcctgacgcgagtgattcgagcctcgtggtcgcggtggtgaacgccaagggcggatcgggcaagacgacgctcgcgctgcacgtgggcgtcggtcttgcgaggcgcggccccacgctcctcgtcgatgcggatccgcagcggtcgctgaccttctggacggcgatggcacctcctcgagctgcgttgccaccggtagcggaggcctcgcgggacgtggtgaccgtgctgcgcgctgcgcgggcggactaccgctacgtcgtggtcgactgtccaccgacgccgatccgaggcaccgtgcgtgccatcgtcgaggtcgccgatcgtgtggtggtcccgatcctcgcatctccggtcgatctgtggacgagtgcggagacgttctggtcgttgcgcaggctcgcgactggggaccgtgcgcgtcggttcgtcggtgtgctcaatcaggtcgagccgcggagcgcgctgtcggcgtccgttcggcgcgcggcgctcgcactcgatgtgccgctcaccgccgtcgcgctgggccggcgtgtcgtctaccgacaggcggcggccgaggggcggagcgtgtacgcgatgggcaagcgagcgatggcagcgatcgaggagatcgaggccctcatccaggaggtggtgtgatggcagaggacttgagtgatcgcttggtgcgggaggtgagccaggtccgtgcgatccgagccaagcagacaagcgcgtcgaagggggcaagcgtcgccggctcagaaccgacggcgcgagccaccgaacctgccaagccccgacccagacggcgtgcctcctcgactgtcgagcgcgaggtcacgcctccggccgacggcgaggccgtcgaacaaccggtggcgcgccctcggacgagacgtcctccacttgccgtgtggcctgactgatgcggatcgcggggcggtgctcgtgacggtcgggccgacactgtctcaccgaggagcaccgtttcaccgagcaataccgtctcgccgaggaaaggagtgagtcgtggtcgcaccccaagttgcgccctacgtcatcgacacggagccctactaccgaccggtcgcgaacgagatcgcgctcttcgaagccgcgtactcggtgcggatgcccgtcatgttgaagggcccgaccgggtcgggcaagacgcgcttcgtcgagtacatggcctggcgccttggcaagccgctcatcaccgtcgcgtgcaacgaggacatgacggcctcggacctcgtcggacgcttcttgctcgacgccggtggcacccggtggcaggacggaccgctcacgatcgcggcccgctacggggcgctgtgctacctcgacgagatcgtcgaggcgcgccaggacacgaccgtggtcatccacccgctcaccgacgctcgccgagtcctgccgctcgacaagaagggcgagctggtccaggctcaccctgacttccaggtggtgatctcctacaaccctggctaccagagtgtcatgaaggacctgaagcagtcgacgaagcagcggttcggcgccttggacttcacctatccacccgcggccatcgagacggagatcgtcgcccacgagagcggggtcggccacgacgatgcgagtcgcctcgtctccatcgccgagcgcgcgcgcaacctcaagggacacgggctcgacgagggcatctcgacccgcatgctgatctacgcggccagtctgatcgcccagggcgtcgatcgcatcgccgcatgcgagatggcgctcgtgtcgccgatcaccgacgaccccgacatgcgtgacgcgctcgaggcggcggtcacgacctacttctaggagggccctcccgtggccatcgagctcgagcgctaccaggggctcctcgactctctcggctcgcaagccgaggaggtgctgcgtgctgcctgggacgaagcgacgcgctccttcagcccacgcggcctcgaggaggtctacctccgctcggccgcgagcctcgcggcgctcgggcgtgggagcgacctcgtggtctcgttcctgcagcatgcccccgcgctggcgcgtgagctcggcgaggacgccgtgcgggatctggtcgcggcctcggtggcgttcttctcgaagaccagcgccagcgtgatcgcggagctgatcgcgacgagccctcgggcggccgagcgcctcggggacctggaactgttccgctcgtacctcgggctcatcgaccagctcctcgggctggccccccgtggcgttcgcggcctcctcgaccacctcgacgtcctgcttgcgcagctgaccctgagcgggttgacgcgctgggccctctggggtgcccaagtccacaaggtcgacttcgaggcccagcagcgctacttcgcactcgagagccccgatgcgctcgccatgctccagcagcagcgtcggggactgctgttcgtcgacgtccagcgtcgcttgcaggcctacctgcgcgccctgtggggccgcgacttcttccttcgacccgagtcggccgatccgcagacggccgcggtggtacgaccgttcatcgatggattcgtcgtccacctccccgacgcctacgacgacacggacggggtcggtgggccgatcagcgcgctcgagcagtaccgtgccgcggcggcgcacgccgctgcgcaccaggtggcgaccacacacgccgtggctcgagccgagcgatcgcgtctcgaggaactcgtcgtcgggatcctcgaggatgcacgcgtcgagcgcgcagcgatcgcggccttcccagggctcgccgcgctctgggcgcgcttccacgtcgtcgatctcgccgccgacgacccctcctcgctcgtcgcgcggctcgttcgctctctcctcgtcggctgcgataccgaggctcatccgtgggtccgtgaggcgtgcgagcacgctcgggtgctcgacgagttgggcggtgccgaggcagcggcagctctcccggagcttgctcgaaccctcatcgacgccgcacgccgcttcggtgtcgagctcgaccaggtcgactcgcgagccgtcctgccgagctaccgcgacgacaatcgctacgtcttcgagcgcgacgaagccattcgcgcccaggccgccaacctcgatctcgcgccctcgcaggtgcgcaagtacgtgagcgtgatggagatgatcaacgaggtggacgtgccgagcgccggcgacgacgccgaggagatctgggtgctcgcgaccgagttcttccgtgacggcgaggccgagagcgtcaacgcccaagagggtcgggagccgccgcccgtcgaggtgcactatcccgagtgggactaccaggtccaactggagcgaccgagctggacgaccgtgctcgagcgacgaggacccttgggcagcctggaggaggccgaggcgatcctcgccaagcatcgccccttgctcgggcggatgcggcgcatcatggaggcgctcgcccccgagggtgtccagcgcctgcgcaagcaggaagagggcgaggaactcgacatcaacgcggcggtcgatttcgcagtcgacctgcgacgggccgaggagcccgacctcagggtgatggtgaggacacggcgcatcgtccgtgaccttgccttcttgctgctcatcgacacgtccgagtcgacgaacgatcaggtgctcggcgcggacgtgacggtgatcgagctcgctcgagaggcgaccttgttgctcgcagaatcgatcaatcgggtcggggatccgttcgcggtccacgggttcgactccaacggtcgccatgccgtcgagtacgttcgctacaaggacttcgatgagcgcttcggcgacgaggcgcgcgctcgtgtggccggcatgaccggccaactgtcgacgaggatgggcgcggcgattcggcatgcgggtgcccatctcgcacgccagccccagcgtcggcgactgctgctcgtgctcaccgacggcgagcccgccgacaacgacgtgcgcgatccgcagtacctgcgtgcggatgcacgccgagccgtcgaggagctggctcgcgctggtatctcgacgttctgcctgagcctcgatcctcgcgcggaccagtacgtcgcgcgcatcttcggcccgaccggcttcatcgtgctcgacaacgtggcgcgactcccggaacgtctgccgctgctgtacgcggccctcacgcgctcgtgagcaacacgtaagtctttacttgacgaacatcgctttcaaatgagctttcgcatagcggaagtgtatttccggtctagtagattctcttttcatgaggagcacgccgaccgagcgccttcacggtgatggtcggctgcaggcttctgctcggcaccgggtcggtgcggcgagcggtggtgaggtgcgccccgcggtcgcgttcttacggtgtccgtggccgtggcggcccctcgcggggctcgaggggagaagggatcaagcatggggaacctggtgagttcgtggttgctcgcggtcgcggtggtcgcctacctggtggtgggtctcggtctcctggtcgcgcggggcgcggccggacgcagtgcgcgacggtggacgacggtggcgtcgtgggtcgggctcgtcgccacgctcggcgcctcgacggcgttcgtcgtcggccacgaacgatcgaccacgctggtcgcggtgccgttgcccgcacacctcgggcacgtcgccgtcgattcgctcgtgaacgccctcaccatgatcgtcgtcaccttggtggcgttcgtgggcaccgtggtcgtacgctactcgacgtcctatctccgtgacgaccccgctgagctgcggttctatcgctggttgaacgtgacgctcggcttgttcctgtggctgatcgtcaccaacgacgtgtggacgttctggctgctgttcgtcggtgcgagtctgtcgctccacgagctgctcgtgctctatcgcgatcgaccgctggccgtcacggcggcgcgcaagaacttcgcgctcgccagactcgcggacgtgagtctggcggttgcgctggtgctcgtcgtggaggcgacggggcgctcgagcttcgccggcatcgcggcgtggttccacggggcgcaccccccgatcggcgtcgatctcgaggtcgccgccgggctgatcgctctgaccgcggtcgtcaagagcggtgtcttcccgttccacgggtggctgatccaggtcatggaggcgccgacccaggtctcggcgctcctgcacgcggggctcatctacacgggtgccttcctcctcctgcgcatgagctggctggtcgcgtcggtgccgtgggtgtgggtggtgctcagcctcgccgtgatcggggtgttcgtgtcgtcgctgatgatgctcaccgagacgaacatcaaggaggcgctcgcgtactcgacctccgcccaacttgcgttcatgatgatggagtgtgggctcgggctctacagcgtcgcggtgctccacatcgtcgcacactcggtctacaaggcgcatgcattcctctcgtcgggaagcgtggtggatggccatcggggcgcgatcctcaccaaggtcccggcgcgtcgaacgttcgggcaggtcgagggcgcgctcgctatctccgcgctcgtcaccgtggggatcgccgagctcctccgggtcgacgtggtgcacgagcccacgttggccgccatcggcttcgtggtcgcggtcgccatgacgcagctgctgctgcagggggtcggggggtcagaccgtcagggacgtcgcttgctcgtgcgcgcgagcggcttcagtgtgctcgtgggtgctgcctacttcggtctgcacgacgtcatggtgcgcctgctcggctccacggtgccgtccgagagcggccaggcggaccacatcccggggtgggtgctcgtcgtggtcgtggcggcgttcgtcgccttgctccacatcggccagttcctcggtccactcagccggacccgcttcggccagtggctctacgtggcgctgtggaacggtctgtgggtggatgccgccatgcgtcgcctcgcgtggttcgaccacctgcgcctcggtcatcgtccgctgcacgcccctaccgagcctgagcctgttgcggcgacgggcgatgagcccgtgcccggatcggcggcctcggtgctggaggccgcgcgcgtggcgtgcgaccggatcgcgccggtgtggccgctccggcacttcgtcgccgtgaacccctacttcggcatgcgcgacctgtcgttctgggaggccgaccgctacctccagaccatcgcaggttctcgcctggtcatgccgctcgcctactaccgagagcagctgcaacaaggacgcatcggtccacgcgatatccgtgacgcagcgcgtcgccttgggcgcgagggggcggtcgagggcctgctcgctcgcctggaggaggctcgtagtgagccgctgctccctcggctcccgctcttcagcgatcacctcgggcgccttcgcggtcgggacatcaccacggccatcgtcgagcggctcagccatttcctggcggcctacttcgacgaggggcaagccacctggcaccttccgtggcaggggaactcgttgtggcaggcgtggcggtcatcggtccaggtcgacgcgacgccgcgcatcctcggactcccgtggcccaagtcggcgctcgcggccctgcccgagacgcccgaggacgccatcgccgctgcgctgggcgtgctcggcgttgctcacgaagcgatcgaggactacttggtcgctgcgttgttctccatcggcgggtgggcgtcgtgggcacggtaccgacggtggcaggcggagctcgtcggctcgaccgacgaaaccctgttcgaactgctggcgatccacgtctcggccgaggcgatcctcgcccagggacttgatgatcctcgggtgctcgcctcgtggcgcgacgccgtcgtggcagcccatcggtcctgggtcgcctcgcggcacgatccgctcgacgacgccgcgatcatccacaccgcgttcgagctgcactatcggcgccggctcgcgcggacgctggctgccggtgctcgcgccggggaggcgcccaccggggagcgtcctcgcgcccagctcgccttctgcatcgacgtgcgctcggagggcatccgtcgcgccgtcgaggcccgcgtcgctggcgcccagacgctcggcttcgccggcttcttcggcgttcagatggagtacgtccccttcggtaccgagcacgcacgcgcacacctgccggtcatctttgcgccgccctatcggatccgcgaggacctcgtcgatgcctccgacgacgaccgtgcgcgtgcggcggagcgacgtcgccttcggctcggcgccggcgcggtctggaagaccttcaagtcctcggcggcctccaccttcaccttcgtcgagtcgaccgggttggtctatatcccgaagctcttcggcgacgccatgggctggtcccgcacggtcgcgcaccccgacgcccgaggtctcgctggcgacctgcgcgcccggctgcgcccgaggctgacgccgatcggtcatcccgggggcaacgacgggatccccgaggatcgtctcgccgagatcggtcgcttcatcctcacctcgatgggcctcaccggcgggttcgcgccgctcgtggtcctggtggggcatgggagcgagaccgtcaacaacccgcaaggatccgggctcgactgcggtgcctgcggggggcagacgggcgaggtgagcgcgaaggtggcggcggcgttgctcaacgatccgcgaacccgagcaggcctcgaacgcgtggggatctcggtgccgagcgacacggtgttcgtcgcggcgctccactccacgttgacggagcaggtgaggctcttcgacgtcgacgcgctcgatcccgcccatcgcacgctcgcccgcgacctcgagaccgatctcgccagcgcgacccggctcgccgcgacgtggcatgcgacctccctcggtgtgaccgccgaccaggatctggcgcacgacctggcgcgtcgtggccgcgactgggcggaggttcggccggagtggggcctcgtcgccaacgccgccttcatcgcggctccacgcgcaaggaccgcccacgtctcgctcgagggccgcgcgttcctccacgactacgactggcgccacgacacggactttgcgaccctcacgctcatcatgaccgctccgatggtggtcgcgaactggatcaacctgcagtactacgcctcgatggtcgacaaccggcgcttcgggagcggaacgaaggtcctccacaacgtcgtcggtggttcgatcggagtcctcgagggcaacaacggcgatctgcgggtcggcctcgcgctgcagtcattgcacgacgggacacgctggctccacgagcccgtgcgcctcaccgtggtggtggaggcgcctcggggcgcgatcgaccaggtcgtccgggaacaccagctcgttgccgacctcgtcgagcacggctggctggtcgtgacccaactcgaacccgacggcactctctacgaacgcgagggcgatggccgttggcgcgcggtcatcgacgacgattcgttggcagcgaccagcgttcgctgacggcacggcgagcgcgagcggcctcgctcggcggccacctggaccgttcgcggtgtcggtggctgctcgtggtccgtggcctcgctcggcgatccgtgctcaaggtcgtcggcgttcgctccgagatcagtggcagccgcaggatgcgagctaccgctgatccaaggagggcgtgacccgcacggggaggactccgcgtgagcacgaccgtcgaggcgttgagctttgcgctcgacgcgctccagatccagagcgacgccatcgccaacaacgtggccaacgtcgacacgcctggctacatccagtcgaacgtgtcgttccagtcgtcgctcgccgctgcgctcgccaacggtggcacggccaccaccagcgtgaccccatcgtcgaaccccgtgggactcaacggcaacaacgtctcgctcggccaggagctgacccaggcgaccaccaacgccatggactaccaggcagtctcgaacgagctgacgacgtacttccaaatcttgtcgggttcgatgggaggccagttctaagtgtcgctgtttccagccatcgacgtcgctgccaccggcgtgacgaccgagcaaacctggctcgacaccatcgcgtccaacgtggcgaacgtcaacgaccagtcggccacgaaccaaccgatctatcaggagcaagaggtgctcgtgcagcccgtggagacgtcgccggtgacgggcgtcgcggacacgaccacgacgcccgtcggttcgggcgtccaggtcgacgccatcgtcaccccgttgcccaacggggtgctctcctacgatccgacctcgacgctcgcgaacgcgcagggctacgtgaagacgcccgggatctcgctcgcccagcagctcgggaacctcgtcaacgctcaaacctcctaccaggccaacgtcgcggtgatcaaccaggccaagacggcctacgaggcgatcctcgggatccaggcatgatccccccgatcgcacccctgtcgtcagcgctgtcggcggcggcgccgggtgctgcgggagcgtccacgcagggcgcgagcggctttgcccaggtgctcggatcggtcatcgaccagatccaatccacccaagcgacggccaacacccaagcgcaaggcgtcgccagcggccaagcgtcgatctcgaacgcgatggtcgcctccaccgagtcgctgttgaccaccgaacttgcggtccaggtgcgtaacggcgtcgtcggcgccatcgaccaggtcatgtcgacgcagttctaggaggcgtactcgtggcatcccaggacctcctcgccaaggcgcgcgactcgctccggcgcttcgcgagcggcttcaccaccggccagaaggccgtggtcatggtcggcatcgcactggtcgtcgcgatcgcggttgcgctggcatcgctcacgtcgagcccgagctacggcgtgttgttctcgggcctgtcggcccaagatgccggctcgatcaccgcgaagctccagtcggcgggggttccctacgagctcacgaacggcggtacgacggtgctcgttccccagaacctcgtcgaccaggagcgggtctcgctggccgaggccgggcttccgtcccagaccgcggggctgacgtcgctgaacggcctgtccatcacgagctcgcagatcacccagcaggccgattaccaggcggcactgcagtcgcagctcgctcagaccatcgaggcgatcaacggcgtgcagtcggcacaggtgaacctcgccctgccgccgacggacgccttcgcgatcggtcagtcgtctcagccgagtgcctccgtgatcgtgacgctggacgcgggcgtgtcgctcacgtcccagcaggtcgaagcgatcgtccacctggtggcgagcgccattccggggatgaacgccaacgacgtgacggtggccgaccagaacggtgacgtgttggcagcgccgggtctcggcgtcaacgcccagggcgccggtcagtcggcgcagggcttcgactctcagctcgaggcgtcgatccagtcgatgctcgacacgatcgtcggccccggcaacgcgaacgtccgcgtcgcggccacgctgtcgacgaaccaggtcacgacgaagacccagtcgatccagacgcagaagggcaagcccctcaccacgccgacccagacccagacccagacccagaccttcaccgggaacggcaccgtgccgggcggcacgctcggcaccactgggatcgcgaccaccggcaaccaggtgtcgacctacaagcagacctcctccacgacgcagtacgcgatcggtcaggtcacccagacggtccagcaggcaccgggcgcgatccaacgactcagcgtggcggtggcggtcaactcgcacgtcaagggtctctcgttggcgaagctgcgccaggtcgtcgcggccgcagccgggatcgtaccggcacgtggcgacacgctctcggtcgtcgcggtgccgttccccgcgctggcgacgacgccgtcgggtgcggggtcgtcgctcttcgggtcgatcctcggcatcgcgaaggtggtcctgctcgtgctgggagcgctcggtgcgatcttgctcatgtcccgtgcagcggcgcggaccgaggtcgagccgttgttcccggctgagctcgagcctgctctcgcgggaacgggtggccagctcgccggacccaccgaggaactgcccgcggtcgccttgccccagagccagccggtcgtcggcgaggacgtgctcgactacatcgatcgccagcccgaggacgtcgcgaagctcttgcgggtgtggatgacggcgcggggtcgcaaatgagcacgaaggtcgccgacctcaccggcacccagaaggcggccgcagtgttggtgcagctcgggacgactctcgctgcgcgcgtgcttcgtcagatgagcgagtcggaggcggtcgccctcacgctcgagatcgccaagctgccgagcctcgacaaggagaccatcaccgaggtgatggccgagttcgtcgactcggtcatcgcactcaagaccgtcggtcaaggtggcgtcgacacggccaaggagatcctcgcggcccgcctcggcgatcgtgaggctgaagagatcctcgcccagttcaccggtcagagcgtgtcgaacccgctggccttcctcgaccacgtcgagccgttccagctggtcagcttcctctcgagcgagcacccccagtcggtggcgatcatcctcgccaacgtccctccagacctcgctgcccaggtgctggctgcgatgcccgaggagccgcgcgcggaggtcacccgccgtatcgccctcctgtcgcgtgtcgacccggtcgtcgtcgagcaggcggcctccgtgctccagcgcaagctagccggcctgacgaagcaggggccggtcgccctgcgcagtgggctcgccacggtggtcgagatcttgaacaacgtcgaccagagcacggagcgacgcatcctgtcggacctcgactcgctcgaccccgaactcgccgatcgcatccgtgagcagatgttcgtgttcgaggacatcatggtgctcgacgaccggaccctccaacgcatcttgcgtcaggtgtcgccgaaggacctcgccgtggcgctcaagggcgtctcgcccgagttggtgaaccgcatcatggcgaacatctccgagcgcgccgcggaggatctcgccgaggagatcgagctgctcggccccgtgcgcctctcgacggtcgaggctgcccaggcacagatcttgcgtgccgtccgcgagctcgaggcggcgggcgagatcacgattgcccggtccgacgaggagctcgtccagtgagcgccgcacggatcctgcggggcacgctcgacggcgtcgggacggtggcgctcccaccggtggagcatcttcgtgccggtgacgccgagcacatcgcccttgcgcacgccatcgaggaggccgagcgccgaggcgaggagcgcggtcgtgccgccggtgaggcggccgcacgtcagctcctcgaggccgagcgggcggcgctggcctcgacgcgcgaggcccttgcctccgtcctccggcggctcgagcgcatcggtcgcgagtcgctcgaggccgacgtcgtcgaggtcgtcaccctcgcgctcgagctcgctcgcgaggtgctcgcggccgaggtggtgcctccccgggagcggatcgaggcgtgggtggggcgagtgctcgccgagcgtgacgtcgaggagctcaccgtccgcctggcaccgcccgcgagcgaggacctcgccgacaccctcgtcgagttggccgagcgcgaaggcgcgaggctccgggtcgagcgcgatgtgtcgctcgagccctacgacgtcgtcgtggagctgggcgcgggcgtcctcgacctcacggtcaagggagcgttcgagcgtgtcctccaggagttgcgggagctcggacagtgatccctgcccgtgtgcgcgaccaggtcctgcgtgccgctgcgccggttcgccagggccgcgtctcgcggatcgtcgggatccacctcgaggtcgagggcgtggaggcaggcatcggcgaagcggtgcgcatcgagctcggaggcggccagagcctggtcgccgaggtggtgggcttcgagggcgagcgactcgtctgcatgccgctgcgcgaggtccgaggggtgcgctacggcgatcgcgcggtggccttgcgccgcgcgacccagatcccggtgggtcgagcgctgctcggccgcgtgatcgacgccgatggggtgccgatcgatggccagggcccggtcgaacccgacgatgtggtgggcctcgagctggcggcaccgatgcccatggagcggacgctcatcgacgagcagctcggtctcggtgtgcgcgtgctcgacaccatggtcccctgtggtgtgggccagcgtctcggggtgttcgcgggagcgggtgtcggcaagagctcgttgctctcgatggtggtgcgcggtgcggacgtcgacgtgcgggtcgtcgcgctggtcggggagcgcgggcgcgaggtgcgagaattcctcgagcacgacctcggaccggaggggatggcacgctcggtcgtggtcgtcgcgacctccgacgagccgccactcgtgcgtgtgcgagcagccatcgcggcgactcggatcgcggagtggttccgcgccagcggggcgcgcgtcttgttggtgatggattcgctcactcgcttggcgctcgcacaacgcgagctcggactgtcggcgggggaaccgccgagcgtgcgtggctatccgccgagtgtgttccgcctgatggcccagctcctcgagcgtgcaggcaccgatcacgtcggctcgatcacggggatctactccgtgctcgtcgaaggtgacgacctcgacgatccgatcgccgacgcggctcgctcggtgttggacggtcacatcgtgttgtcgcgccagctcgccaatcgcggccgatatccggcggtcgacgtcttggcgtcgctgtcgcggttggagtcgtccatcctccccgacgatcgacgaaggctcatgcaggcggctcgccgacatctcgccgtcctcgacgaggtgcgcgatctggtggatctcggtgcctaccaagcgggaacgagcatggaggtcgacgaagcgctcgaggtggtgccgcggatcgagaccgtcttcggccaggacatctcggagcgctccgatccgaacgacgcctggtcgcgcctggccggtgcactgggggtgaacgcatgagcgaggagcgtcggatcagagcactcggtctcttgcgtaggatcgagcgactggagcgctggaaggccgtcggggcggtcgccgcagcacagcgcgcgtggggatcggcaagggccgaccgcatcgcccatgtcgccgccatcgatcaggacctgcccctcacgctccatgcctggcatctccaggccgccgtctgggcgggcgagcaggccgtagacgccgctgcccgacgtgcgacgtcggagcgttggctgcgcgccagtgagcttcgagagcggagtctcgctcgactcgaggccgaggcgcttcggcggcgccggagccacctcgaacgtgcgcgcctcgccgatctgctcgatcgtgtggtgtcgacgccgaggggagacggaccatgaccatggcgatccagagtgcggctccgcccgccgtggccgccatcgagcagctcgccagcaccctgtcagcggccgcgagcgcgcagggcgtcgcctcgttcgagtcgacgctcgccgcagcgctccaagccgagggccaggtgatctcggggaccgggaagagccagagcccaggatcggtgacgggggtggcccagcagccgagcgcgagcgtcgtgccgacgtcgaacgcaccggtcgacccgttcgctggtctcaccccggtgcccccgacgccaacggcccagaccctcgtctcgacggggggctcggcctccgagcgtgcgacggcgctcgcggccgcgaccggtgagatcggcgtaccgtacgtgtggggcggatcgtcgccggcgacggggttcgactgctcgggcctcgtccagtgggcgtacgctcaggcaggagtcgagctccctcgtacggctgccgagcagcagaccgtggggacgctcgttccctcgctcgccgcggcccagcctggagacttggtcttctatgggaacccggcctatcacgtcgcgatctatgccgggaacggcatggtggtgcaggcaccgatgaccggtgagaacgtcgagctcgccccggtcggtacgccgacggagattcgtgacccgacggccgtcgcaccgcagccgacggtgagtagtgccgtcgcgacgccgagcgacctcacggcgacgttccaggctgcgagtgcggcctatggcctgcccacagggatgctcgaggcggttgccgagaccgagtccaacttcaacccgaacgccgtgtcgtctgcaggcgcggaggggatcatgcagctcatgccccagacggcggcctcgctcggggtcaaccccttcgaccccacccaggccatctggggcgctgccaagctgctcgcgggcaagctcgcccacttcggttccgtgccgctcgcgctggctgcctacaacgcgggagacggcgcggtggaggcctacggcggtattccgccctacgcacagacgcagaactacgtccgcacggtgctctcgctgatgggaggtgaggccgatggctccggtcagagcactgccagcgcgtgagccgtcgacgggatcggcggtcgcgtcgtcgagtgcgagtccgtccgagtccgtcgcgggtgggttcgcggcgctcctcgcggccgcatcggaggtgggcatgccccaggcgaccgagaccccgacacgtgggggttcctcgggtcactcgtccgatgtcgagcacgggggggtaggaccggaggcgcgaggacgcgggcacgctgcggtgagggccgaaatcggtgcccctggcgaggcgagcaatgccagcacacgacacacgacccatcccgagggatcggaggcgaccgtgtcggcggctcgagcagccgtcgagggcgccatcctcgccgaaccggctggtgcggtgcggacgcacgcagcgtcgaacccgaagccagagcccgcgagcgcttctgcgtcactcgcgctcgttgctcaagctggcgtcgtcggggccacaggcgtcggcgccgaagccatccgggccgaagccatccgggccgaagccgtccgggtggcagcctctcccgcgcgtgcgccctcgctcgaggtcgctccggccgccgatgctcgtcgtggcgagcctgccggggcgccagcgagcgccaacacgaacgctcgacccgatggggcacctccgcacgacgctgggtcgctggtgtcgcaggacgtggtgtggccaagcgctgggccgcttgcggcggcggtcgctggtgccgagggatcgggcagcgcgcccatggccgtgtcggcgccgacgacggacgcccccgcagcgctgtccagcgccgtggccgctgccccccgagcgcacggcacgcgcgagcccgcgatcgccctcggcaccgccgacggcagagccggatcgagcatcgcctccgacttgcaagcggtcgggcgggcgccgaccgccgaagctgccggccagacgacggtcgcttcgaccggagcgagcggtgcggtctgggcggcgacgagcgtcgagctcggctccttcgtggtcgatggcgatgtgatcggaccgcccgtcgagccctcggcggtgccggcgatggtggacgggctggcacgcgctggcggtgcccaccgcgtcgtggtggtcttgtcgccgcccgagctcggtcgtctgcgcatcgtcgtgagcgaggcaccgggcgggaccgcggtgcaactgcaggtcgagaggccggccactcaggcgctcatcgagcacgcgctgggcggatatgccgatacgagtggctcggggtcccgggggggccagccgcacgcagaggacgcggcgccgccgtctcgggtcgcggtgtcggtgacgacgaaggcgacctcggttcgcgctcgtcgaggcgttcgagtcgatacgtggatctagcaggtcgacgagagaaggagtccagatgacaatggcagtgggtggtatcggagcaagcgccgccggcgctacgacgagcgcgtcgggtggactcgccagcctgaccgcgaacgagtttctcaacctcttggtcacggagctgcagaaccagaatccgctctctccgatggacccgtcgcagatggtctcacagacctcgtcgctgtcggaggtggagctcctctcgaccatccagagtgcgctcacccagatggcctcgagccaggggatcctcagcgcgagcagtctgatcggccagagcgtcacctatcaggacggctccggcgaggttgccggccaggtctccggcgtcgggcagagcgccaacggcgtcgtcctcgatgtcggtggccagagcgtgccgatcgcgaacgtcatcgccgtcggcatggtgccctcgggcgcctcggcgacgggatcgacgcagaccgggtcgacgacgtcgacgaccgggtcggtcggctgagccgccggacagcgtcgctcagtgggcgccacgaccaccatcgacacggaacacgatcaggacaccacacgatcaggacaccacacgatcaggacaccacacgatcaggacacaaggaggatcatcccatgaccaagtcgctctcgtctgcgatctccgggatcgaggcgaaccaggaatggctcgacaacatcgcgaataacatcgccaacgccaatacgaccggctatcagtcgacccagacggagttcgcagacctgctctatcagcagcagtcggcagccggcggaccggtgccgggccagaccggagggacgaatccactggtggtcggctccggtgtccgggtgtcggcgacgccaaccgacttctctcagggcacgatcgtgcaaaccggtacctccaccgacgtcgccatccagggccaaggcttcctcgtcgtcaaccagggtggccagaactactacacccgtgacggggcgctccagctcgacggcgctggtcagctcgtcacggcctcgggtgcgctcgtgatgggatgggtccccaacgcggccggtcaggtgaaccagaacgctccgctcgccgcgctcacgattccgcagggccaagttgcccagccggtcgccacgagcaccatcacgctcggtgggaacctcccggcaggttcgtccaacccggtcgtcgtgacgacgaccggctacgacgacctcggtaacccggtgccgattcagctcacctttacgccgtcgacgaccgccaaccagtggacactcacggccgagacgacgccgccgggcgcgacctcgcccgtggcgctgactgtcggcggcgcctcctcgcagacggtgaccttcgaccccgcgaccggacagatcagcgccatctccgggacctcgaccgcgaaccctgatcaactggcgctcggtgggttccccacgtcgtacgatctgccggctggctacgccatgaacctcgacttcccgacccctggcacggcacaagccgtgacccagttcgccgccagctctccaacggcccaggtgacgaaccagaacgggtacccatcgggagccctcgcaggcttcaccatcggctccgatggcgtgatcgagggcacctatgccaacggtcgcacccaggtgctcggccagatcgcactggcgcagttcgcgaacgcgcaggggctctccaagcagggcaacctcctgtacgcagcgacgaccaactccggtgcgccccagctcggatccccgggtgccgcgggtctgggccagctcgtcggaggtgcgctcgagtcgtcgaacgtctccatcggctccgaactgaccaacttggtcgtcgcacagaccgattaccaggccaatacgaaggtcgtccagacgacggccacggtgctccagagcttggtgcagatggcctagcggcgtcgggtcgcgcctgctgggtgcggcccggtcgccaaaggttcaggccggcaccaacggtgccgataccaacggtgcgcaaggaggtgctccgtgatcgaggtcacgcggtggtcaggatcgaccttggtactcaacgccgatgcgatcgagcgggtggaggcgacgccggacaccgtgatcacgctgttcggtggctcgacgtacgtcgtccgcgagacggtcgacgaggtcgtcgcggccgtggtggcctacaagtccgccgtgttcgcacccatcgcacccaccggcctcgtcgtgctcgacggcggggaggggtaggccatggacgtcgccacgccggtcgggatcgtcgtagccctcgtcgcgatcctcgtgtccatgatcatggatggaggcaatccggccgccctcatcgccccgtcggcgatgatcctcgtgctcgtgggcactgtcggcgtgtccctcgcgggccgtcgtctcaaggagatcggccagatcgtgggagcgctgcgctcggccatcctcgccaaggcgccgagcgcggaggagagcgttgggcaactcgtgcacttcgctgagatggcgcgccgagagggcgtgctcgctctcgaggccgccgcgaaggacctcacggaccccttcatgcgctcgggtatgcagctgatcatcgacggtgtcgagggcgacaagattcgagagatcctcgaggcagatctcgagggtatggggacgaggcatcgcgccggtgcgaagttcttcaaggacatggcgggattcgctccgaccctggggattctcgggacggtcatggggctcatccacgtgctcgccaacctctcgtcaccgcagacgctcggtccggcgatctcgggcgcgttcaccgcaaccctatggggcgtcatgacggcgaacgtgttctggctgccgatctcgaacaagcttgcgcatctgtcggagcaggagaacgcgctgcgtctgttggtcatcgacgggatccttgccatccaggctggtgcgtcaccgcgcctgctcgagcagcagctcctcagcttcctcgccccgacggcacgtgaggcgcaccgtacggccaaggagcgagccaagccgcagaagaaggcggcctagcgtggccagacgacatcacggcgagggcgaggccgagaactccgagcgatggctgctcacctactccgacatgatcacgctgctgctggcgctcttcgtggtgctgttcgccatgagctcgatctcggtgcgcaagttcgacgagttcaagaccgggttgttgcagaccttctcgcagatgcagctgcagagcttggagcacgggggacgcgggctgctccagcactcgtcactggtgacgcacccaggtctcacgccgggtcctccgcagatcaccatcccgcaaccaggcgcgggaactccgagcgagtcgcagatcgcccaagaggtgaaccaggcactcgcggcccaaggcctctcgcaagatgcccaggtcgtcgtggagcaacggggggtggtggtgcggatcttgtcggacaaggtgttcttcgcgacggactcagccgcactcggccccgtgggagacgccgtggtcgacgccatcgctggcgtcctgcgcacgctgccgaacgacgtgtccatcgagggctacaccgactccgagccgatcgtcggcggcccctacagttccaacttcgaactctcggcggtccgggcggtgacggtcctcgagcgactgtggaaggtcgacggcatcaaccccgaccgtctcagcgccacgggtttcggcgacacccatccgctggtgccgaacacgaccccccagaacatggccatgaaccgtcgcgtggacatcgtgatcttgagttcgaccacccaagccggcaaccgcatctagcgcgacccgacgagaaccaccggggtcacgaggaccccacgagacccaccaaggagggatatggcgacgacgaaggccaaggctgcccaggcagccgaggaggcgcaagcgcccaagaagggcaagaagcgcctcgtgctcatcgtgctcctcgtgctcatcgtgctggggggtggaggcggtgcctacgagttcctcctcgcgccccatcctgccaccaagcggcaccacggaccaccgctgccggggccgacctacacgttcccccagctcacgaccaacctcgacgacggccacatcgtgcagctccagatggtcctccagctcgcgagcggtgacacaaccgcggaggtcgcccacgacctcgacgagctcaacaatgcggccatcttgacgttcggccagatgagctacgggcaactgctgccgacggcgggccgggtggcggcggcgagcgccctcgaaggcgcgttcaaccacgtcctcgcgagtggcgcaccgccacacgacgaggtcgtcgggatcgagttcacctccttcatcgtgcagtaggcgccgcggcgccctggcaccaccgagcgcgaccgttggtcgacgctcaagttcgcgcgcctccgtccgatgccactgtcatgagtggggagaacgaggcgcgtgagcgccaggtgcgtactgtcgactttcgcctcccccacagcttcgaccgtgccgagcaacgaggactcgagctcctcgtcgagaacgcgctccgaccggctgcaaccttgatgggtgcgagcctgcgccgcggcgtgcggctcgagctcggtcggatggaccaacttccctgggagcaggtcgtcgcccaacaggacggcccagccctggtcatctcgttcgcgctggttccattgggatcgcgtggcgttctgcgcttcggagccgatgcggcccttcgcctgctcgatctgcggctcggcggtgacgggtcgccgatcgagccccgtgcgctcaccgaactcgagcagggactgctcgtccaggtcttctccgatctgctcgtccaactcgcctcgagtctgcagacgctgctcgacgtccgcttggatcgggtgggggcagagacgtccctcgagttcgtccaagtcatcagcccgggcgagatgtgcctggtcgtgccgatcgcgctgggcatcggtgacgaactcgagagcgagctcacgctctatctgccctattccatgctgcggcccgtcgtggagctcatcgcccagcgcgccatcgtggccgtcgatcgtggcggcgatacgttccgggatctgctcgccgctcgtctgcacgacgtccgcctcgaggtcagcgtccggttcgagccgacgtcgatcagttcgcgcacgctgctcgagcttgctcccggtgacgtcgtccccctcggccatcgccaaggacaaccggcctgggtcatcgtcgatcgcacgcggcttcatcgggccgtcatgggtcagtcgggctcgcgcgtcgccgccgtcatcatcgaggaggaggaagaggctcatgcctgaggtgcccgagacggccgcgaacctcgcggtccttcgcaacgtcgaactggagctcagcgtcgaactcggcagggcgcggatgcccgtgcgcgcgctgctcgcactcacgagtggcgacgtcatcgaactcgaccgtcacgccaacgccccggtcgacgtcctggtcaacggcaccctggtggccaagggcgaggtcgtggtggtcgacgacgagttcggggttcgcatcctcgaaatcatctcctccgacgaggtggaccagctgacccggggagcgtagcgaagatgggatcgatcgtcgaggccatcggcgcgctcgcgttggtggtcggcttgatcgtcgcatctggtcgcctcgcccagcgcggtcgtccggcgcgttcggtcggcatggctcgcctcgccgtcgtggctcgggcttcacttggatcgaagacctcgatcgtcatcgtcgaggccgacggacggcgattcctgctcggggtcgggccgcagggggcgagccgactggcgagcctcggtgcggcaccgccggccgatgcccccgagatcgagctcctcgacctgcgagatgtcgacgtggccttcccccctccaggttgacacctgctataggaggaagggatgagccagacaccgaacccaccaccgggcgacggccccgctggacgacgacgcggccgctacccgagccagttccgcaaggacgcggcagcgttggttctcgaccagcgccgcaccatcgctgacgtcgcccgtgagcttggcatcaacgagcagacccttggtaactgggtccgtcaggaacgcatcgaccgaggtgagcgagagggcctgacgagcgccgagcgcgaggagctgacacggctgcgccgccaggtcaagcagctcaccgtggaacgcgagctgctcaagcgagcgatggccttctgggtgaaggaggggggacagtgagccgctaccactggatctcccgccaggaggccaagggcttctctgtagcggcagcagcacgagtcatcggggtctctcgccaggcctactacgcctggcgacaccgtcgggaccgaggcgaggatcccgagcacctggtgctcgcgagcgagcttcgcgccatctggcacgagagcgacggcacctacggcagcccccgcatcacccacgagctgcgacggcgcgggttctgcgtgaaccacaagcgggtggaacgcctgatgcgcgagctcgagatggcagcgggcccacgccggcgcttcgtagtcacgacgaggcggggagaggacgcagcgctcccggacctcgtccgtcaggacttcgctcctggtgagccgaagcgcaggtatgtgagcgacatcacctacgtccgcaccgatgaggggttctgctatctcgccacggtggcagatcttggctcgaggcgcatcgtgggctggtcacttgggcgtcacatgcccgatgacctggtggtcgaggcgatccgcgaagcactcgggactcggggcagcctggctggggcgatctttcacagcgatcgcggcagccagtacctctcccggaaggtacggagcctgctcgcgacccttggcattcgccagtcggtggggagggtcgcgacctgctacgacaacgccgtggccgagtccttcttcgggagcttgaagcgcgagctggtggctcgctaccgcttcgcgaacctctcaggggctcgctctgccatcgctagctggattcaccgttacaacacggtccgcctgcactcaagcctcgggtacctaccgcccgtcgagtacgagctctcctgggcctgccgggaggtggccgtggcctaaattcagactgtcaagcaaatggggggaagcccaacgatccagaggccgccgtggtcgctgccttcgacgagccgccggtgcacgccggcggtgcgctcacggccctgctcgcggcgcttcgcacccgaggggttcgcccgtgagcggtctgctcctcgcggcgacgagcctgccgtcggccacgttgacggtgcatgcgggttcgacgccgaccgcgagcgtggtgatcatcctcgccctcaccgtgctctcgctcgccccgacactcctcgtgctcttcactggcttcgtggagatcgtcgtcgtgctctcgatcactcgtaatgccctcggtctctcgacgacgccgcccaatcaggtcctcgccggtctcgcgctcttcctctcgctcttcgtgatggcccccaccctcgggatcgtggagcaccaagccgtcctaccgtatctgcacggtcacatctctgccgttgtggcgttggatcgcgcggaagggccgatcaagctctggatgctgcgtcacacgcgaacgcaagaactcgcactgttcgatgtagtcacccaccacgccggggtcgcacctgccgcagcgccactcgatgccgtcgtgccggcgttcatcctgtccgagctccacagcgccttcgtgatgggcttcatcatctacgtgccgttcctcgtgatcgacctcgtggtctcgagcgtgctcatgagcctcggcatgatgatgctgccgccgacgctggtgtccttgcccttcaagctgctgctcttcgtgctcgtggacggttggacgctcgtcgcgcacgccctgctcgtctcgctccactgacaagggggttcaccagatgaacgatgctgctgtgctccagatcgcgcggacggccctcgaggtcgccacgctcgttgccggaccggtgctcgccgttgcgctccttgtcgggctcgtcgtcgcgctggcacagaccctgacccagatccaggaggcgaccctcagcttcgtgcccaagctcgctgccatcgccttggtcctgctcttcacggggcactggatgctccaggaactcacgacgatgacgacccagctctacagccagatcccccatctcgtgcagacgctctaaggacgagccgtgcagatcagcctccagctgggctccgtactcgcgttcttgatcgcgaccgcgcacgcgctcggcttcgtcgtcatcgccgcgccgttcgcgctcgcgacggtgccgcgcacggctcaactcgcgctcgcggtggggatgggcatggctggcgcagcgatccacaccgccttgccggcgacgacgccagcgctcatcggccagctcgcctgggcagcagcgaccggtgcattgatcggattcgtggcgctcgctgcgatcagcatcggatcgcaggcggggagcttcatcggcttgctgggtggcttcgtcacgcctccctcgctcacgccgctcgcgttcggcgaggtcccggtcaccggcgacctctacggcatgatctgggcggtgctgttcttcgtctccggcgccgacgtcgtcgtgctccgcgggttctatctcgcgagcgacgcgagcgtccatctggccaacacggccaccgtcatcgtgcagtcggtgacgctcacctttgcggccggcctggaggtggccgcaccggtcatcgcggtcatgttcttcgcccagatcgtggcggcggtcctcacgaaggtcgcgccgcagctccagccgctcggcttcttgttcccgctcgagattctgttgtcgctcatcatgatggtcgtctcgctgcccgtcatcccgcacctcttcgacgctggggtgcgtctcctgctcgctgccgagcgtgatctcggggcctgaagatggcgcgccaggagggcaccgaagagccaaccccgcgaaagctcgagcgggcgcgcaaggaggggatggtcgcgcgctcggtcgacctcgtctcgttcgtcgtgctcctcatcgcgtcgttcgccctcccgctcgccgtgcgcgatgcgagcgtgcgcatcggcgacgtcgcggccgcagcgtggtcgggcgcgatccccgccacgagcgccggggcgttgcgctttctcggcaccggtctcgatctcgtggtccaactggtcgggccggtcgccgtcgttgcggtggtcatcgtcgcggtcgggaaccttgcccaggtcgggctgcgcttcgtcccgaagcgactccgaccacgcgccgagaccttctcgcccgcggccaacctgcgtcggatcttctcggcccaacccgggatcgaggtcgccaaggcgatcgtcaagctcgtcgcgacggcggccgtcgcggctgccatcgtctccagcagcatcgacgccatggctcagggtgcatcctcaccgcttgcggcggcggatgccgccgctggtgcctctctcgagctggtccgtgtcgtcgcggtcctcggggtcgtcctcggcatcgtcgacctcgtgcgccagcgtcggtcgctgcggcgcaggctgcggatgacccgccacgaggtacgtgacgagttgcgcgagcacgaaggagatctcgccgtcaaggcacgccgccggcgcttggcgcgtgagttcgttcgacgggccatgctcgccgacgtcgcccaagccgacgtggttgtggtcaatccgacgcacgtggccgtcgcgctgcgttacgaccctcgccgtgatcgtgctccgaccgtcgtcgctaagggcctcgatcacttggcgatgaccatacgcgagcgtgcgcgtgccgctcgggtgccgatcgtcgaggaccccccgctcgcgcgcgtcgtctacgtcgcctctcgtgtcggagagccgatccctgcatcgctgttcctcgtcgtcgcgaggctcctcgcgttcgtctatcgactgccgtcgctggcgcgctcgttcgactcacgccacgtgacccgttccgacgacattccggtcgatctcgccgctcgggcctggagtctgctcgccgacgagatcgatactcaaggcgacgtgcacgcgggccgagaacgctagcgaggcgcacggaggcgccgtggaagccacggtgggcagcgacgaaggggaggcccgtggactcgacgaggctccggcgcatggcgctcgccgtgccggtcggcatcgcggtcatcgtgatcatgctggtcgtgccgatgccgtcgcagctcctcgacgtcttgatcacggccaacttgaccttcgcgttgatcgtgctgggactgacgctgcgcgtgcgagatcccctcgacttttcggcgttcccctcggtcctgctggtggccaccatgttccggctcgcgctgaacgtgtccgcgacccgtctggtcctgctgcacgcctatgcgggcagcgtgatcgaggccttcggccacttcgtcgtcggcgggtcggtcgtcgtcggactcgtggtcttcgccatcttgttcatcatccagttcgtggtcatcacgaacggtgccggtcgcgtcgcggaggtgggggcgcgcttcacgttggacgctatgccgggcaagcagatggcgatcgacgcggatctgaacgccggtcacatctcggaagccgaggcacgtgcacgtcgggcgcgcatcgctcgcgaggcggacttctacggggcgatggacggcgcctcgaagttcgtcaagggtgatgccgtcgcggccgccgtcatcaccttgatcaacctcattggcggcttcatcgtgggcatcgtggagcaccatctctcggtctcgcagtcgatcgacacgtactcgctcctgtcggtcggtgacggcctggtcagccagatcccggcactcttgctctcgatctcgacgggcctcatggtgactcggagcgcgaacgacgcggacttcggcctcgacctcctgcgccagatcgcccacgagcccgtggccatccaactcgctgggggggtgatcggcgcgctcggtctcttgccggggctccccatggtgccgttcgtcctggtcggtggctcggtcttcgcggtcgggtggcggcttcggtcgaggagcgcgtcgcacgtggggagcggcgacgagcccgtcgtcaccgagtcagaagccgtgccggacgcgctcgcggccgacgtcgtcggcgtcgagctcctcgagctccagctcggcttcgagctcctcgacgtcctcgatccggctcgaggcggggacctgctgacgcgggtgaagggcctgcggcgcaagctcgccggggagttgggcttcctcctgccaccggtgcgtacccacgactccttggacgtcggtccggacgagtatcggatcctcatccaagatcaggtcgtcggtacgggtcggattcccagagggcgtgtcctcgccatgggccagggcctcgagtccttaccgggggaggccgccgtcgatccggtgttcggtcttgcagcgtgctggatccccccggaggccaagacgcaagcccaggtgctcggcgcgacggtcgtcgaccgatcgtcggtgatcgtgacgcacctcgccgaggtggtccggcgccacgctgacgagcttctcacgcgccagcaggtcaaagagatgctcgatgcgctccgccaggcagcgccggtggtggtcgacgagctggtgtcgtcgcagctcccactcggtgagctccagcgagtccttcgcgacctgctcgccgagcgggtgccggtgcgcaacctcgccgccatcgtggaggcggtcgtcgatcgcgcgcgtcagacacacgagcccgacgcgctgctcgaggctgcacgcgaggcgctcggcggtgccatcgggacgcgctttgcgaccggcggcaagctgccggtcgcctacctcgtgcccgagctcgagcttcgcctcgtggaatcgctcgtgagcgtcgacggacgccggagtctcggcatcgcccacgaggagctccgagcactgcgtgccgaggtcgccgaggccaagcagcgcgccgaggcacaggggctcgacctcgtgctcgtcacgatgggagcgatccgtcggccgctgtgggcggtccttgcccgtacgccggcggagctccccgtgctcgcgctcggtgagatcggttcgtcggttgatgtcgttcagatgggggtgatcggtggtgtccagcaaccagcggcgctttagtggtcagacagcggcagaagcggtcgcggctgcgcgcgcggccctcggcccagacgcgaggatcgtggcggccgagcgggtttccaagcccggcctactcgggcgcaagcgccacgtggtcgtcacggccgaaccgatgccggtgacgagcgcccgggactttgccaaggagctgtcacgtcagctcgcggctcgggaagcggaggcgcccgccgaggacctcgagatcctggcgacggcgtacgagcaggccaagagcgagccgcctcaggtcgtggtcgcgcccatcgggcgacgcgaggcggtggtggtcggttcgggcggtgagacgcgtccgctcggctcggtcgagcgcccgcagtggtcgcagctcggtgacgtagcgagcgcagccgtgcgtgccgtcatcgacgaacgcacgactcacctgaccgtcgacctgagcgctgacggtggcgacgtggtggtcgacgtgagcgcaccggtggccgagcgcaccatcgcccccgagggctcgcgggtgatcgcggtgtgcgccccgagcgtgccgtatccgttggcggcgttcgatgcggtcgccgatcgcgtcggggtcggcgacgccgatcggttcgtgctcgctcagcgtcggcgcgagatcccactcggactgcgcagtccagctgatcgggtggcgcgagcggtcgcgagtggacagcgacgcgtcgcggtgctcgtggatccaggtcagctcgcgctcttgcgtagctcgtttctcgccccgctcacgtgggtggtcgtcgcggtgtcgggagacgagcctgcctgcgacctcgaggtggaactcgcggcttgtgggccgatcgacgcgctccactgcgtgcgctcggagcgtgccgccgtcgagctgggccttgcggtggtggcgtagccatgcgtcttccgtggcgggtctggctctcggtcatctcggctgcgctcgttgcgacacccagcgtcatccaagccgaccacggctacacgagctgggccaacgtcctcgagcacttcctggtcgccttggtcgtgctctggatcgcctactccgtgctggcaacggtgatcgcatggtacgaactcgaggggatggtgcgacgtcggcaggcgcgccaggccgcgatggagcaggcgcagcaggcggcaccacggactcctcagtcctgatcgacgaggaggatccgaacgacgtacgacccgtgctcgtggcacgggtcgtacgtcgtttcggcgatggcgtcgagcgcgattcaggcgacgttctcccggctgccgttcagcgttggcttgcccgcgcggatccaggcgttggtgccaccgcggacactgacggcgcgcagaccgctgccggcgaggagttgggcggcggcgtagctgcgcgatccgctcgcgcagatcacgtggacgtccttgtcgcggggcagttcatggatgcggcggggcaggtggctgagcgggatgttcttcgcccccgggacgtgacccgactcatattcccaaggatcgcgcacgtcgacgacgaaggcaccatcctggtgggccgcggcgaagtgatggatgtcgatctcgcggatcatcggtcctcccgtagtatcacgacaattatgtgatgcttcaggttgtcaaccctgatgatgacagtatataccccatggggtactgaggcgaccagtccggcccacgtcatgtgtgcgatcgatcgacgcccacgacgcaaccagccgggaccacggtcccggctggttggaggtacgcgttgtggggtgaggtctggtgctacggcagctgcgcgagggcgcgctcctccttgaagaggaagtagcgctcgaggaaccgcttcgtgatgtcgtagaaggggttcgggagcatgaactcgacctgccgcggcttgaagaacttgttggcgtacatgatcacttctttgtgccccgcgtccagtacgcacacgcccgggatgtcgcggaagggtcgctgctcgaggtccgtccgtccggtcgccaagcggccgacgttcttgccgacgagcttgccctcgatgtcggccgggaagcccgtcttcgggatgccgagcggcacctgactggtgaagggcttctccacgtcgatcgccacgcccgcagaaaagatgttcgggtagtcggggtgctggaatgcgccgttgaccgggatgaaacccgctgcgttcccgatgcccgcacccgagttcaagatcacgtcctgtccgctgaaggccggcatgatcatggtgaacttcgaggggagctgggtcccgtcggcgagggtgacgccctcgtcgctcacggatgcgatcgccgtgttctcgtagagccggatgccctggcgatggagcaggcccttcaggagccgctcgccgcctcggatgccatccatgccgaaatgacccgcgtagggttcaggtgtgacccaggtcacgtcgacgcggtcgcgaacgccgtggacgcgcaggtagtagtccaagttgaagaggaactcgtaggcggctccgatgcagctggcaccaggagcggcaccgacgacgaccgggcccggatcggcgacgagccgatcgaagtcttcacgcgtctgcatgatgagctcggggtcgtggacggcgtggttgaagccgagcttcgggtcggacccttcgagcttcgagtagtcgaacttcgggcccgtcgcgatcacgaggtagtcgtagggctcctcgccacgagtggtgctcaccacctggcgctcggggtcgatgtgggtcgcctcggcctggctgaaggcgacgtcgcgcttggcgaggatcttgggaaccggccgggtgatctgcgacacctcacgctcacggaagggaacccagatcatcgaggggacgtacaagaagtagtcggtcttcgagaccaccttgacctcgacgtcgcggccgcgggtatgtcgcttggcctcgagggccgacgtcagaccggcgaagttgccaccgagaacgagtactcgctccactgcgaacctcctttgcgcactgagtcagtatgggcgcgctggagcgcccccgaccagggaagaggtgcccgtccttgagggaccttcgtcccgaacggacgtcgaggtgccggtaggatgggggtgtggcgagcgtctatgagctggatcgtgcggcggtgcgtgcgctcgttccctggccggactggcgtatcgagcagctgtttcacgggctctaccacgaggggcagcgactcgaggcgatctcgacgctgccggctcggatgcgagccgagctcgcgagccacctcgatccgggcctcactgagcgtcggcgtgagcacgccgacgacggtgagacggtcaagttcgcgctggaggctgccgacggggcgctcgtcgagacggtcgtcatgcagtcggcgcgtcgcatcagcgtgtgcgtctcgagtcaggccggttgcgcgatgggctgtcgtttctgcgccacagggcaggccgggttcgtgcggcacctcggggtcggggagatcgtcgagcagctcgcgatcgcgcagcgttcggtacgcccgcgacgtctcacgcacgtggtcttcatggggatgggcgagccgctcgcgaacgcctcggtggcgatcgaggccattcgacgcatccgcgctgacttcggcatcagccctcggcgcgtcacggtgtccacggtcgggatcgtgccggggatccgacgccttgcgcacgcagatctcggcgtcacgctcgccgtgtcgctgcatgcggccaacgacgccgcacgaagcgacctcgtgcccatgaaccggcgctacggcatcgacgccgtgctcgatgccgcgcaggagttctccgagctcaccgggcggcgcgtcacgctcgagtgggcgctcatcgccggcgtgaacgatcgcgaccgtgacgccactgagctcgccgggcacgcacgtcggctcgccgctcacgtcaacctcatcccgctgaaccccacaccgggctacccgatggtgggcaccgatcccgacggcgtcgcgcgctttgcgcgccggcttcgctcgctcggtgtcaacgtgacggttcgcgacacgcgggggcgatccatcgatgcagcctgcggacagctcgccgccgacgtcgctcgcggcggcccggccggcgccagcgcggtgcgcttcgcacggcgcatggtctcggcctgagatcccccgaccgatcacccctggcgggggaggctccaagcgtcggagaggctaggttcctaggtgcctcgataggcctcgcttcgaaggagcgcgcatgacgaagcttgagatcgcgccctccatcctccctgctgacttcggccagctcggcccgacgctccaggacctccaggctgctggcgtcgaccgtgtgcactgggatgtgatggacggcgtcttcgtgcccaatctcaccgttggcgccccggtgatcgagagttgccgccgctggagcgacctcccgttcgaggcgcacctgatgatcgtcgaccccgaccgccacgtcgagtcgttcgtgcgggccgggtgcgagctcgtcatcattcacgccgaggcgacggcccacttgcatcggagccttgggctgatccgcagccttggtgctcgcgctggcgtggccctgaacccgtcgaccccgccgtcggcgatcgagtacgtcatggatctgctcgatgtcatcctcgtcatgacggtcaatcccggtttcgggggccagcgctacctggcgagcgtcgagccgaagatcgcatcgctcgccgcactgcgtgacctcacgaacccgaccaccaggatcgaggtggacggcggcgttgcccctgacacgctggcgggggtcgtcgagaacgggggcgagatcgtcgtgtcgggctctgcgctcttcgcacatccaggcgggctccgagctggcgtcgaggcgtttcatgcgatcgcagaggaggcaaggaagtgaccacgactgtcgagcagcgagccatcaccacggtccggatgctctcgatcgaccaggtcgaggcggcgaactcgggccatcctggccttcccctcggactctcgccggtcgccgtcacgatctttgcgcgcttgatgcggttcgatccgacagatccggcctggcccaaccgcgaccggttcgtcctgtccgctggtcacggctcggcgatgctgtactcactgctccacctgttcggtttcgacctaccgatggatgagctgcgccgtttccggcagctcaactcgcgcacgcccggacaccccgagtacggccacaccgcaggggtcgaggtcacgaccgggccgctcgggcagggcttcgcgaccgcggtcgggctcgcgctcgcagaacagctgcagcgtcacgagacggagcagcgcttcggtgaggcgctcatcgaccatcacaccttcgtgctcgcgtccgacggcgacctcatggaggggatcagccacgaggcggcgtcactcgcgggccatctcgggctgggtcggctcatcgtggggtacgactcgaacgacatcaccatcgacgggcccgcgcacatctcgtgcactgacgatgtgcgcgagcgcttccgtggctacgggtggcaggtcctctcggtcgaggacaccgaagacccggacgccatcgaggcggtctatcgggtcgcgatggccgacgagtcccgcccgagcctcatcatccttcccacgctgatcgggcgcggggccccaaccaagcagggaacgtcgaaggtgcacggtgccgccctcggacccgacgagtatcgggcgaccaaggagttctatggctggcccgtcgacgaggcgttcgtcgtccccgatgacgtgcgcgcatgggccgacgaggtggtcgccgccaagcgtgaggtggctaccaagtggcgcgaacgggctcgtgaggtgggctacgaggcgccctccatccacctcgacccgcaggtcctcgaggcgctcgagttcccggaggtcgatcctgcgaaggccgtcgcgtcccgcgtggcgagccagcacgtgctcgagcgggccatggtggcgatcccgacgctggtcggaggatcggcggatctcgccgagtccaccgggaccaagcttgcgttgcccgtcatcgatcgcgagcatccgctcggacgcatcgtccacttcggcatccgtgagcacgccatggccgcatgtgccaacggccttgcgctctcgggcttgcgcccatgggtcgcgacgttcctcgtgttctccgactatctgcggccaagttttcgtctgtcggcgatcatgggtctcccggtcatctatctgttcacgcacgactccatcggcgtgggcgaggatggaccgacgcaccagccgatcgagcaggtcgaggcgctgaggatcatcccgaacagcgcggtggtacgaccagccgacgccttcgaaaccaacgaggcgtgggcagcggcgctcgcccacacgagcggtcccattgcgttgatcttgactcgccagggtcttgcgcccatgccgaccgcggacgagcctgggtggctcgagcgccgtggtgctcggatcgtgtacggcgccgacgtcgaccgacctgatgtggttctcgtcgcctcggggtcggaggtcaacctgtgcgtcgaggccgcgcacgcgctcctcgaggaggaggggatcgtggcgcgggtcgtctccgtgccgtggcgcgagcgcttcctcgccatcgacgagcaggagcgagaggagctcgcgccgtcggggattccacgcctgatcgtcgaggcgagcgtcgcgaccggatgggaggccttcctccagccgggggaccgcctctacaacatcactcgcttcgggctgtcggctccgatcaaggacgtgcagcgagcgctcggctttaccgcctccgacgtcgccgacgccgccgcagagctcgtcgtggacggttcgttcttgcgtcgtccggtccacctcgtctccgagctcctcgctgcgacggaggccgctgcggttgcgacccaggacctcgtcggcgatggcgatcgctcggcagcagaccaagccgcggtctcggccatgcgtcgagcgctcggtgcgctccctgcgcgggccaccgtgatcgtgggtgagggggagaaggaccgagcccccatgctctacgtgggcgagcgacttggctctggttcggtcgcggtcgatctcgcggtcgacccgttggaggggacgacgtacgcggcgaccggccgggagggtgccgtctcggtgctcgctgcggcgcccaatcgcggcctgcaccccttgccaggctggtacatggagaagctcgtggtaccggccgaggccgcgggagtcgtcgacatcgaggcaccgctcgtcgagaacgttcgacgcgtggcgcaccgtctcggacttgccatctcggagaccccggtggtcgtcctcgccaagccacgccacgaggcggccatccgagagctgcgggccgcgcgggttccggtcgtcgagatcccagacggggatgtgatggcgagcctgcgcgtgctcaccggcgatccccgtatgcgcatgctgtggggtatcggtggcacgccagagggcgtcatcaccgccgcagccgccttggcgctggccggccagatgcaggcccgcctccgcccgcagagcgacgaggagcgatcgatcctcgacgcatggaagcccgattgggaggagcttcgcttcgaggcgagcgacctcgctcatcctgaatcggtcgtcgtcgcctcgtccgtaaccggggcgaccccgcttgtgccaccgatgccgcatgcggatggtttcgtgatcgaaagcctctggatcgagccgggacagttcggcacggtccggcgggtcgtgagcctccggggggaggaggacgcatgatcgatgttgtgcgaaaggaaccgtcaatgtcccatcgagtggccgccatccagaaggcgacggcgcgaggagcgcatccgacgcgcgtgacgatgctcgcgatcgccggagactccgcttctggcaagacgaccctgacgaagggcatcacccaggcgctcggcgccgagcgtatcgcgtcgttctgcaccgatgattatcaccgctacgaccgggaggagcggcgtggactcccgttcacgccgctgcatcccgagtgcaactacctcgacattctcgagcagcatctccagctcttgaccctcggacaatcggtgttgaagccggtgtaccaccattcgacgggcacgctgggtcggccggtgctcttcgagcccaaggagatcgtcatcgtcgagggtctgttcccactgtggtcgaagctgtcgcgggccacgttcgacgtcaccgtcttcttggacccaccagaggaggtccggcgtcgctggaagatccagcgcgacacgggcaagcgtggctacagcgaggaccaagtgctcgccgagctcgagcgtcgcgagcccgagtcggacgcttatatccgtccgcagcgtcgcaacgcagacatcgtgatttcgttcgctccggttgcgggccggaccggcggagacgagacgatgagcgcgaccatcttgctgcgtccgacgatcccgcaccccgacctgtcgtcggtgctcacgggcgacacgcgtgagtcggtccacctgaagctgattcgtgaccaagacggcaagccggtggatgccctccacgtccacggccatgctccgaccgaggtgacccaggtcgtcgaggaggtgctctgggaccacatcgggctcccagggccgatccccgaaccgctcggggtcatcggaccgggcaagcgctcggcgtcactggcgatcgcgcagctgctcctcatctaccacctgatccacgcatagccgggtcgggcgtgtcctactccgaggcgtcgcgcgcctcggagtcggcagaccgccagctcaccgagctcacggcgggttcgaggctgaggcgagagatggcttgttccacggcgaggtcgtcctggccttcggcgacgaggtctgcctcgacgagcacgaggccgggctcatgacgcagctcctggctgcgcacgccgcggagccgaaacgcgccggctgaggctgcttgggtgatgagcgcccggatgtgggcttcggctggctcttgacagacgaccgagagcgtccactcgaagcgcacctcttcggcctcgcgctgcggacgtcggtcgagggtgcgggcgagcggccgtagcccgacgtgggctgcgaggaccgtgagcgcagccagcagcgccaacatgaggtagccagtgcccgtgagggcgccgatggcggccgcgcaccagatcgtggctgcggtgttgatgccgcgcacgttcacgccatcgcggatgatgacgccggcaccgaggaacccgatgcccgagacgatgtaggcggtgaccctcgtgaagtccaccgattcgtgtgccgtcgcggcgatggggctggtggcaaggagcagcgagagctgttcgaagagggcggcgccgagcgccacgagggcgttcgtgcgtagccctgccatgcgcgagcgccactggcgttcggcaccgacgatcgcaccgaacagcgcagcgaggacggagcgcacgaggaaggtccaggtcacccctgggacgaggggagcggcgaggtggcgcatgagggcctcccgaggttgcggtcgggggtagtccaccggtcgagagtgaccacgagctgaacgaaaccttgcgaggcgttgacaatgcgactgcccgtgcggaacaggtcgctgtgttgtctcgtcgatcaccgacacggcagtggtgcaccgtggtccgtgctcctgcggggcggtgctcgtgaacggttcctgcgagcgatgctgaaagcgtttgcatgtcgttcacgtaagcgctatcatctggcctacgttcgctggtatgcgaaccggggaacttggtgggggtcgtcggtcgtgcggtgtgatcagggcgctgggatcgcgcgatgagcgctgctcgcgcgacgatcttcgatgtcgcagccgaagccggcgtgtcggtcgcgagcgtctcccgggcgctgcgcgacattcctggcgtacgtccggagctacgagcgcacattcgtcagatcgccgagcgactcgggtacgtgccgagtgccccggccgcgtcgctggcgtcgcggcgcctcggtgcgatcggcttggtcttcccggacctcgatgatccgtcggtcgacccagggctcgacgaggatcaagagggtcggctctatgccgacgaggtgattcgcggagccgagcgcgctgcacgttcccacggggtcgcgctcctcgtcgccgctacccatcagcgcgaggccgccgagctcgtgcgtttcgtctctgctcgtgtcgacggcatggtgatgctctcacgggtgctcgccgacgtcgaggtccgggccttggcggagcgggttccgctcgtgcagctcgccgggcggagtcggttgcggggggcggacgtggtccgagtcgacaacgagcggggcatcgaggagatcacgcggcatctgctcgtcgatcacggctacgccgacgtccggttcgtcggaggtccggttcgctcgccggatgctcgcagtcgtcttgaggccttccagcgcacggtacggatgctcgggcgcgacgatctggccgagccgatcgcgcgcggagactttcgcgagtcaagcggctggtccatcgcgtccacgctgctcgaacgcggccccgtgccacgtgcgctggtggtggggaacgaccagatggctgtcgcgatcgtgctcgccctccggaacgcgggcctgcgcgtccccgacgacgttgcggtgaccggcttcgacgatacgcagctcgcgcgcctgacctatcccggcctgacgaccgtgcgccagccgatgcgtgacctgggaaggctcagtgtcgagctcctcatcgatcggatcgaaggtcgagccgcgccaggccgcatgatcacgctcccgaccgaggtcgtgcgacggcgtagctgtgggtgcacgtcggcgtcgtggcccggagaactcgtcgcacccagcggtgcagcggagccggtgacgagcacggtcgggacggcgatgagaggagcccagtgaaagcccacggagagcagcaggacgcgacccgggcggtactcgagcgctgggaggagggaactcgtgagcgacgtgtcgacgagcacgttggtcaccttcctcccccgacgggcgtcgaggcctggcgtggctcgggctgcgtcaccatcacatggcagcgtgtcgagggtgcggtgtgctatctcgtcgagcgggcgccgagtccggacggtccgtggacggtgcttcggcgcgccgagcacgacctcgtcgaagtcgctgggcctccaacgctggacacgagccgggaggcgggcggttggtaccgggtggcggcactcgaagatgtgggtcgtcgtccgacgtcgttctccgatccggtcgaggcgcgcgatggcgaccgcagcgcagcggtgacggtacgggtcgaggcgtcgtccccggtcggctcactcgcgcccgtgtggtggatggtgggctccgagcggccagggcagctgctccttcgcgacgacggcttcggtcatgacgttcgggccgaggtgctcgaggcctatcgccgggccgcggcgatcggcgtgacgcacgttcgggcgcactgctggctcgatgacgcctttgggatggtggacgcgtctggtcgcctgaccgagacgagcgcgctcgacgaggtgctcgatctcgtgctcgccagtggtcttcgcccgatcgtggagctgtcctttacgccatcatccctggccacggatccagcggcaaccgtgttcacctatcgggccaacgtgtcgcctcccgctgacctcgttcgctacggcgaactcgtggcgcaggtggtgcgccacatgatcgagcgctacggcgccgacgaagtccgcgagtgggcgttcgaggtgtggaacgagcccaacttggccgtcttctggaccggcgacatggctgcctacttcgcactgtacgaccgggtcgcgagggcggtgaaggaggtggatccggcgctacgtgtgggaggccccgcaaccgcgggaagcgggtggatcgcgccgttcctcgacttcgtccacgagaccgatgcgccgttggacttcctgtcgacgcacacctatggcggtatgcctctcgacctgcgtgcccagcttgcgcgcgtcggtcggggggacgtccccgtgtggtggaccgagtggggcgtgtcgccgacgcaccacgcgcgggtcaacgacggggcctttggtgcgcccttcgtggtgcgcggcatgaaggcagcacagcagatcgcagctgccctctcgtattgggtggtgagcgaccacttcgaggagctcggcaggccggaacgcctcgccgcgggaggtttcgggctgttgacggtcggcaaccttccgaagtcgcgctggcacgcgctcagtctcgtcgctgagctgccttctcgaatcgtggcgaccgaggtggagggcgacggtgctggagcactcgtggacgggtgggcgggtgccgatgcggagcgggtcgacgttctcgtgtggaacggctcgcacgatgcggccgacgccgagggtcgcggtgacctcgatcggacggtgactgtgacgctcgaagggctcgaggacggcgagtggctgctcgagctcacgcgcgtcgatcgggatcacgcttcgttcctcgaggcgatcgcgggtgaggacccatggcctgggcccgaggccacggcggccctccgggagcgcgcggcgctgcgggtcgagccggctggccgaacctccgtcgtcgacggggggcgcatcgagatgaccgtgcgcgtgccgatgcccgggttggtgcggctcagggcacgccgcgcgaggagttgggaggcctgagggtcgaccaacgcgagggccagggcccgcggcgaacggcgtaagagtttcgaccgcgggacctggcgtgggatagacaaagggggatcatagtgagtggacaggtagctcgctggaggactggtcggcgatcgcggccgatccagggattgatggtggggctcgcgggcgccgcggtgctcgcggcgtgtgggtcggcatcgacgtcgtcggcgtcctcgacgacgaaggtgtcgccgacgctcaccatcggggtcgacaacggctcgccgaccctgcaggacgatttcaatccgttctcgggcaaccagcgcatcggcacgacctacatgtacgagccgctggcctgggtcaacccgctgcaagggacgacggtcccgctgctggcggcgtccgagcacttcaccaacccgaccacactcgtcgtcacgctgcgcagtggaatgaagtggtcgaacggagcgccgatcacgccagcggacgtggtgttcacgttcgacatgctcaagcagtacccggccctcgacggtgcggggatctgggatcacgtgtcgtccgtgacctcgagcggctcgacgatcaccttcacgttcaccgcaccggatgtgccgttcgcccagtcgatcctcgagacgccgatcgtgccgaagtcggtgtggtcgtcggtgtcgaatccggtgacgttcaccaacacgaacccggtggtctcggggcccttcgtgctgaagtcgttcaatccgaacgagtacgtgctcgcgaagaatcccgacttctgggacgcatcgtccgtcgaggtcaagaccatcaacttcccagcgttgacgggcaaccagacctcccagctgacgctcgcacaggggggctacgattgggcgacgctcttcatcccggatgtccagaaggtgtgggtcgccaaggatccggcaaccaacaagtactggttcccgagcggcggtgagatcaccctcttcttgaacctcgcgaaggcgcctttctcctccgtcgcgttccgccagggcatctcggcggctctcgatcgttccacgatcgcgacgaaggcagaggacggctacgtgccggttgcaagccagacgggactcttgctgcccaacctgaagcagtggctcgatcccgcgatccccaacagcggctacgtgagctacgacccaacggcggcgctcgccgacttcgcgaaggctggctaccacctcagcggcggcaagctgaccggtccgagtggtgccgtctccatgtcgatcatcgtcccgaacggcttctctgactggatcgaggcagcccaggtgatcagccaagagctggcgaaggtgggcatctccgtgacgctccagacgccggagtacgccgcctacgcgagcgacctgtccacggggtcgtttaccggagccatcggtgccttcggcggtacgggcaacccgtacaacgacctccacggcctgctcgcggcgtcgctcgccgcaccgctcggacagacggcggcctcgaactacgagcggtgggtcaatccgacgacggagacctatctgcacgcgctggctgccgcggtcacgacgagcgcgcagcgcaacgccgtctacgggctcgagcaacagatggtgaacgatgtcccggtcgtggtgctctaccaaggggcgatctggagcgagttctcgacgaagaacttcgtcggctggccgtcggcccaggacccgtacgcgccaccgcagccctacggtcaagcgccgctggtcatcatgacgcacctcaggcttcgttagtcgtgttcccctggggccgccaccgacctcggtggcggccccctcccgaggaggtagctcgtgcgctacgtcgtgcgcaggctcgtcatcttcgtactgacgctctgggtcgccctcacgctgaactttctcatccctcgcctcatgccgggcaacccagctcaggcagcgctcgccaagttggcggctcgcggaccggtgagccctaccgagctccacgccatcgagctcaccctcgggttgccccatggctcgttgctctcgcagtacggtgggtacctcgttgccctcgcgcatggacaccttggcgtctcttacacgttcttcccggagtccgttcgctccctgatcgctcaagctctgccctggacccttggcctcgtcggtacgaccactgtgttggcgttcgtcgtcggcaccttgctcggtgtgcttgcggcctggcgccgaggcggcatcatcgacaccgtcgccaccgtcggctcgacgttcaccgcggccttcccgtacttctggaccgcgctcctcgcgctctacgtgctcggtttcgtgctgggctggttcccgatccgaggtggctacgcctccacgctcagcccgacctggagcctcggtttcatcgtcgacgcggcctaccatgcgatcctgccggccgcgacgatcctcgtctcgagtcttggcggctggttgctcggcatgcgcaacaccatgatcccgaccctcggtgaggactacgtcacgttcgccgaggccaacgggattccctcgcggacggtggcactgcgctacgccgcgcgcaacgcgatcttgccgaacgtgaccggcttcggcctcgcgctcgggttcgtcgtgtcggggtcgttgctgaccgaggtggtgttcggctatccgggcgtgggatcgttgctctacaacgccgtcgtgaacgaggattacccgctgatgcagggcctgttcctcgtcatcacggtgagcgtgttggtcgccaacctgatcgtggacctgctctacggcgtgctcgatccgcgggtgcgccgatgagcacgcccgtgacgagcgcgccggcaccggctggggcagaggctgcggctccggtgcagtcggggtcgagggcgcgagcttctctcgcgcggatcgtcggggcgctctggtcgaacgtgcgagctcggatcggcatcgtcatcctcctcgccttcgtgctcatggcgctcgccgcaccgctgatcgcgccctactccccgacggcgacgtcgtttgccgactccctgcccccgagcgctgcgcatctgctcggcaccacctcgagcggccaggacgccctctcgcagctgctctacggagcgcgtacctcggtgctcgtggccttcgccgccggcggcatctccaccgtcgtcgccatcgtggtcggactgatcgctgggttctcgcgcgggatcgtggacgagaccctgagcttcgtgatgaacgtgatgctcgtcatccccgggcttccgctcatgatcgtcatcaccgcctacctgccgggtcgaggtcccggtgtgatcatcgcggtcatcgccctcaccgggtgggcgtggggagcgcgcgtgctccgaagtcaggcgaagtcggtgagcgcccgtgacttcgtgctcgctgcacgcctggccggagattcgtcctggcgcatcgtgttccgcgagatcctccccaacatgacgtcgctcatcgcggcgagcttcttcggcgcggcgaccgccgcggtgctcgccgaggccggactcgagttcctcgggctcggcaatccgaacgccgtgagttgggggacgatgctctactgggcggagaactccaatgcgttgctgacgggccagtggggcgtcatcgtcggtccgggtctgtgcatcgcactcctggcctcctcgctgtcgctcatcaacttcggtgtcgatgcgctctcgaatccccggctgagggagcgcgcatgagcttgctcgaggttcgcgatctcgtcgtcgattaccgcatgggcacgaccgtcgtgcacgcgctccgaggcgtctcgctcgaggtcgacgagggccagttcatcggcgtcgtcggtgagtcgggctgtggcaagagcacgctcggcaccgcggtcgtcggtgtgctcggtccccctggcttcatcgtcggtgggtcgatccgcttccgcggtgtcgaactcgtgggtctcgacgccgcccagcggcgggccctgcgccatcgagggctcgcgctcgtcccacaggccggcatgaacgccctcaatccggtccgctcgattgaggggcactttcgagacgtgctcgccggtaccggtgttcgtcaccgagcagaggtccgagctcgcgccgtctccctgctcgaacaagttgcgctcgcgccgtcggtcttgcgcagctatccccacgagctgtcagggggcatgcgccaacgggttgcgctcgccctggcgctcgctctggaaccccagctcgtggtcttcgacgagccgacgacggcgctcgacgtcctcgtgcagcgctcggtggtcgataccatccgatcgctgcagcaagcgaggggcttcgccgccatcttcatcagtcacgacatcggtctcgtcgcgagccttgcttcgcgagtggacgtgatgtacgcaggtgaggtggtggaggcgggaccaaccgagcgtgtcgtggcacgaccgctgcaccgctacaccgaggcgctgctgggctgctacgccgaccctcgggcggaggaggtcacggtgcgtggcattccggggagcccgccgaacctcgttgcgcagatcgaagggtgcgcgttcgcgccccgctgtggcgtcgcgagcgacgagtgtcgttgccccctgccgacggtgacgctcgacgaccagtgggcacgctgcgtgcatccagccgtggcggtcgagggacggtcccgatgaccgaacggctcgtggtcgacggggtctcgaagtcctatcgaggggagcggcgtcacgagacgatcgaggcgctccgagacgtctcgctcgaggtcgccccgggtgggtcgctggggatcgtcggccagtcgggaagcggcaagagcacgctcgcgcgcctcatcctcggcgcggagcgcccggactcgggcagtatccgactggggaacgtgcgcgtcgaccagctcgaccggcgggggctacgagcgcactggcggcgcgtgcagctcgtgttccaagatccctacgcggccttgaatcccttgacgagcgtgcgcaccgcgctcgaacgtcccctcaccaaccaccgtcacctccgaggcgccgagcgtgagcgcgcgctcgccgagctcctcacgaccgtcgggctggtgccagtggagcagttcgccccgaagctcccacaccagctctcgggcggtcagcgtcagcgcgtcgtgatcgcgcgtgcgctcgcagcctcacccgaggtcctcgtcgcggacgagccggtgtcgatgctcgacgtctcgctccgtgccggcattctcgagctgctcgcgtcgttgcgtcgcgagcgcgggatctcgctgatctacatcacgcacgatctcttgtcggcacgggtcgtcaccgacgagctcgtcgtcctccgcgagggagcgatcgtcgaacgcggccccaccgtgtcggtgctgcgccagccgacgtcggcctatacgaaggcactgctcgatgcggtgccggtgctgccgaggagtacgcaagcgtcgacgtgagctcggccatcgtcgcgtacagtgacggaggatgactcgaacccagctccggagcctggtcgccgtcttcgaggcgggctcggtcgcgggtgcggcgcatcgactggtcgtcagcgccgctgcagtctcggcggcggtggcctcgctcgagcgggaggtcggtgtcaagctcctcgagcgggtgggtcgcggtgtgcgcctcacacctgcaggcgaggtgctcgtcgactatgcacggcgcatcgaggggctcgaagaagaggcgctggtccgcgtgcatgagctcgccgacgccgcaggcggggtcctacggatcggggcggtcgcaacggtcggggaagagctgttgccgcggtggctctcggtgttccgatcggcgcggccgaaggcgagcgtccacctcgaagtcgccaacaaggcgcgactgctcgagcggctccgtacgcatcggctcgatctcgtgatcgcgggtcgacccggacacgaggccggtctgcgcatcgtcgcgacccgtccgcacgagctgctcttgtgtgccgccgcaggctgggcgcgcgagtggttcggcccctcgctcgaggtgactccagagacggcaagcgcagtgacctggctcgtgcgcgaagagggatcgggcacacgtgcctcggcagaggaggtcctgagcgcgctcgacatccatccgccatcgctcaccatcggctccaacctcgcgatcaagcggggggtggagctcggtctcggcgtcgccgtcctgtcgagcgatctcgttgcacgagaacgtgagcagggcgagatcctctcgctcgcgctggggccgctgccgtcggtccggcgttggtgcctggtggtgggccccgaggggcccccagagccggtccgcgccttcgtcgcccagctccaggcgatgggggagctcgaaatcccccctgcgctcacctgaggggcgggtgggcgagcctccctgcccgcgtagcgtgctggcagcgcgtcgtccagtgggtcgacgatgaccagggcgcgccacgattcagtctcgagccgaggaggcgttgtggacgacattcgcacgatcgctgcggccatggtggcacgaccgaagggcattctcgctgccgacgagagcagtccgaccctgaccaagcgcttcgacgcgctctcgatcccatcgacgccggagagtcgcctcgcctggcgggagatgctcttctccacgcccgagctctccacgtggatctcgggggtcatcctctacgacgagacgttcaaccagcgaacctccgatggttcgacgatccccgagttcctcgccgcccgtggcatgatcccagggatcaaggttgataccggtgccaagccgctcgctggctcgaggggagagctcgtgacggaggggctcgatgggcttggttcgcggcttgcgacctaccacgccaagggggcgcgctttgccaagtggcgcgcggtgatctccatcggggacggtcggccgagttcgatgtgcgtcgccgccaacgctcacgcgctcgctcgctacgcgaagctgtgccaggagaacggcatcgtccccatcgtcgagccggaggtcctgatggaaggcgatcactccatcgaggtcaatgcggccgtgacccgacgcgtgctctccgaggtgttcgccgaacttcgacgcttcgacgtcgacttcgagggcatggtgctgaagccgtcgatggtcacgcctggggtgcttggcgaacccgtgagcgtcgacacggtcgcacaggcgtcggtggcggtctatcgcgacagcgtgccggcctccgtcgccgggatcgccctcctgtcgggtgggcaggcagacgacgtcgcgaccgcgcacctgcgcgcgatgaacgccggagcgacgttgccctggccgatcacgttctcctacggacgagcgctgcaggacctgcccatgcgcatctggcgtggtgatgcggccaacgcggcggcggcgcagcagtcgctcgcgacgctcgcggcggcgaacgctgccgcggccgaaggccgctaggtctgcgacgctgtcgctgtaggctccagagccgtggagcgtgaggcatcgtgtgaccccgtcgtgctcgcatcgttgctcgcgcaggtcgacacgctcgaagcggaggtcgaggccttcctcgaggtcctgcacgccgagatcgagccgacgcgtacgctgcccgatccgcggcagcgtgtgtccgagggggcgagcgagacgaggcctgagcgtgcgggtctcgcttgaactcctcggtccggtccgcgaggcgatcgggtccagcgtcatcgaggtcgcgctcgagcccgacgccacggtcgcagacgtggttgaggagctggtcgagcgtgctggcgagccactgcgtggcctgctcgaacggtgtcgctttgcgatcggcgatcgcgtggtggacctcgacgagcctctcgccgatggtgcgaccgtcgtcgtgatcccacccgtcagcggagggtcgtgatggccgtgaccatcgtgctcgtcgatgaccaccaggtgatcatcgacggggtgcgtgccatgcttgcgccctacgccgaccgggtcacgatggtcgggtcggcgaagacgcgggccgagctgttcgaggtgctcgagagcgtgcaccctgatctcatcgtgaccgatgcgaggctcaccaacgactcgggcttcgagatcctcgaggacctccagcgacgtggcgtggcggtgcccgtcgtgttctacagtgcctatgacgacgaggcctacctctttcgtgcgttgcgcgccggtgcgcgaggctacctcctcaagcaggcctcaggcgaagagctcgtagggatgctcgagcgggccgcaggtggcgagacgatgatcgatgctgcgctcgccggcagagtagccctgctcgcagcccgcttgcagttcggtgagttctggccgggagcacacctcggactcacgcagcgcgagagcgagatcctcgatctggtggtcaaggggctctcgaatcgagacatcgcgcagcgactgttcctgggagaagagaccgtcaagacgcatctgtcctcgatctatcgcaagctcaaggtcaagggacgcgccgaggcgatcgcggttgccctgcgcgaagtgcggttccgatgagtgcgcgtgagctgaccctctaccgacgtcttgccgagctcttggttgcgccactcgaggtcggcgaggtggcgagccgcaccgctgcgctcgtcgtcgaggcggtcgatgcgagcgtgtgcttcgtgcacgccgtcgatcacgagcgcgggcgcctcaccctgatcggggccaccccgcccttcgatcgagtcgtgggtcgcatccagctcggcctcggtgacgggatcgcaggatgggtcgctcaaaccggtcgtgccgccgtggtgcccgacaagtgggcggaccaccggtatcgctatatacccgagctcggtggggagcacttcacctcgctggtgtcggtgccactcgctcgcgacggaaggccgaccgtcggggtgctgaacgtgcactggcgcgaggcgatcgctgacctggagcacgaggcttccgtgatcgaggcggcgggtcgattcctcgtcggggcgctcgagcacgcgctgctcgcagaccagctcgtcaccggtgaggccgcgctcgagcgtttcgcgacggaactcatccgtgcccaggaggccgagcgccgtcgcgtccagctcgacctccacgacggcgtcgcccagtcgctgcacgccgcggcgtaccgtctcgaggggcttcgagccagcgcaccgccggcgctcgcgtcggagctcacggtggtgagggacctggttcgcgcggcgaacgccgaggtgtcacggctcgtgcgcgacccgggacgtcaggtgctcgaggacttcgggctcgccgaggcgctccagtccgtcgcacacggctatcccgacctcgaggtccaagtcgacgtcgagctcgacgatctgacgctgctgctcgagcccgagcgggggctcgccgtcatgcgcatctgccaggaggcactcaacaacgtcgcgagtcacgccgcgaccgacgctgccgaactgcgcgctcgacgcgtcggcgacgacttggtcgtgaccgtacgcgatcgtggcgtgggtttcgagcccgaggcaaccgtgcccggtcgtctcgggctcgtcgggatgcgcgagcgcgcgcgcctgctgggcggaaccatcgagatcttctctcgcctgggtgaaggaacgctggtccgtctgcgtgtgccgatcgtgccgtcggtcgcgtcgtcctaggctgagtgcgctcaaggcgccatgctggggcagagtgacaggggcagctcgtgagccgtggaggggacagttcggcgctaccgcctgagctgtggcaacgtgcgagccgttacacctggatcgccacggcactgctcctgccgaccatggtgcccgccttcgtcatcggtgggtgggcgctgcgggtgtcggacgcctcgttcgcgctggccgcgctggtgggatggctcgcgcgtcgccgactcggtctcggggcaaacctccttgtcacgaccgtcgcgagtgcaggcgccctgctccagctctcggtgccggtcgatgccgtgacgaccttgatcgcagcgagcgtcatccgctccaccttgctcctctttgccggggtgggcgtgtacgcgatgagcttcatcggcgggcgggtggggctcgcgttcgccggcgtgctcctggtcgccacggccctcgtgcacccggtgggtttgctcggcgcggtgctcgccctggcgctcgccgccctgctcggctacatgatccacgggctcgtggagcatcttgcccatcgcgagcgtgagctgagtgctgctgcgctcgtcgatccgctcaccggtctcggcaatcgacgggccctcgagcgtgcgttcgacgtcgccgtggccgaagccgcacgacaggacaccacgctcttcgtgtcgctgtgggacctcgatgcgctcaagcgcaccaacgatgaacgtggtcacgaggccggcgatgccctcctgcgggacttcgctgcggcgctcacgcggacgctccacgatcaagaccaggcctttcgtatcgggggcgacgagttctgctgcttgcatctcggcttgaaggacggcgcatcgatcctcgcgcgcatggcactcgcgtttccgagcgtctcgggcggctttgccgaggttggcaacgactcgctggggacggcgcttgctcaggccgatcgcgccatgtacgccgcgaagcgccgtcgtcggcgccacgacggctccgacggctgagcgcgtgctaaactcgacacgtccatacggatggacgtcaccgcggtcgtggaaggcgtggcgccttctccccgttcccggcgtgttcgcgctggtggtgatgccgtatggcgccacgtatgacagaagctcatggatgggcgcagtggcgacgagctgctgcgacgctggcgctcctcgtgagcggtggctttgtcgcgcgttggggctcgacggccccgtcgtcgtccgtgcagtcgctgcaggctcaggcacaggttatcgaggcacagcttgccaacctgggggcctcggtgcatgccatcacggtgcagatccaagagactcaggccgcgatcgcggccaacgaggcctctgaggccatcctcgaggggcagctacgagccgagcacgctgcgatcgcgcggtcgcgtcgagtcctggtgacggccgctgatcagcagttcgtgacggcaggccaatactcgagcgtgttggcgtcgctgcggtcgaactacagctcggtcgggctgacgcagggctacgagcaggtcgcttcctcgtcgatcacccaggcgctctcggcctacgagcaggccggtctcgagatcgaggtgacgcaggcagcgctcgcggcgcgcgttcgggcaaccgaggccgagctggtgcaggatcaggcgcaacgcgctcagctcagccaacgggttgcggccaccgaggccgaactggcccaggtgcactcgcagctggcctcggccatcgcggctgaggcggcagctcccttgccggctcccggcggagcggcccaagccgtccaggtcttgctggctccgccgccgccctcgccgacgtcgctgtcggggcccgcgaccgccgcgcagctcctcgcgttgcgcgactgcgagtccgggggcaactaccaggccgacaccggcaacggctactacggtgcctaccagttcgcggccagcacctgggctgcgctgggttacggtggcctgcccaaccaggctccgccagcggtgcaagaccaagccgccgagcaactgctggctcgagctggctggggtcagtggccggtgtgctccgtcctgatcggcatgtaacgccgatcgttgcgccacgagccgaggcggccccgggatcgctcccgtggcgccgatcggagcgcgcgccactacgtcatggcgtgcgccccgaggaggctctggcgtgcggtcgcgtcatgctcgctgggttcacgcacccgtggtggccgactcggcgagaagctctggaggcgtcgaatcgagcagcgacaagatggcggtggcgagggcgcgggcgcttgcgacatcgagctcgagcgcactgaggcgcctgaggccggtggcctcgcgagcgaagacgtcgatgttgagcgaatgggtcgctgggaacgccacggggtggtcgaagtagacggtcgcctggtcgacggcctcccagccctccggggtacgtgcgcgccccgtgagaggggcgtgttcggtcgcgtaggtgcacatggctaggcgagatgctcgccgaggaagcggaagatccgctgccaaccgtcgttcgctgcttcgggtcggtacgagggtgcagcggtgttgaagaaggcgtgcccggcaccgtcgtaggagtggaactcgtgcgccttgccgagtcgggtgagctcttcgtcgagtcgacgtacctcgtcaggggctgggaacgagtcgtcgttgccgaagaggccgaggagcggggcgtggagctcgggagctcggtcgatgaccggacgcaccctgaccggggctccctcggggggctcgttcaccacgaaggcgccgtagcagtcgatcgctgcgtcgaaggggatcgcgcatgccgcgaggaagctctgtcgaccgccagaacagtagccgatcacaccgaccttgccgttggcgctgagggcggcacggaggtagtcccgtgccccggcgacgtcgccgatgagacgctcgtctggcaccccaccctgggcgcgggcgatggccgcggcctcgtccggagccgcgttcggagcctcgcgccagtagaggttgggcatcagcgtggcatacccgtggcgagcgaagcggtaggcaatctccttcgtcgcttggtcatagccaggcatgtgatggatcacgaccatcgagccgtggaccgtcgcgtccagcggtcgcgcgagaaacccctggacgaggtcgccgtccgcgccgcgaaacaagatctcctcggtgaggacacggtgctccatgcagactccctgtgtgcatctgggtggtcgaggccaccggtcgagttggagtagttgtaccttaccagcgactgggttcggcgtcgccacaggtggcaggccggggtgcgatgaccgacggcgaggcctcgcgggcggagtggtggtccctagtgctcgaccgagggcgaggcgacgagctcgaaggcgtcgaacccgacggtcggggccgctgggcgttgcacgaagccggcggcgaggagggctcgagccgagggggtgttgtgtcgtgcgacacgcgcgacgatcacctcgacaccaggctccgcgctcagcgtcgccgtgaggctgaggatcgccgccgtcgcgatgcctcgcccccgttcggatttgatgacgtcgtagccgatctcgacctcaccgttgatcgggttgccgtgcgcgccgatggagccgacgacgacgcccttggcgaggtcgacgatcacgaacgggccgaacgggaactcaggcccgacgcccgcctcgtggagctcgaggaagcgctgcgcgacgcctcggtcgatgtcgtcggggaagtccggggcccagtcgggagcgcgttccgccgtcgcgatcgctcggaggaggtcgacgctacaccagcggagctcgacggcggcacgatccatgcgttcggatcagtggaacgtcaagacggtgatggtgccgagcaggaacagcacgccgctgacaccgtagagcagcgacttggtgatgaccttggtcacggggcggtgcacgtagtcgttcacgatggtccgaaggccgttaccgccgtggagcagaccaagggcgaggaggagccagtcgaacaggcgccagagcggattcgaccagcggtgggcgacgaacgccacggtggtctgggtcacgtcgttctcgatgtgcatgatgtacatgtggatgagggccaggaagaacaggacgatcccggacacccgcatgaagagccatgcccaggtctcgaagttctggcgaggtcgtcgtgcgctccgaggagtggcgaagacggccatgtcagtgcacccccacgaagaacggcttgacgatgtagtagccaccgacgatcgtcagcagcacgctgagtccgagcatggcctggaagagcgctcgttcgttgcggacggcgcccgggaagaagtcgatcatgatcactcgcagaccgttcagcgcgtggtagaggagggcgaagagcaggccgacctcgaacaggcgcaggaagatgttgccgtagagctggtggatctgttcgtagacgtgcgggtcgttcagcgtggcgacgtcgacgatgtggagcaggatgaacatgaagacgaggaagccggtgacccgatggaggatgaacgcccactggccggtcttgcctcgatacatcgaggcgcgcgctcgtactgcgcgccctccagccggagccggcgtcgctggcgacgtcatgactgcctcctgaaccaccgggtgctgcgggtggtcgtcgcgacgacgtaggcagcgaaggcaacgatccccaacgcgatcagaccgagggcgatggagaacaggatctgggccagactgacccccgaagagctcacactcatggcgcttacgctagcgcccgctcggtgttggtcgaaatcacggcgatgcgtccttgtcgtgggtcaacccagctcgccaccggccggggctgtcgtgagcgtccttggcgatgcagtcgggctccgtcgtgagtggtgcgacacgacctgcgatcggtggggcgctggctcaagcggtcttgggtgcctcgagcctcgaggtgccgaggtagggggccagcgcatcgggcaggcgtatcgacccatcgggttcgcgaccttgctcgaggagggcagcgatgacgcgtggccacgcgagcgccgagccgttgagggtgtgcacgtactctggccgcgccgccggctcccggcggaaccgcacattggcccggcgcgcttgatagtcgctgaaccatgacaccgaggagacttcgagccacgcgtccacaccgggcgcgtagacctcgaggtcgaaggtgcgggcggacgactgtccgaggtccccagtgcacaggtcgacgacacgatagatcaggccaaggcgctggagcagcgcctctgcccgaccgagcagctcgaggtgcatgctcgtggcatcctcgggtgcgacgagtgccaggatctcgaccttgtcgaactcgtggagacgcagcaggcctctggtgtcgcgccctgcggaccctgcctcgcgccgatagcacggggtcgcggcggtgaggcgcatggggagcatcgcaaggtcgaggatctcatcgcggtagagcgacgtgagcggcacctcggccgtcgggatcgcgtagagatcatcgcgctccatcacgtaggcgtcgtcggcgaacttggggaggtggcccgttgccaccatcgtctcgcgacggaccagcgtcggaggatggatctcttcgaaggcctctgcgtgggcatcgagcgcgaagttcgtcagagcgcggacgaggcgtgccccgaggttgcgatagagcgcgaacatcgatcccgagagcttcgctgcgcgctcgagatcgagaatgccgagctcgcgaccgatctcgaagtgcggtacgcgacgatggctgggtgtggtggacgtgagatcgacgtcgggctcgaccgtgccggtctccggcgaccattggcgtaccacacggttgtcgtgttcgtcctcgccgatgggtgcgttcgggctcgggatgttgggcaaggtcagccagatcgcgtcgcgatcgccggtcaaggtgtcgacgcgctgctcgagttcgtcgagccgattaccgagcgctcgggcgccctcttgcagctcggtcgcgtctcgaccgctgcggcgagcctcggcgatgtcgcgagagcgggcacgcagctcggctcgaagctggtcacgctcggtgatcaccgctcggagttgctgatcgatcgtggcgaggtgggcgaccacctcggggtcgatcccgcgggacgcgaggcgccgtgcgacgtcgtcggggtgggcgcgcagctccgtgaggtcgatcatgcagccttagactagcgatgcgatggaggatgctctcgaggtccacgacctcgtcgtgcgctacggctcgttcgaggccgtccgcggcgtgtcgctgcacgtcgctttcggggaggtcgtgggcgtcctcggtccgaacggcgcgggcaagacctcgaccgtcgagacgttggagggctaccgacgggcggctcgtggcgaggtgcgcgtgctcgacgtcaccgatccgtggcggcaccagcgcaccctcgcgcgtaaggtcggcgtgatgctccaagagggaggcgtcccgccgcggatgcgggccctggaagccctcgagatctacgcacagttctacgacgatccctggcccgtcgctgagctcgtcgatcgtctggcgctggcgcccgttgcgacgacgccctttcgtcgactctcgggcggcgagaagcagcggttgctccttgccctcgcgatcgtcggccgtccacgggtcgtcttcctcgacgagccgacggcaggcgtcgatccggtcggcaagcgcgccatccgggacttggtcgccgagctcgccggatcgggcgtcgcggtgctgctcaccggccatgagctcgaggagatcgatcgcatggtggatcgggtgctgatcatcgaccacggcatgcccgtcgccgccgggagtcccgcagagcttcgggagcgcttcggagaggccggggtcgagttcaccgtgcgaggcaggctggacccaagcgtgctggcggcacgactcggggtcgaggttcggctcgttgccgaggatcgggtgcacgtcggggcttcgccgacccctcagttggtcgcgtcgctcgcggcggtgctcgacgagctcggcgccgaggtcggtccactcgagacggtggagtcgtccctcgagtcgatctatctgcgcctgctggaccgcggggagacgacatgagtgcccatccagtacgcgcccaggcggtgtccgagctcaagctcgtcctccgccaaggcgaagccgccctccttacgatcgtgatcccgatcctcggtctcgtgttgttttccaaggtcaaggtattgccggtgcctggcggcatctcgcgcgtcaacttcattctcaacggcgccatcacgttcggcatcatggcttctggcatggtctcgcagtcgatcaccgtcgccttcgatcgttcctacggcgtgttgaagcgtctcgggatgacgcccctcggacgcagtggggtgatcgccgcgaagctcgtggcggtcgcaggactcgagatcgtcgagttggtactcctgctcgtcgtgggggctgtgctcgggtggcacccagctggcaatcccatcgagttcgtcgtcggttgggtgctcgcgaccgctgcgttcgctggtgtcggtctcgtgctcggaggaacgttgcgggcagagctcgtgctcggattgtcgaccctgctctggctggtgctcctcggtctcggcgcgatggtggtgccgctcgggagtctgccgggcccagtcgccgatatcgccaaggtgctcccagcagctccggcggccaccgtgctgctccatggcatcgctgtcggcgggagcgcgccactgtgggcgtgggtgagtctcgtcgcctgggcagtcgtcgcaccggtcgcggcgtctcggctgttccggtggagcgcctgagtatccgccaagagcgggccgtcgaagcgtcggtaggatagagccatgcatcccgtcgtcgagcgagttcggtcggccgtaccggtctcgccgcaagtcttccgacgtgtggcgctcgccacgctcggcgtgtcgacgttcatcatcttcaccggcggcgtggttcgtctgacgcagtcagggctcggctgcccgacctggcccgactgcacgaccggccacttcgtggcgggcttcgagatccaccccatgatcgagttcacgaatcgggtcgtcacgttcttcgctggcctgctcatgtccttgacctgggtggtggccctgttgcgacgtccattccggcgggacctcgtgtggtggtcgctcggtctcgtcgtcgaggtcgtcgccgagagcgtgctcggcggtatcaccgtgctggagaagctcgcaccccccttcgtcatggcgcacttcttgctcgcgctcgtcgtgctatggaatgccgtcgtgatctaccacaaggccggccagcccgagggacgcccaaccttggcggtctcgtccgaggtgctgtggctgtcgcgggtgatgttcctcgtcctcggtgcgctcgtcttcgtcggtacggcggtcgcgggtaccggaccctactccggatccccggggagcaagaggctgcacatcctcaccatgctgcaggtgacctacctgcacgccgacatcgccctcgtcttcattgcgctcacgctcgcggacctgttcctgctccaccaggggcgctaccccgcacagatccagcgtgcggctcggagcatcctctggctgggcgctctccaaggcatcatcggctacacgcagtacttcacgggcttgccgcagtggctgatcgcgctccacatccttggtgcagcggtcatctggctcgcgatgaaccgctactacctcttgctgttccgcgtgccctcgacgcgcagggcggaccacgcggtcgcgccgcagcaggcgccttccgtcgcggctgccgactagcgatcgcgacggacgctagccttggtggtgttcgtctcgggaggtgcgtggtcgatgtcaccgtcaccagcccttgcgccggtcgagtccgaagaggtagccgagactcgcaccgaagagagctgggcgaccattctgtgggatgacccagtgaatctcatctcttatgtgatctatgtgctgcaggccaccttcgccttctccaaggtcaaggcgaccgagctgaccatgcaggttcacaacgagggcaaggccatcgtggcgaccgggtcgcgcgaggacatggaagatgcagcgtcaaagttgcatgcctatggcttgtgggccacggtgtcgcgcgcgtgagtgccgggccgttcgtccgtgatggcgacgtcgtcgtggtggtgctgtcggcgcaagctcgagatgttgtgagtcggagtctcgagctcgtcgctgggatcgttgcgtcgggacgcgaggaagcctggcgggttgctccgccgctctacgacgacccgttgctcgaagccgaggcgtcgctcgcgagccgaggtgatgccggcggcaccctcgatgaggcccagtcgctcatcggtcgttgggcgaagcgtgtccgcgacgtcgagcgcctcgatctcgacgcggctgatgaattcatgcgcgcgttgaacttcggtcggctggtcctcgcggagacccgaagcgtcaccgatgatcgaggactcctcgacctgtttgcttggctcatcgaggcactcgtggaggccctcctcgagggttgacgcaccctacccttgcgtcgtcacgctggacgagcgcaccgcacgacagtagggatctcgcacgtcgacgtcgacccgcgcggctcggcgtggtcgtcgagcagcgcggcctcgggcgtcgtggtgcccgaggccgtccctgcgacgcggccgctcagtcgccgagctctctcgggatcgcggtctggaagctgcggaacagctgcgtgaggtccgcgtagccgaggcccgatcccggattgaacacggcgccttgggagccggtgtagaagtcgttcgtgttggtgaactcaccggagatcgcaagctgggcgttgccgatctggccgctgtagtaggccgagccgtcgatggtgttcgaatcgagcggcgtgaacggcgacgacgtcgaggtcgcgaagcggtagatgttcggattccagaagccgagccgtacgcccccgagggcgctctcgtagacggcgtcggtcccgttgagctgaggcgcgatgaagctcgtgccaccgaagtccaccagctttgacccgtagacgctctggaactgtgggtcgtagaccgcatagccggtctgggggtcggcgttgaacgccaggtccggcgtgacgcggccaccgctcatgcccgtctgaagcgtcggggcagggttgaacgagaactgcgtcggctcgacgaggcctggtgcgacctgctgtggatcgatcggcgtcaagaactcataggccgagtagctccctgcccccaccatctgaccctgttggtagagcggacggccgaagagggtggagtagccaccgcctgatcccaccggcaagctcgtggctgcttgggcctcgttctggaagccgagtgcgatgtacatcggccacaggtagtcccagccccaggtcatctgctgcgggatggtcaccgactcggtgccgacttgggtcccgttcgccatgatcgggtaggtctgagtacccgggagcgtcgtgccgccagcggcggtgtcgtagggggagtcggagggcgagataatgccgaggttggtggtgccgatgtcacgagctgggttgtaggccccataatcgccgctcgcgatgaagttcgactgtccctgcgccgccatctcgaggaaggcctggttgaacgaggccgcataccccggtgactcctgcgctgcgtccaccgcagcttggatcgcggtctcggactcaccccagctcgacgagacggagccggcgacgttctggctggccgcctcgtagaaggcgtcgacgaagccgtagtcggtgttgggcgcctggtacacgacgatcttggccatcggcgcgatcgtgcccgactgctcgacgtcgagggtggtctcgtcggagccagcgttcagcgacaccggccctgcaccgccgtcgacgttgacgagcgcaagacgattcggcaacgtcacgacgtgcgcgatgttcctccagaagtacatcggcaccgaagggttcacgctcgccaaggtcacgatgccgatggtctgcccctgaccgaggtagcccgcttgctggagcggtgtgaggttgtagtcgctcgtgaaggcctgcggcagctgatcggtgggtgctgcggtttgcgacgacccagccgtgggtgcgacctggttgatgccgggcaccgcgagcgactcgtagggcgcgtagttcgacaacccgagcacggccagaatgttcgacgccaggttcaacggcatctgcggcgcgctgcgcgtcccgtagaccgtctgggtcgtcgcgggcgcactggctgcgggcctggtggtgacggtgaagttctcgagcaagatcccaagggccttgtcgtactgtgcggccgtgccctgcgaggtgacatcgaggccatcgctcatggcctgggagctgatgccgaactcacggaggaacccacgcagcgcgaggatgtactcttcggtctggccgtactcgagcgcgaactcatggggcgtcaggtacggaccacgccaaccagcagccacccgagaggcaagctgtccctggttgcgcatcttcaggatgaacgacacccgcatcatcgtcgacccagccgtggtgcccgtcggggtggcgtgcgagagcacatcggcaccgatgccctgcgacaccggcaccagcggatcagacgccgacgcgagcgactgcgcgcctggcatcgccagtgcagcgccgacgaggccgatggatccgaggattcccaggtatttcgtgcgagccaaacgcttcatcgctccaaccccctctgtggatgtgacgagggatctcgcagaccccgctggatcatacatcgcgtcgcgtcgtgcggtgggatttctacggagagtttgtgcgcttggcacgcagcggcaacattaccactcgatgtgggcgcgagaccacaaacgatgggccagagctgggcgcggcgcgctgaagtgagtggtcgggcgcaccgtgcgaggtggcccttccctgccgccgcgactcgcgctttcgaccagacagagccgcgtgggaacggtgcttgggctccatatcccagggcatcgagccaggactcatcgtcgtggcgctgagttcggctcgcctccgagctttcgacacacgcattggcgctcggagttcgccgacgtcgcagcggtcgaccaacgaggagccgagcaggtcgcgggcgcccgacgctgatgatgtcctggccgcgtaaggctctggtcgacaagggtggtctcggacagaggtcgtggtgtgccccgccggctgggtggtgagccgaaggcggtggctgtgcgggtgctcggtcggcgccgggcacgggctgtgccggcgatgtcgggtcacacgaagcactcgtgtcgacgacggctcagggcacgaggatgaccttgcccacggtggtgcgaccggcgagggcttcatgagctcgacgggcctcctcgagggggatgcgctcggcgatggtcacctcgaggaggccagcggcgacatcggcaaagatcgcctgagcgcgccatctgagctcctcgggcgtcgcgacgtagtgcggcagcgacgggcgcgtgaggaagatcgatccctgccggttcaggatctggggatcgacgggcggcaccgggccgctcgcctgtccatagagcacgagcatccctctgggtgcgagcgccgcgagcgatccatcgaacgtcgcacggccgacaccgtcgaaggcaacgcttaccccaccgagcctacgagcggcatcgacgaatccgtcgtagtcggtcacgatctgagcgcccagacgacgggcacgggttcgcttctccgcggtcgaggccgtcgccacgaccgtggacgcgacgcgacggacgaggtactgcacgagcagggaacccacgccgcctgcggctgcgtgcacgagaaccgtcgcacccggttccactcgagcgcaggagttgacgagcgcatggacggtcatgccctggagcagcaccgcggcggcgacatcggccgtgacgtcgtcgggaatcgtgacgagccgaccagccgggacgaccaccacctctgcgtaggcgccgagatgattggcaaaggccacgcgatcgccgatgctgacggaggtgacaccttcaccgacctcgatgaccgtgcccgcgccttcgctgcccaggacggtcgggagcgagaggggataccagccttcacggtggtagaggtcgatgtagttgacgccgatcgcctccagtttgatcgcgacctcaccgggggcggggtgcggctcggggacgtcggcgatctcgagcacctctgggccgccgtggcgctggatcagcaccgccttcatggtcgcctcctggttcaggtctgtgcgctagcaacggtagcctcgtggtgcgacaaggagggtcacggtggggcgagtgttggtggttggagccggcatcgtgggtttgtcgacggcatggcacctcgcagagcggggggaggacgtgacggtgctcgagcgccgagacgtcgctgccggcgcttcctacggcaacgccggctggctctcgcctggcctcgccatcccgctcaacgagccgtcgctggttcgtcagggcctctcgtcccttgcgtcgccgtcatcgccgctgtaccttgcacctcgtctcgagcgaagctggttggagttcgtgatccgtttcggcctcgcatgcaggacggacgtctggcgacgatcgatgcagatcctcggtgggctgaatgctcggtcgttggaggcgtgggaacgactcggcgatgccgtcggctaccagccgacgaccgcaccgatcgtggcggcgttcgcccgccgtagcgatgctgcggcgctggagcacgagttcgctctcattcgcgaggcgggcttctcgctcgagacgaaggatctgagcggcgacgagctgcggcagatggtaccgatcgcggcccccgcgctctcgttcggcatcgccatcgaggggcagcgcttcgtcgacccggcgcgcgcgacccaccgtgtgggttcggccctcgctgagcgcggtgtcgccgtcgagcgcgcagacgtggttgatctcgagcggcgcggagctcacgtcgtcgtgcgtacggtcgagggggccgagcacctcgccgatggggtggtggtcgcgatcggagcgtggctcggcccgctcgcccgacgtctcggcgtgcgagtaccgctgcaagccggtcggggctactcgctgcgcgtgccgatcgaacgcccgctcgacgtcccggtctacctcccgactgcgcgactggcgtgtacaccgctcgacggtgagctgaggatcgcggggacaatggccttcgagaggcccgacgatccgccgcgccaggcgcgcttcgacgccatgcgtcgtgccgcgcggcggttcttcgaaggggtgcagctcgatgcgccacgcgaggcctgggtgggcccgcgacccgtgacggccgacggcttgccgttgatcggccccaccgcggtgccgggggtctggctcgccgacggacacggaatgtggggcatgacccaaggcccccttaccggggaactggtcgccgagggactgctcagtgggacggtaccggaagcgttgatcccactcaatccgctccgctgaggtgaagcgatgtcacgctcttgtcgctcgaatccaacgggcgccagggagtgtgccgcctcgtcagtggtgttctcgagcactgcaggctgcgcaggtgccgacgatcgcgaagtgtgacaggcgtgcgcgaaagccccattgggtctcgatgcgcgcgatggcgggcgcaaagacgtcctcgggaatctccgtgaccgtgccgcagtgctcgcacaggaggtggaagtgcgacgatcctgcgaggtggtaggtggcggggctgtgaccgatgtggacgtgttcgatgatcccgacgcgttccaaggcgtcgagggttcgatagatggtcgcgcgatggacgagtgcatctcgctgctcgagggcgcggacgagttcgtccgccgtcagatgaccgcccgcctccgcgagggcatcgatgatggcgcgtcgcgcctgggtgacccttccgccccggcggcgcagacggtcgagggcttcgtcgcgatcgagggtgacgcgcgtgcgctcaggcacgggcgtggtctcgttcgagccggtagccgacccctcgtaccgtggcgatgatgctcgggttgttgggatctggctcgatcttggagcgaaggcgcttgacgtgcacgtcgagcgtcttcgtgtcgccgtagtagtccgacccccagactcggtcgaggatcagatcgcgcgtgagcacgcggccggggttgcgcaggaacagcaagaggagatcgaactccttcggaggcaggcggacctcggtccctcggacatcgacttggtggcgatcgacgtacacggtgatgccgtggctctcgaggatctcctctgcggcctgggcttggccctggtgcttggtgcggcgcatctgcgcacggatcctggcgaccagctcgctcatgcgaaacggcttggtgacgtagtcgtcggcgccgagttcgaggccgagcacggtgtcgagctcaccggaacgtgccgtcaccatgatgatcgggaccgaggactcctgtcgaatggtgcgacagacgtcgagccctgacaggcgcggcagcatcacatcgagcaggatgaggtcgggatggtgcgagcgactcaacgccagcgcctcttcgccgtcgttggccacgatcgtctcgaagccttcgcgcgtcaggccgaggacgagggcctcgacgaagctcggttcgtcgtcggcgatcagcaccgtgccgacgtgggcgcgcttgtcgtcagcggccatcgttcggaccacctcgtggaagcctcagctcgaatgtggatccaacgccctccatcgaggtcacgttcagcctgccgcggtggttctcgaccacgtgcctcactatagagagaccaagaccagttccgcccgttgcgcgtgagcgggcagcgtcgacccggtagaagcgttcgaagatccgctcgcgatcgcgagcggggataccgatgccctcgtcgcgcaccgcgagcacgatggtgtcgtcgctcgcgtcgaggctgatctcgaccgtgccccctggctcggagtacttgatcgcgttgtcgacgaggttggacagggcgctctcgagttgccaacggtcgccgacgaccatcgtgggcgtgacgggtacgagcgcgtccagggtgagatccgctcgacgtgcggtctcgtcgaagcgttcacgcaccgcttcgaccagggatcgggcgtcgaactcggcgagcacgacgccgctgccctcttcgatgcgcgacaggtcgagcaggtcggagacgagacgagcgaggcgatcgccctcgtccacgatgcgctggaccaggcgttgcgccgtcgtgggctcgtcctcctgggccagggcctcggcgaggagaacgatcgcgccgaccggggtcttgagttcgtgcgagacgttggccacgaaatcgcgccgtaccgactccaggcggcgcagctcgctgacgtcctcgacgaggatcagctggcctcgatcgtcgagccaggttcgacgcacgagaaaggtccgccttggcggaccgaacagctcgacagcgcgctcgacgtcgccgtgggctgccgggtcgtggagcaacgtggcgatcgctcgatcgagcaagatgcgctggttgagactctccgcaccgaatttcgcctcgacgtcacgatagagcgtgtgtccttcagggtcgacgagcacgatgccaaagggcatcgtggatgcggcgctgtgccagagccgcgcctccgcagtcgtcgtcggcatctcggctgggcttggttcgggagtgtccaccgtcgctccagtctaggagcctcatcgcgccctgatcgtgtcagtgatgacattctatgctacgctatgcctactcatggatgatggtgtcgtccgcaagggcgtcactcgagcaaaggagtgcaaggacatggtcacatggacgttcctcgacgtgtcgctggcgccggatccctcggcgttgccgggaggctccgtcctccagaccctgatcaacggcctggcgggctgggcgctgctggcaagcttggcaggtctcgtcatcggtgcggccgtgtgggcactcggtgcacacagtcagaactaccagcaggcctacctcggtcggcgggccgtactggtcgcgggggccgctgcgctgctcgtcggggcagcccctgccatcgtcaacttcttcttccacctcggacttggcgtggggtaagtcgtgggcttcctccttgcacacggcgcggcggcgatcgcccgtgcggtgtggacgacgttcacctccggcctcgatcacttcgccaccagcgcgatcgtggcgctgctcgcatggctgctcggcaatctcgggcctgttgttgccgctgccccgaccgtgctcccgaccgcgccggcactcgtcggtccgtacgatcacgtggccacggtcgcgggagccttgctcctgccggcgttcatcgtggcgatcatcgcgcgcgtgcgggagccggctcacggatcgatcgccgaggtcctcgcccgacctgcagcctgggtgctgtcggtcatcgcgacgccgcccgtggtggccacgctcgagcgctgggttggcgtggtctcggccagcgcctacggagcgttcgccgtggtgccgtccgctgctctgtcgttgcggccgaccgtggtggccggagggttgcgctcgagcgccgcggtcgtactcgcccttgtcgcagccctcgctgccctcgcgtgctatctcgaggctgtgggacgcggggttgcggtcgacgtcctcgtcctgctctggccactcgtctcgatcgggctggtcctgccgggggcacgaaccctggtgcgccgaagcgccgaggtcctcgccggtctcgtcctgctccaactcgtgctcgccctcacgctcgggctcggggccgcgattgcgcaggcgaatggttcgcgtacaacggccctaccggtgatcggcgccgccctcgtcgtggcggcgagcctggcgccggcgctcaccttcggcatcgtgccgatcgccgaggtgcgtctgttcgaggtgacccggggccttcgacatctggcgagcacgggcctccgacggggcatcgaggtcggagggggagtcgtcgccgaagccatgccacctggagacgctcgccctacgatcccgccgtacgaggggtatcccccgcccccggaggtgctcgagcgcgcgaagcacgacccatgggtgcgggcgctcgtcgacccccctcgtcgtcgtccgtggcagcggaggcggggatgagcggcgtcgagctcggcacgccggccctcgggtcgcgggtcttcggggtgccggttgccaaggcgctcgcatggggcgcggtcgctgtggtggtcgcggcggctgcggcgcgcatcggcgggatcttgggcgtggtggtcgcggcggtcgtcgcgaccggcgtcgctggagctgcctcgatcgccgggtggcacccactctggtgggtcgtggtcgcggtgcgggagcgcgcgcgacgcgctaccgagcgggttggccagccgcgacgcgccgttcgcttcgatcccgatgccggcagtgtccgcattgctcggctcgtggcacgccacgctggcgtcctcggtcgggggcatgatggaagtctcgacgacgcgtggggcgagctgctccgggtgctcgggacgagcttgcgtggccgcgaacggtttctcgtgcgttcggatgtgatcccggcgatcgaacgagagcagttcgctctcgagccagacgatcgctggctggccgagcggacctggatggtcgagacccatctcggggtcgcgagtgacgagcgccgtgggcgtggacggcgcgtccgactcgtccgcgctctcgaggccgccgaagctgcggctcggggccagctcgcgctcgagccgatctcgtccccgtctgccgtcgcatggagcgtgctcccgcgcacgggtgaccgtccggatgccgtcctcgagcggaccgacgcactagagatcgacggcggcttcgtgcgcgccctccacgcggcacgctttccggttggggcggtccacgcgtggcagctggcagggctgttcgcccccgcaggaccgcgccgcgtcgtgaccctcgtcgcccaaccgctcgatcctcgaagtgcgcttcgccaactggggcgccatcgtgtcgagacagctgccgaccaggagcttcgccggcggcatggctatcggctcgggatcggtgagctcgggcgatcggatcgtctcgacgagatcgagcgggagctcgcgaacggtcacgccctgtgtcgatgggagctgttcgtggtcgtggccgcgccgacgctggccgagctcgcagctgagaccaccgccgccatcgagcgggccgcagcctgcagcgtcgatcttgccaccgtgctcggacgccagcgtgaggcggtcgaactcgcgctcttgggggtgtccggatggacctaggttggcaggactcgacccgtgcgctctcggtgctcgcgtttgcgcccacgcctccgccgcagccggcgccgagcaccgtcgtcgggatcgctggcagtggcggactgtttcgcttcgacgccttcgacctctacacccatgggtggctgacgaatcccaatgtgctgatcctcggcgacgtcggccgcggcaagagtacgctcgtgaagctgctcctcgtccggtctgcgatcgcggcctccggcagcttgctggtgctcgatccgaagggcgaatatggcgccgtcgctcgcgccgtcggcgcgagcgtcatgcgcccgcgcgcggaccatggcgggatcgatcccctcgctggctcgctcgatcagcgagagcgggctcgcgccctcggcagcgtgctcgaagcgttgtgtgagcgtccgctcgacgagctcgagcggcgtgcggtgtcggccgtgtgcgtgggaccgctcgcggggctcgccgacgccgctcgacgcctcgcggcgcttgacgcagaggtgttcgatgcgcgacttgccagtgccggtctcgaacgggcggcgcggctggcgctgtggctctcgcgcgtcgtcgacggggatctcgcggggatctgggagacgcgaggtggggggagtgcgctggctccgcgggtcgtcgtggatctcagcgacgtcggcgccgagcgttgggttcggatcgcggtcgcagcactcctccgcatgcggttggcgcagcttggcagcggtgaggttgcaggtgggctcgtggtcgtcgacgaggcatggacgctcgcgagcgagaccagtacgcgaacgctgctcgtgcgagcgctcaagctggcgcgcgcctacggcgtcagtgtggtcgcggtgacacatcgcctagccgacgtcgccggtgcgatggatctcatcggcgacgtcggtaccgtcgtcgccttcggacagtcgtcgtctgcagcccaggacctcgtcactgagctccatctcgacgagcgcgtgcgcgagctggtcgccggtctcgggcgcggtgtcgcgctgtggctcctcgggggacacagctggctggtccggcacgtcgttcgggaggaggaggtcgcactcgtcgacaccgacgcgcggatgcgggctccagcaccatgagcctcggtgcactgatcggaggcctcgctgccatcgcgaccctggccggtgtcggcaggccccgtacaagagagcatcgcagtggcccgcgaccactgccgcgcaccgcggggatcggcatcgtccgcagcgacgagatcgtggttcgactcgggcgctggcgccgtgtcggcgtggggcgaggatcgtcgttgctcgtggtcggcccgacccagagcggcaagacgcgcagggtcgtggcggagaacctgcgacgtcatccggggaccgtcctcgtcacctccgtcaagggtgacgtcctcgatgcgcgtgcgctcgagcggcgtcacgacctcggggacgtgtgggtcctcggtgatacgccgcgagcgacgcacgagtggcagccctggttcgaggccatcgacgacacccatgcactcgcgatggcagatcgactgctggcgatggtgcccgagcgcagaaccccgagcgccgaggttcggttctggcacgagcttgcacgtccctacgtggccgcgtggctgcgccttgcgtggtacggagagcaggtgccggtgggtgagttgctcgtccgcgcagccgaggtggcgggggacgaacttcgtgcggcccttgatgagacggtcgccgatggccgtcagcgtgactcgctgcacgtgaccatccaggcagcgctcggcgcggcccgaggaccgaggagtcgtgggtggccggtccgactcggcgaggccctcgccccgacggtcgtggtggtgggttcgctcgccgagcaggagcgccgctccgcctggtatgcgacgctcctcgacacggccttcgaggccatcttgcgccagccggccaacacgctcgtcctcctcgacgaggtggcccacctcgcgccggtgcctcgcctcgcgcacgtcgctgccgtcagcgtgggtctgggcgcacggctggtgacgatcgcacaggactttgcccagttggaggcggccttcggggtcgaagcagcctcattggttgccaaccaccgtgcccgactgttcctcgaccccgcccacgatcctggggttcgagcgcacctcgcggccctcgggctgcgaggtgacgagggcgccatcctcctcggccctcgtggtgcgcggcgtccgatccttgggtcggtggcttaggttcggcgaggcgctgccgatagctcgcacatgagcccttccacgattgcgcaggcgcttgacgacgtcgaggtcgcactcaccgctctcgaggcggcactcgaccgagacgacgtcgctgcgctcggacccgcgtccaacgagttggctcgtgcggcggtgtcgctcgggtcactcgtggccgaggaggcgccggtcgacgccctggatcgagaacgttatcgctccctcatgccgcgcgtcgacgcggtggtcgctggctgtgcgtggcgtgccatgctggtcgcgcagctcctccgcgacctcggagcggatcttggtatctacggtccggatggactcctcgaggtgaccatccccgagcgctcgagtcagctcgcatgagcggcggtgccctctacatcgcactctccggcctcgaggcgcagcaggtcgggctggacgtcgtcgcgcagaacgtcgcgaacgccaacactccgggttaccagagcgagtcggtggacctcgcgaaccagcaactcccaggcagcccggtcggcgacggggtcaccgtgcaaggagtgctccaggcgcagaacacgttcgcgcgctccctcgagctcgggtcgcaggcggcgtcgtcgtacgcgacgcagttgtcgtccacgctcaccgcggcgcagtccgggtccttccaggagccgtcgtcgaccggcatctccgagcagctcaacggactctggagtgcctttggccagctgtccgacacgccgacacagctggcatcggcacagtcggtcgtcgctgcggcgcagcaggtcgccgaggcgctcaaccaagcggcctccaacctcacgggtctgttcaacgacacctcccagcaggcttcgctgctcgtggcacaggtgaacacgcaacttgcgcaggtggcgtcgctcaacggccagatcgcggcgcagagcggcggtgaggtcggagcggcgaactccctcatcgatgcgcgcaaccaggtgctgtcccaactcgccaacgagatcggtgccacggtggttccggcgtcgtcccagcaggtgaacgtcctggtcgggggagtgacgctggtccaggggacccagtcgaacgcgctcgccgcagcgatcgcggctcccggctctccgccgaccgcatctgggacggcccagatcctgctcgcggggacgagtacccaggtgccggtcacgagcggatcgctcggtggcatgctcgcgtcgttgaacaacaacctcccgcgctacggcacccagctcaacgcgactgctcaggcgttggcgacccaggtcaacgggctgctcgcgtctggtcagacccaaggcaccactggcccgattgcaggccctccgttgttcgtcgcggctggaggtggcacgctcgatgccggctcgatcgctgtcaacccccagatcgaagcctctccgtcgctgctcgcggcctcgacgacgccctatgccggtggcaatggtcagaacgccgccgcgatcgcgaacctcggcagcgccgcagacggcccgaatgcactctggtcacaggcggtgggtcaggtcggactcgatgtgcagtcggcgacgtcgctcgcgacctccgcggcccagcaggcccagagtgctcagacagcggagcagtcctctgtcggcgtcgacgtcaacggccagctcgtcaacctcgtcacctatcagcaggcctaccaggctgcagcgaaggtgatctcgacggtccagcaagccctgtcgtcgttgctgtcctcggtgtcctaggaggggcgatgcaacccatcatgacgtccatcagcctggcgaacacgctgtcgtcctcgctcgatagctaccaaagccagctcagccagctccaggtgcagctgtccaacgggcaagccatccaggcgccgtcggacaaccctgccgggacggtgaacctgcttggggcccagacccagctcgccgcctaccagcagtaccagtccaatctgtcgtacgggcagacggtggcccagctcgcgaactcctcgctgacgcaggcggtgagcatcgtccagcaggctcgaagcgtcctgctccaagcaggtgctcccggggtcacctcacaggtcgcctcggggcttgcaacgcagcttcagggactcgagacctcgctgctcggcgttgccaacacgacgtatgagggccaggccatcttcgccggcacggcggacgtcgcaaccgcctatgtccagcctggcgggcccggtactgcggtgacctatcaggggaatcagcagagcgcgacggtcgcgggcgcgccgggcgtcgctctggcgacctcgttggccgacccattcggggcctccagcccgaccggcggcgtgttcgccgcgctgaaccaggcgatctccgacctgagttccggcaacacctcggctgcgaccaccaccgatcttgcgtcgctgactaccgcgctccagaaccttacgaaccaagcgggggcggccggtgaggctgtcacgcagttccagaacctcacgcagcaggtcacggcggcgattacgcaggtgcagagccaggtctcctcgctgcaggggctgaactatgcccaagtcacgacccagtaccaaacgctgctcaacaactatcaggttgccttgtacgcagcggcccaggtcaagcagccgacactggcctcgtacctcgcctaagggatctcgcatgacacgcacaacggaggatgccgctatggccatgaccaccacgcagccggcgatcgcgacggtgccgatcaccttcccggtcggtgtgcccggcttcgaggaacatcaccgcttccacctcgtcggactcggccccgcctatggaccgtggctcgcgctccgatccgcgatcgagggaggtccgaccttcgtcgtcgcccagccctatgagctcggcgtcgagctgacggtcgagatcgacgacctccatcaggccgtgctcggcattgcggatccgcagcaggtcctcgtgctggtggttgcgacgctgcgcaacccacacccgaccgtcaacctgcgcgctccgatcgtcgtgaacgtcgaagtgctgcgcgcggcgcagatcccgcaggatcgggacgactacctgctcgaggcgccggtgaccgtcccgctctacgacaccgctcgcctgcgcccgtcggaggcgagcgacgagcccggggctgatcgctgaggccccaccgtcaggatcacgcgtggcgctgcctcggcgcgacgggatctgccgacgcccgaggttggcgccctcgaccgacacggttggttggctgccaggatggggagctgcggcctctccgcccccgcatcggctcatggctcgcgagtcggtgagcggccactctcgtgtcatgacggtggtcggccacgagggaggcgtcgttcgacgtcggtctcgagcgacaggctcgttcgcactcagtttcgcgattgaccgtgccgtcgtcgtggtccgcgctcgacgtggcgaagcacggtcacaactggccgccgcgccggtcgcaagggcgtgtcgagagcgtgatgagtgcgacctcgatccctaggcctcggctcccgggcctgaatcctcgagatgcgctggatctgtgagtactcgagcactctccgcggcctcacggttcgcctgttggagcgcctcgaagacttcttgtcggtggacgtccacggatttcggcgcctcgatcccgatccgcacctgatctcgatgcacatcgagcactgtgatgacgatgtcggtgccgatcacgatgctctggctcgccttgcgtgtcaggactagcaccgcgcctccttgcgcccgaaggcactcgttcatgcccccaccagggggcagttcctccacggtcgagaggcctcttgcagctctttgcgctgctctgtgcccacgacgcgcctcgttcgcaagtgtagcatcacggtcggactccgatccgagttccttcatcgatcgctgaggcttcaagcgaacgtcgcaacgtgccgatgcgccaaggtacgagtgatcggaggagcgatgaccggcgcttcgccagaggagcttgcggagttccttgcggagtcacaggagaacttggaccgcttcgatcgtgacgtactcgcgctcgagtcggacccgtccaaccgtgacgcggtggcctcggccttccgcgcgatccacacgctgaagggcacatgcggcttcctcggcttcggccgtctcgaggggctcgcgcatgacggggagagcttgctcgcacgggtgcgcgacggggcggtgcgagtggacgccgcggtagcagacgcgttgctggctctcgaggacgcggttcgcaggagtctcgacgccatcgccgccaccggcgacgaggacgacgagcactgggaggagctccgcgcacgcttggttgcgctcgcggagcaggcccacgaggcgccgcggtcggtcgcgggcgcgaacgccgtcgtcttcgcgccagcgccatcgtcgggcgcgcctgccgagctctcgtcgggacccgagtcgcaggcgtccgtcgagggcgacgtggcgcgcggcgccgagccggatgggaagtctggcgctcggccgacactcggcgagaccgcggtgcgcgtggacgtcgggctcctcgaccgtctcatgaacctcgttggggagctcgtgctcgcgcgcaatcgggtcatgcagctcgcccaatccgagggcagtgcggcgctcgcagcgagcacgcagcagctcagcatcatcgcctccgaactgcaagaacaggtcatgaagacgcgcatgcagccgatcgacaccctgttcgcgaagttgcctcgagtcgtccgcgacctcgccagggaactcggtcgcgaggtcgaactcgtcctcgaagggcgcgacaccgagctcgaccgcacgatcatcgaggcgatccgcgatcccatgacgcacctcatccgcaacgccatcgaccacggcatcgagccacccgacgagcgccggtcccagggcaaggcggcccatggcgtcctgcgcatcgacgcctaccacgagggcgggtcggtgattatcgacgtgagcgacgacgggcgaggcatcgatctcgaagccgtgcgggctcgtgcgctcgcccgcggtctcgtgcacgccgacgagctcgcacgactcgggccgcgggaggtggccgagctgatcttcgtgcccgggttctccaccgcgacgaccgtcagtgcggtgtccggccgtggcgtcggcatggacgtggtcaagaccaacgtcgagagcgtcggcggcagcatcgacatcgactcggatccgggccgaggtacgcggatgcggctgcgcatcccgctgacgctcgcgatcatcccggcgctcatggtcgagacgcacgggcagcgcttcgcgatcccgcaggcggcgcttgccgagctggtgcggctcgagctcgatggtcggcactcgctggtcgagatcgtcgaccacacccccgtgctccgccgacgcgaccgtctggttccgttgctcgacctcggagcgatcctcgggcttgcgccgcccttccccgagcgaggactcgatgcggtgagcgtggtgatcttgagcgctggcgccacgagcttcgggatcgtcgtcgatcggatcgtcgacacgcaagagatcgtggtcaagccgctcggacagttcgtgagccagctccagtgttactccggggcgaccatcctcggcgacgggcgggtcgcgctcatcgtggacgttggcgggatcgcgcagctcggcggtctcgcggtggagcgtgcacacgagacgacgtccgagtcggtaggggaagccgagtccgaggctgagcccgtgatcgtccttgctgcgggcgggacggagcgactcggggttcgtctccgcgagatcgagcgcctcgaagagttcgcgctcggcgcggtcgagtacgttgaagggcacgaggtcgttcagtatcgcggtggcgtcatgcgtctcgtccgcctcgctcacctggtcgggctggcgtcccagcctgcgcgccccgacccgatcaacgtgatcgtggccgttgatcctgctgggcagctcgtcgggctcgtcgtcgacgaggtgctcgacatggcgctcgccccggtgagcaggacgcacggcgcgatcgtgctcgacggcaagctcgtccgggtcctcgaactcgacgcgctgctcgagcgtgcgggtgaggtgagccatgtctgaggtctcgacgctcgcgaccttccaggtggcccatctccggttggcgctcgatgtcgagcgcgttcaggaggttctgcgccgccaggaggtcacgccggtgccgctggctccgagttcggtcgaggggctcatcaatcttcgaggccagatcgtgaccgcactcgacctcgccgacccgctgggggtgaccgagtccgggacccgcgagacggcgttgatcgtccgtgtgggcgacgagctgctcgcgctgctcgtcgacgacgtcggcgacgtgatcgaggtgcccgacgagcagcgtgcaccgatcccggagacgctcctcccaccgctgtcggacctcgccgccaacgtcgtcgtcggcgctgacgacgtggtcgtcgtgttggacctcgagcgactcctcggtgcgttccgttgaggtcactgctcgtcgtcgacgactccggcgtcgtgcgcatgatggtgcggcgctggctgctggaggcctgtcgtgatctcgaggtcgtcgaagcctcgggtggtcgagctgcgctcgagctcctcgagcagcgcaccgtcgatctgatcctccttgatgtcgagatgcccgacctcgacggcctgagcgtggtgcgcacgctgcgcgtccggggcgttcgtaccccggtcgtgatgttctcgaccctcacgagtcgcggcaccgacgtcgcggtggcggcccttctcgccggcgcaagcgacgtcatcgccaagccgcaggcatcgaaccagggcgcgggccgtcaagcgctcgtggaacgtgtctgttcgttgctggcggccgaggaggagctcatcgtggccgcggcaacccagggcgtgcctgcgtcggcccgggtcgtcgagcccgccacgccgcgcgtgggcgcgggtgccccacgcatcgcacaccgcgtgccgtggcaggccccggcgatgcgcacgagcccaacaccgcgtcgtcaggaggtgccgacccatcgtgcggcacctccgctgaccgtcctgcgccccagacggccacaagccccgggcctcgtcgttgtggcctcatcgaccggtggaccccaagcgctggcttcgttcctcgcgggcctcggtcgagtcgcggtgccgacggtgtgcgtgcagcacatgcccgccagcttccttccgctgctcgctgcccgcctcgccgagcagctcggctcggacgtcgccctggccgaggacggtgaggtcgctcgcgcgggcaccgtccgactcgcggctggaggccgtcatctcatcgtgacggcggatcgccctgacgggagccttcggctgggctacgtcgatcaaccaccggagaactcctgtcgcccatcggcggacgtgctgtttcgctcggccgccgcgaccggcgtgcgagcgatggcggtcgtgctcacgggcatgggggccgatggggccaagggtgctgctgccgtcgccgaggcgggcggtgtcgtcgccatccaggacgcggcgagcgctgtcgtctgggggatgccgggtgcggtcgatgccctcggcgtggccagcgtggttgcgccgccagccgagctcggcgaccgcgtccgtcggctggttggcatgccctgatggtcgatcccggcgtcttccagcgcattcgtgcgttcctgcgccgcgagatcggtgtcgatctgggtgcggatcgggcctatctggtcgagactcgcctcggttcggcgcgatcgctcggccgttggcgctcgatcgatgcgttgacgcaggccgcggaggccggcgacctcgaggcgcggcgtcgcttggtcgaggcgctcgtcaccaccgagacgttcttcttccgagacagtgcggccttcgacgcactgcggacgcgcgtcttgcctgagctgttcgagcagcgccgcggtggcaccatcgcgatctggtgcgctgcgagttcgtccggccaggagccgtactcgatcgccatcttggtggcgagccgatttccgtcactgcgctcgcgggtgcgcatcctcgccaccgacgtctccgaggacatggtcgagcgcacgcggcgcggggagtactccgcgttcgaggtgcagcgcggcctggaaccgcggatgctcgagcaagccttcgtcccgatcgccggagggtttgccgtacgcgacgagatccggcgcatggtcgaggtccgtctcctcaatcttgcccagccgttcccgtcgatcgggcccttcgacgtcgtcttcgtccgcaacgtgctgatctacgtgccgccaacggaccgacccgccatcttggcacgcgtcgcagaacggatgcggcccggcgcctacctcgtcctcggcaacggtgagtcggtcggccctgaggtgcgcgcgttcgagcgcgcgagtgacctccgggcaccgatctatcgtcgggtcgacggagtttgccgagcaacgcagcatctgcgagactcaagggcagcgccgagccgaggaggagggggtgccacggggtagcgtcgtgccgctttcccagagcgcgtaccagagcatcagatctgccatcgtggacctgacgttgccaccgggatcgttcttcctggatcgagacgtcgcggatctggtcggtgcctctcggacgccgattcgtgaagcgctcgcgcgtctcgaggtcgagggttgggtcgagtcggtgccgcgcaagggctttcgcgtgagcggcgtggacctcgacgaggtcagtgagatggccgagatggtggccgggatcgaagcggcgggctgcatcagccttgccaccgagcaagatcgagtgcgtacctcgctgctccgtgagaccaacgcgcagctcggcgtgttcgccgaggagggcaacgtcgtggccttcctcctccacgacgaccgattccaccgactcaccgcggcgggtgggctcggtcatcggctcaccggttcgatctactcgctcttgatcgatcaactccatcgcgcgcgccgactgcgccccgcgtctcccggtgacctcctgcgtcacgtcgaggagcatcgcctgctcatcatgtcgctcgagctcggtgatgccgaggccgcggcgctgatctgtcggggccatcgtcgccgcatggtcgagcgactgcgcacgacgatcgagagcctcggacgtgaggtggtcgagacgacctcgatgctggtagacgccgcgggtgacgagacctcgtcgagcgcgagcgatgaggaggccgcggtcggtgacgcggcgcgatcggacgccaaggaacccgaggaaatcatcggccagatgagcgctgaggccgccgagcgttcgcagcgtcgtcgggtgaggctcgggcggcgacgccgcagtgagggaggctgaggaccaggaggcgtcaagcgtaggccgcgccgtgccgataccacgatggaagaacgagtggcgcaaggaggcacggtgaagattctggttgcggacgactcgcgggcgatgcgcatgatcgtcattcgacagctgcgtcacgcggggctcgacgacgccgagttcctccaggcagagaacggcttcgacgcgctcgagctggtgcggcgcgagcagcccgatctcatcttgtcggactggaacatgccggagatgaacgggctcgagttcctccaggcgcttcgctccgagggcagcgacaccccgttcggcttcgtcacgagcgagggaaccccggacatgatccggatggctcgttcggctggggcgacgttcctgatcgccaagccgttcacgcccgagggattccgcgagacgctcgagggtgcgggggtcttcgcgtgagcggtgtcctcgacctgtggtcgacggcactcgccgacggcgtcgcctcgatgcgtgaaggcatcttcgcgctgttcgatggcgtggtcgagcaggttcccggagcgagcgtcgagggcctgccaggtgcgtgggtctcctacgtgggggagcgcctcgccgtggagtttgccctcgtcgcgccagacgtgaccttggtggcgctcacggcggccctgacaggcctcgcagagccctcggaactggccgtcagcgacgctgtgatcgagatcgcgaacatgctcggcggcgtcgccaagcgtcgcctcgtcgccgctgatccgacgttgcgcaccggcatgccgaagttcctctacgccggtgcggtcgtgccacgccagaccgattcgctcgtcctcgaggccggcaccgtggccggtccggtgctccttggcgccatggtgagccgcgcagcggatcgcgagcttgcggagctccacccatgaccgtcgctggctacgacgtaccgttgctcccacgcctcgacgacctcgagcggttgttcatcaccttgctcggtcgagaggtgcggatcaaccgactgcgccagggcgtgacgatcgccgagcccgatcgcatcggcacctatgtggaccgtagcggcgccctccggtgcgtcgtggccgtcgatcgcacgctcggtgctggcctcggcggagcgctcgcgctcatccctcccggggcggttgaggaggacctcgccgagtccgacgagctgcccgagcacctcgcggacaacctccatgaggtgctcaacattctcgcgagcgccttcaacgagacgcgcgagcgggcgctgcacgtgcgccttagcgacgtcgtcaccgccagcgagggctcggaggcagttcacgcactcctcgcaggaggcacgggtcgcgtcgactgcgacgtcatcgttcctggctatcccggcggccaactcgcgattcggatccagtgatgctcgttcgcgtctgtgaccacgagcgtgtgggggccgacggtgcggcgtgggtgctcgttcctggcgagtccgtccctcccgaccagatcgctgctgcgcctgccgtggtcatcgtggtcgaggatgcgctggtcgatgcgcggagcgcgcggcgtctcgtcgaactcgcgagccagggggtcgtcgcggtacctcgctcgccgagtgtcgtcggcagaggacatgtcctgctcacgaccggtgacgacgtcgggaccgtcgagggtcgtgaggcgctcgccgaacgagtctcgaagcactttgcgggcctcaccgaggacctcgagctggtgcccacgctcgccgtggccgtgcccggcgcttgggcagcgagagcgctggacgaacgttggacgacggtccatgagctcttcgcgcggctcgtcgactcacggccagccgaacttgcgttcgatgccgtcgcggtggcgcggcgtcccgttgaggggctcgtgccggctgcaccgcggcgacgccccctggtgtcggcctgcatgatcgtgcgtgatgaggccgtgtggctcgctgacgccatcgattcgttggctggcttcgcggacgaggttgtcgtctacgacaccggttcgaccgacgcgacggtcgatgtggctcggcgtcacggggctcgtgtgatcgagggcacgtgggatgacgacttcggagcggcgcgcaaccggagcgcggcggacgcgcgcggcgagtggatcgtttggctggacgccgacgagcgcctcggtggcgatctcgccacggcccgggcacgtctcgcagacccgctagcgcagtgggagggctacagcgtccggatccgcaacctcacgggtgtggggctgacatgggcggatcactttgcgatgcggctctttcgccgtgcggcgggcgcctggcgcggagccttgcacgagacggtctggtcgcgtgatcacgctcggccgctcaacgcgcacccggcgagcgagctgcatctcgttcatctcggctacttggacgtggtgatgcgccaacggggcaagggggagcggaaccttcgggttgcatcgcacaacgagtctgcgtccgaaccgctcgaggcgctcgtgcacgagatccgctcacggttgctcgccggtgagcacgccacggtcgttgcgctggtggaggaccgggtcctgccggctcctcctgggccgttgcgcaagctcggactgctcgctggcttcgagagcgccctcgcgctggggagcttcgacgtcgcccgtaccttcgtcgacgcattggccacgcagcccgatgtcccagccgccttcgcgctcgaggcgagcgctcggttggccgccacgaccggcgacctcgagggggcccttcgcgatctcgccggcatcgacacgcgcgtcgaggatgtcgacggtctcgtggtcgatcccgagcgccttgccggcctcaccgctcgctgtctcgccgggctcggccgcttcgatgaggcgagcgacgtcgtcgtcgcggcgctcgcgcgtggcacggtcgacgtcgatcttcgcgaagtcgtcgcctggttcgaccacgccaaccgaccactcgccgatcttgagtccgcgatccatcccgagcagcgtcagctcatcgcggcctcggtactccccgctgcggagcttgccgagcgtctcttctgggcgttcgtcgaggcgaaccccgcttgcaccgtctggcttgccgcgggcgagctggcagcgcgacgcgtcggcggcccggtccacgagcggtggcgtcgactgctcgccgacgccggcctcgtaccgagtgcctagtaggggtgcactggactgtaacgcactggactgtcacgcgcgggcgctgcaagagccatcggctccaggcgggaagagagtggcgcctccgggacggccggcgctggtgtgcggcgtcctctctccggtggctggagcagagatcgcaccccggtagctccgagtggcgccagccactgcctcgcgcgtcgtcgtccccgacgcaggcgagggctccggtgccggtcctctcgctgcgcggacggccgtggggcgtggtggcgcgtgcggaaggccccggagcgagccctagtcgtcatccacgtggataggagcgctgctcgtgtcggtttcgcgagccgtgcggggccgtacatcttggtcggtgcgacgacgtgagctcctcgccggggatgattccagaatctgacccatcccgtgctccgctggtgggtgtcgatcgggagagggcagagcagttcaagcacgcggaggagcgtgactgacgcgaaggaagccttctcggccctcaggcggtggtggcgtcgctcaaggggagtgtgacgtcatcgaatgcgagttcatggccctgacgcaggaggcgcaccgtaccgactccgacgcgctcgagggtgccgtcgcctcgaacgacgaggcccgtctcttcatcgatctcggcaaccgtgacgttgggtggagcaagacgaaccgtgcggcttcgtaggtcgcgtggccaggtgtcggcgtgcgggatgacggcgagaccggggatcatcccgagccccaccgtgagcgcgccaccacgtgggtcgaccatgggatcgccgatgaccatcgccccagccgacgaggcgaggacggtcgccccctgatcgagtgtggcgcgcagtgcatcgaggatcggggtcgcgcgcagcacgcctcgcaggtgaaacggtgagcccccgatgaggtagaggcaccgcgcggtgcgaaccatgtcggcgagcaccggatcgaaggcctgagcgcgctcgtacagcggtagctcgacgacgcgaacccctgctgccccgagtacggattgggctcgttcgacggcgcgttcgggtcgctcgaaggcggccgctgtcgggacgagcagcagttcgccccctgcctcggtggcgaacgtcgcttcgaagctcgcgcgcgaaccgaactcgccacccccgaccaacacgatggttcccagccccacgtcgaggatcctaggccgcgaccgtggcgagcgcgccggccacgtccccgataggatcgcgccatggagggcagtgatccacccttgtcgatgcccgatcccgtcaggcggctcggcgtcgtcggtacggggacgatggcgaccggcatcatcgaggtcgccgcgcgaaaggccatcgacgtcgtcgtctgggcccgctccgaccagagcgcgtcagcggtccgggagcgcttgcaagcccggctcgcgcgcgaggtcgctcgtggcgtcatcgctgagcaggccgcccatgaggtcggggagcgtgtcagcatcacgcgtgcggtggatgacctgggtgggtgcgaggtcatcgtggagtcgatcgtcgaggcgctcgagcccaagcgggttctgttcgcgcagctcggctcggtgaccggtcccgagacggtgctcgcctccaatacgtccaccctcggcatcgggcagctcgcccaggtcaccgagcatcccgagcgtgtgtgtggactccacttcttcaaccccgtgacgcgcatggagctcgtggaggtggtccggggtctcgagacgtcgcccgcgaccatcgctcgtgcgactgcgttcgcggtgcagctcgccaagacgcctatcgaggtcgaggacgaagccggcttcgtcgtcaacgccttgctgttcccctcgatcaacgccgcagtccgcctggtggagcgtggtgtcgcgagtgccgaagacgtcgaccgcgcgatggtgctcggcgcgaaccaccctctcggaccgctggccctcgccgatctcgtggggctcgacgtcaccgtcgcgatcctcgatcggctctgggcggcgactggagacccggcgctcgtgcccgcgccgacccttcggaggctcgtcgcggcgggccggctcggtcgcaagagcgggtggggtttctaccgttacgacggaggggatcggtgatccgccttcccgagcccgaccgaccctgggtcatgcggacctatgcgggtcactcgagcgcccgggccacaaacgcgctgatgcatcgcaacctcgcacgcggtcagaccggcctctccatcgcgttcgacctgcccacgcaactcggctacgaccctgacgacgcccttgctgagggcgaggttggcagggtcggcgtgccgatcgcccaccgcggcgacgtcgccgaactcttcgacggtctccggctcgacgccatgaacacgtcgatgaccatcaacgcaaccgccccctggctcttcgccctctacctcgaccgggcgagcgaggaggggagtgcgtggggggcgctggcgggtacgacgcagaacgacctggtcaaggagttcctctctcggggcacctacctgctcgaccctgccaactcgaagcgagtcagcgtcgatctgatcacgttcgctgtcgagcacgtgccgcgctggaaccccatcaacgtctgttcgtaccacctccaggaggctggcgcgacgccggtccaagaggtcgcgatcgccctcgcgacggcgatcgacgtgctcgatgccgttcgagctcgcggcgtcggtgacgacgtgctcgcacgagccgtgggtcgcatgtcgttcttcttgaacgcaggcattcgcttcatcgaggaagtcgccaaggtccgggcattctcccgcctctgggaaggcatcgttcgtgagcgctatggcatcaccgacccacgtctcgcgcgctttcgctatggggtccaggtcaactcgcttggcctcacggagctccagcccgagaacaacgtctaccggatcatcctcgaagcgctcggggtgacgctctcgcgcgatgcgcgggcgcgggcgttgcaactgccggcgtggaacgaggcgattggcctgccgcgcccggtcgatcagcagtggtcgttgcgggcgcagcagatcctcgcctacgagaccgacctcctcgcctacccggacatcttcgagggatcgtacgtcatggagcagctcaccaccgagctcgccgatgcagccggcgccgagctcgagcgcatcgtcgccgacgggggtgcgttcgcctgtgtcgacacgttgaaggcggagctcgtcgcgtctcaggccgagcgcctccgagccatcgaggccggcgatcaggtcgtggtcggcgtcaatcggttcgtcgagtccgagccgtcgccgctgcgtcgaggcgacgacgtcgtccaccaggaggtcgaccttgccgccatcgaggcgctcatcgcgcggctgcgcgagcatcgacgccagcgtgagggacgtcgtgtcgtcgaggcgcgccgggccctcgaggaagcggctcggagtggaacgaacgtcatgggacccacgttggagctcgtccgtgccggcgggaccaccggtgagtgggcggcgacgctccgcgacaccttcgggtcctatcgcgccccgaccggtgtgggtgcggttgccgaacgcctcggccggcggggtcggtcggtgtccatcgtcgcctcgccgccgccgcgcctcctcgtcgccaagccgggactcgatggccactcgaacggcgcggagcagatcgcggttgcggcacgcgatgcgggtttcgaggtcgtctaccagggcattcgccagcaacctgccgacattgcggcggtagcgcgcgacgaggacgtcgacctcgtcggcctgtccatcctctcgggctcgcaccgcacgctcgtaccgcaggtcctcgaggcacttcgggcagctggcgtgacggttccggtcgtggttggcgggatcataccgccacccgacgcggcctggctcgaagagcacggtgtggctcgcgtcttcacaccacgcgactggcgtctcgacgagatcgtgcgcgagctcgtcgtcctcgcgcgtggtgctcgctcgtgagcggcgtcgctgctcaagccgacgagccctgtgccgatgattgggcatatgcggcggttcgtcgacgtggtggcagcggtcctcggtctcgcgggggtgctgctcggggtcctcgggactcgtacgcaggtggccaacgatggactgctggggtcgctcgtcggcgccctcgggatcgtcgtgctcctcgttgctggagcgcgacgcctcgagcgcagacagctgggtcacgacaaggcctcgacgacggggggtgagaggactatgacacagtcggcagcgtcgagcgacctcgaggtcgtcgtcgatcgcgaaacgggactcatgaacgcagccttcttcgctggtctgctcccgacgaagctcgcgacggcacgacgacgtctctggccgctcagtatcgtcttgatgcgggtcatggaggctgaaggcgaggcgagcgccgagggtcctgcgaccatggccgggtttgccacttcggtgctcgagaccattcgcgctgccgacgtggcgtgtcgggtcgggggcgacaccgtcgcgctcgtcctcgacgacaccgacgaggacggtgcggcatgggtggccgagcgggtacagatccaggctgcgcgttcggggaatgccggcatcgccaaggtctgctgtggcgtcgctgcctatccctctcatggcatcgaggccgacgaactgctcgccgtggcgcacgaagcccttgcgcgttccgtcgccgaggcggaggggccggggctcgggccggtgatcgtggctccgacgcgtccgctctagcgacgagccgaggtggcacatgtcataagctggcgcctggtgagagtcgggtgagtggcgagcctacgacgtgagtgatgcgtccgagcgtgtcgtgctcatcggcttcatgggggcgggcaagaccacggtgggtcgcttgctcgctcgtcgcctcggtgcagacttcgtcgacgccgatgacgcgctcgttgccgagaccgggcggtcgatcccggatctgtttcgagtgcgtggcgaggtcgggtttcgccagctcgagggggatctcctgggtcgcctgctcaggtcggcgcgtggcgtcatcgcgctcgggggtggggcgatcgagcacgacgagctcgcggagctcgttgctccgtggctcgtgatctatctcgaggtcccctacgacgttgcccgtcagcgagttggatcggacgacgggcggccgatgctgaccaggtccgatctcgagtcggtctaccgacggcgcgtcgctcgataccggcgactcgctgacctcaccgtcgacgccaccgacgcaccgtccgtcatcgtcgacgagatcgtcagcgcgtttggtgcgctgggcgacggctgaggaagtcgtagagaacgacgaggaagagcgtcaaggtcatcacgtggacgctcgtgcaccagaggcagatcgatccgatcttgacgatctcggcgtagaccagccaaaggacgaacaccacaccgaccccggccagcgcgaggcgcacggcgtcgagcgcgcgatggcgccacgcgaacggcagcgagagcactcccatcgcgaggaagaatccaagacccagcaccgcgaccgggatgccgaggatggtcgactcaggcgaggtggtgaccttggcgcagttgacgatgccggtgtcggggcacgcgagcgtcacggtggtgtcgtagtgcgcgatggtgagatacgtcgccacgcccaggcccgcgagcgcgatgagggcgacgaggccgcgcacccatcgcggtggcgtggctagagctgcgactcgaggtgcgagatcactggatcggtgcatacggcccctggtgcgttgtgggtgagcgtgcagaacgcggcggtgaactcgttggcgagcgagtcgattgcctgggcgggcttggtcgacgggtcgcgcaggcttgctgcgatcgtttgccaactcagcccatcgaggatcgacggcgtatagctcgcgccgatgtcgaggaacttgccgcccatgtcgatgaagggaatcgatccgtcgtactgcgtcgacggcacgtacggaggggcatcgagcttggtgagcagtgcctgctcggctcgggtcggagcctggagggcttggtaggtccgcgtctcgatctcgaccgggacgaagctcaggtaggggctcgtgtagtgcgaaccatagaaggtgaaggtcggggtgttcgcgaagacatcggtcgacgacgagcgcatgaggtgcaggttgctgaacgtcccaaaccgagagagtgcgacgatgagcccccagcgttcggcggcgcagtagggacagtagtcagcgccgatgtagagcacttccggcttgccatcggcggtgagcgcgggctggccggccagccgatggaacgtgctcacgacggagctgtcgaagccgaccgcgtcgagcgccgagcgaggtaccgaggtgatcgccgtctcgacatcggctgggaccggggcattgatgctcgatgcgtcctggctggttccggaggagcgtagggcgaagaaggcggcgacgacgacgatcaccacgacgacgaccacgctcaccgcgatggcaggtcctcgacgagtcgggggccgttgtgcggttcgcgctcgagccgtcatggttcgctcctttgctaccgtcgtcgacgatcgccagcctacggcttcgatcgtctcgatggctcgcgtctgactcagggaacgctccgaggatgcagagcaacagctgaatcggcgccggctgcactgctagcgtggcgccatgagcgcactcgatcggctccgggaccttggcatcgaactcgttgcgccaccaccagcggtggggtcgtacgtgcccacgctggtcgtggacggttggtgctgggtgtcgggcatgctcccgctcgccgacggctcggtcgtccatccgggcatcgtcggcgccgacgttggtctcgaggaggctcgtgaagctgcgcgcgttgcgacctcagtcctgctgtcgcgtctcgcggcggatctcgggtcactggatcggatcgagcagtgggtctcgctcacgggctacgtccagagcgctccaggattccacgatcagccggcggtgatgaacgccgcctccgacctcgtggtcgaggtcttcggcccggcggggcgacacacgcgcgccgcggtgggggttgcggcgctgccgctcgcagcaccggtggagatcgcagcagtcctgcgcgtccgctagacgtccatgctgggcgttcggcggcgctgacctgtctggcgcggccactgcgccagcgcgagcccgatcgcgacgagcgcgacgccgacgagtggtcgaggaccgatcggtgtggtgtggagggcgagccccccgacgagggcgcccactgggatgagggccacgtagggcgcggcgcgtgcgacaccgagacggtggatgcctcgaaaccagaggacaaatgcgccgacggtcacggcgagcgcgatggcgacgtcggcggcggtctcggtcacggtgggggcaggcggcactccgccggtgatgagtccgatcgcgacgaggccgatgcccgctgcggcagcgctcacggtggtgagctcgccaggttcgaggacgcgcaagagcggcgctgatacgagggtgaaggtggcgtcgctcgcgagcgcgacgactgcccaggcaagtccggcgggcgcgaggctgcctgcgccgttgaccacgatggcccccatcgtcgcgatcacggtgcccgtgatgagcgctcgagggatgccgcggcgagaggcgagtgcagtgcccgcggcgatcacgaggggagcgaggccgaccacgacgccgacgcctgccgcggtgccgtggcgcaacgcctcgatggtcgccacggagaagagcccgagtcccacgaccgtatcgacgacgagcaggagcagcatccgcgcagggaggtgacgctggagcggcagagcccgccgtcgcagcacgatgacgagcaccacggcgccgatgaggtagcgtgccccctggctgatgagcggtgggtaggcgacgagcaaaccggaggtagcgatgccgagcccgacgagcaacggggcggctccggcggtgaggtgagcgccgtagctgggatcatcgcgtggcatcactcttaccttacggctggctcggcgtgcgggccctcgggtggatcccgtagactgagcgcggcactcggggagtggaggtgtgcgagatgctgagtgagcgggtagttcgagccaggactctcggggacgtcgtcgcgcccggggcgctcgcgcgtgtcgtggcggtcgtcggctacgcggccttcatcggagtgctcgcccaggtggcgatcccgctccccttcacgccagtgccgatcaccggtcagacgttcgccgtcctcctcggggccctggcgctcggtccggggctcgccttggcgggcacggcgctctatgccgcggtggggctcgcgggggtgccgtggttcgcgggagcgacggggggcctccacatggtctctgatccatcgttcggttacatcgtcggtttcatggttgcggcggccttcgtgggctggctcggaacgcgtggtgcggatcgtcgaccgctcaccacgatcgtggcgatggtggtcggcaacctcgccatctacgccgtcggtgtcgcctggctcgccgtcgcgctcggcgtctcgctcccacgggcgctcgaactcggcatggtgccgttcgtcgtcggggacctcgtcaaggtcctgctcgcggcgggcctgctgccgggagcgtggttcgcactgcgccgtctcggtgcacgtggtgtcgaggggtcgcgtccatgacgcactccgtcgcggagcggctcgaggagctgcggcggcgtcgtgaggaggcgtaccacgccggcagcgagcgtgccgtcgagcgccagcacagccagggcaagatgaccgcacgcgagcgagtcctctacctgcttgacgagggatcgttccaagagctcgacctgctcgcgcggcatcgggcgcacggccttggcctggaggagcgccggccctacacggacggcgtcatcaccggcttcgggacggtgaacggtcgcaaggtctgcgtcttctcgcaggacttcaccgtcttcggcgggtcgctcggggaggtgttcgccgagaagatccacaaggtcatggacctcgctgccgcgtgcggcgtgcccatgatcgggttgaacgacggcgcgggcgcacgtatccaagagggcgtggtcgccttgcactcttacgggggcatctttcgtcgcaacgtcgcgagttcgggcgtcatcccgcagatcagcgtcatcctcggcccctgtgctggcggtgcggtgtactcgccggccatgacggacttcatcttcatggtcgaggggacctcgcacatgttcatcaccggtcccgatgtggtcaagacggtgaccggcgaggaggtcaccctcgaagagctcggcggagccatgagtcacgcgacgaagtcgggcgtcgcgaccttcgtgctcccggatgagaagagctgtctcgacgaggtgcgctatctgctcgagttcttgccgtcgaacaacatcgagatgccgccggccgtgcaggcgaccgacgatcccgatcgcgaggtcctgtccctgcgcgaggtggtacccgacagtcccaaccagccctacgacatgcacgacgtcatcgcggccgtcgtcgacgatggcgagtatctggagtacttcgcccactgggcgcgcaacatcacctgcggcttcgcacggctcgacggcaaggtcgtcgggatcgtcgcgaaccagccctcggtgctggccggggtgctcgacatcgactcctcggagaaggctgcacgcttcgtgcgcacgtgcgatgcgttcaacatcccgctggtgacgttcgtcgacgtccccggcttccttccgggtgtcgaccaggagtacggcggaatcatccgacacggcgccaagctcttgtatgcgttctccgaagccacggtgcctcgcatccaggtgatcactcgcaaggcctacggcggcgcctacgtcgtgatgaactccaagtcgatcggcgcggacttcgccttcgcctggccgagtgccgagcttgcggtgatgggccctcagggcgcggtggaggtcatccaccggcgcgaactcgcggccgcagcggatccgacccgtcgacggtccgagctcatcgacgaatacaccgagcgctacgcgaacccctacgtcgcggccgagcgcggctacatcgacgacgtcatcgacccggcggacacgcgacgggtgctcatcggtgcgctcgcgatgctcgagaccaagcgagaggatctgccgcggcgcaagcacgggaatgtgccgctgtgagcgagctctcgtccgaggaggaactcgctgcggtcgtcgctgcgctctgggcgcaccgggcgaggtcgtcgcctgctgtggccgagccggcccaggacgacaccaggtggcgtttccagcgccgatggtggctccagggcgtcctgtcgctccgtcagcgacctcgtccgacgctgtgacagacgccttgccgccgagctaacctcgcctccgtgtcgaccatcgatctcgctgcgtatgtcgacggcgtgagccttgcggccgcgttgcgccgtcgcgaggtgggcgtcctcgaggtgctccaggcgacgctggagctgatcgacgagcgcaacccggcgctcggggcgatcgtgtggctggaccgagacgacgcccgccgccgggcggagcgggcggctcggcgcctcgacgccgacgaccccgcaccgttcctcggagtcccgctgccagtgaaggacctgcacccggttgcgggatggccgatcacctacggctcgtggggaggtccggagggggtgagcgcccggagttcgatcgccgtggaggcgctcgaagaggctgggttcgtcctggtcgggcgcagcgcgacaccggagctcggcgaactgcccgcgaccgaaggggatcgctacggggtcacgcggaacccgtgggacctgtcgcgcacccctggcggctcgagcggtggtgcggcagcagccgtggccggcggcatggtcaccgtggcccatggttcggacggtggcggatcgctccggatccccgccgctgcgtgcgggctcgtggggctcaagccgagccgaggtcgtgtgccggcgcgctcggccccctggttcggtctctcgacggaaggtgtcgtgacgcgcagcatccgtgaccaggcggcctgtctcgcggtgctcgccgctccgcgtcgcggtgcctggctcccgcagccgcccgctgggttcggcgacggtggctggcacgtggcgccgacgcgcctgcgtgtgggggtcgtcaccgaaccaccgttcggcctcccgatcgacgatgcccggcggctcgcggtcggcgaggttgcgcgtctcgtcgccgatctcggccatgaggttcgggaggtgaccctcgcgttgcccgacgagctgatcgaggccgtctcggtggtcgttggggcaggcgtcgccgagcacgacgatctcgattggagtcgggtcgagccccatacggcggccgagtacgagcgggcgaaggcgttgccggcgaccgagctggttcgccagctcatggtgctcgagcgcacgggctcagacctcgcggcagccctgccaggcgacgtcgacgtgctcctcacaccgacgacagcgatcgcccctcccccggtcggtacggtgctcgaagcggcgcatgcggccgcccacaccggcctccctgcgctcgaggtggtgtcgctcgcgatcttcaccctgccgtggaacatcgctggcctgccggcgatctcgctcccgacgcacctcgacgtcgatggcttgcccatcggcgtccagctcgtcggaccgcccgctggcgaggcgacgctgctcgcgctcggggcggcactcgaggaggtctacgagtggaccacccgacgacctcccgttcagcgctagcatccgagcccatgacccttgcggaccctgtgtgggtgcgccgatggctcgaggatcacggtgtcgcgttcctcgagcgcttcgtcgccctgaacagtctctcacctgcgttcgatccggagtgggagcgccacggcacgctcgccgccgcgatcgacctcgctgcggagacggtcgaggccgctggtttcgaaggaaccgagatcgtgcgccagacgatccccggccgatcgcccgccctggcggtgcgcatccccgggcgcgggcacggtaccgccctcgtctacggccatctggacgtgcagccggccgtcggcccgtggcgtgacgggagcgatccccatcgtgtggtgcgtcacggcgagaggctggttggccgcggcgtggtcgatgacggctacagcgtcgtggcggttctcgccgcactcgagggactgcgggcgatgggcgcggatgccccgacggtgtgggcactcttcgagacctcggaagagagcgggagcccggacctcgatgcgcacctcgacgccctcgccccgaccatcggcccggtggacctcgtcgtctgcttggacgcaggcggtctcgacacaaagcggctgtggctgacctcgtcgcttcggggcaacctcgtggtcgtcgtcgacatcgccgtgctcgaccatggcatccactccggtgaggctggaggggtcgtaccggagaccttccggatcctacgggccctgctcgagcggctcgaggatcccgtcaccggcgacattcgtgtcgatgccctgcgatctgcggtccccgagcccgtgcgtgaggcggcccgcgccctcgtcgaggcgctgggagatccgttcgccggtgcctaccccctcctcgagggcgtacgcctcgagggggcggacccggtcgaacgactgctccgccagagctggggcacggcgatcgcgctcaccggcatcgacggggtgccgagcgtggacacgggcggcaacgtgctgcgcccgtcactcaccgccaagctgtcggtgcgcatcccacccgacgtcgatgcggtccgcgccctcgatgcgttggtggcgaccctgagcgccgatcctcccaacggcgcgcgtgtgcgcgtcacgccggaggcccccgcgcagggctgggcgggggcggccctcccggactggctcgccgatgcgctggctcgcgggtcgatcgcgagcttcggtgagcccccgcgatcggtgggggtcggtgggtcgatcccgttcctcgcgtcgctgggcgagcgcttccctggcgtaccgatcgtcgcgaccggagcgctcgccccgacgtcgaacgcgcacgggcccgacgaagtgctcgagctgccggccgcgaccggcgtggcggtcagcctggccgaggcgctcggcgcactcgctcagcgatcgttctgaggctgtgccagccgagcgtaagcccacaggcgggcggagcagtggtcggagcgtgcggcgagctctctggtgatggtctcggccaccacacgcacatcgtcgtcgacgagaccgatcgggagcgtggcgagcagcggtacgccgaggcgctgcgcgagcaaggttccgcccccttctccgaagggtcggatgaggtctccgtgttcgcatcggagccaggacaggttctcgatgacgccgaggacgtcgaggttcgccttgcgggcaaaggtcccagcacgtacggcgacctcgacggcgagcggggagggcgtggtgaccacgaccacccgggcatctggcagcaggcgtgccagcgcgagcgggacgtcgcccgtgcccggcggcagatccacgacgagggtgctgggctggccccaggcgacgtcggccacgaagtgctcgagcgcgcgagcgagcatggggcctcgccacatgatggcgtcgtcggcgtcgtcgacgaggagccccatggacacgagtcggagttcgccgtcgtcgacctcgatgcgggccggctcgatctcccagcgatcgctggtccctcgcgcgacgaggcgttcgcgtcgttcggtgaggtggggctgcgagaagccccagatgtcggcgtccagcagtccgaccgcgttgccaccgtgtgtcagcgcacgtgccagggcgtgcgccaccgtcgacttgccgacaccgcccttgcccgaggcgacggcgatgacgtcggtgccgagcagcgcggccggaacctcggcccggcgctgagctgcggcccgcgcggcgcgcatggcgcgcgcacgtccggcatggtcgagttcggtttcgtcgacgatgagcgatcgtccgggggcgagctcgtcgacgatggccccgatctcccctcggaagcgagcgcgcgctggacagccgagcgtggtgagggcgatccccacgcgaaccgtcgttgccgtgaccgtgacatcgccgagcatgccgagttcggagagggtcgcgtcgagctcagggtcgcgaatcgcgccgatgcgagctcggagttcgtcgatgtcgacgccggccgtcatggctcacccgccgactcgaccggcagtgtctcgccaggggcgagtcgcgtgggctcgacgagcccatagcgtgggtcgccgggcaagaggatgcgaacgacgtcgccgtcgcgccagaggcgcggctcgatccgcggcacccgctcgagcgctcgggcccgtgcgagtgcctcggcgaccgagcccacgtcggcgaggaacgtgacgttcgccaccgtcggcgggaccatggggagcgcacctgcctcgtggtctcggagggcttggctcggcgcgagccagcgagcctcggtgacctccccggcgtcggcggacgcgtcctggtcgctcggcgctgctgccacgaagaagcgcgtgtcgaagcgccgtggactcccagccggggtcacccagtgggcgacgtagccgagcacggccacgtcgattccctcgaccgctcgcacgacctcgcggaagccgatggtgccggcgagcagacgctggcgcagttcgcccagacgatcggccccgagcgacacctgggcacccaacagcacgcccgcttcttcgaacgcttcgcggaccgcggcgacaccgagggccgcagcacggggctcgtcgggcatgtgcgctgcgaggtcggcacccgagcgcacgagaccgtcggcgacgagcgcttcgtcctcggcgtcgagcgacccgcccgggaacacgtaggtgctcgcgacgaacgcggcgtccttcgatcgacggagcatgagcacctcgagcccggtcgtcgggttgtcgcgcagcaccatcaccgtcgaggcgggacgaagttcgtcagtcactggtcgggaaggcgggatttgaacccgcgacctcagcgtcccgaacgctgcgcgctgccaaactgcgctacttcccggtgtggcttagtctacgccagctcctccggggctgctgcgccagcgacgccgagcgcgacggagctcgccggcaccggcgccaggacgggctggtaggagtggtcgatgaacacaccgccctcgaggacctcgcggacggccgtccggatgaggaccgggcttgcgggcctcacgacgaagccgtcgacacgagcgcgtttggccgtgaagacgtccgcccgacgatcgagcagcagcaggacgcgcgtcggccggagtcggccggcgtcggcttcgagccgaaggtccaccgtgcaggcgataccgcccatcgtgccgatgtgggcgtcgagcacgacgagttcggggtcgagttcggcgaccgcacgccgaacgcgacgtccttcgtccacgccccagagttcgtagtcgccgtcggcgagtgttgcaacgagctcgtcgcggacttccggagcgtcggttgcgatcaggatccgtgccatgcgccgatgatcctagtgttcggggctcgcagattccagctcgcgctcgccaagccgtgcgccgaggcgtccgagggcctcgaccgacgcgatcggctcggcgagatcgtcgaccgcgagtaggtcgaccgggccgagggtctcgcgcacgcgcccgagaccgcctcggcgtgcgtcgaggagtcccatggcagcgcgacgcaggtccggaggcgcgtcggggtcgctcgggagcgagccgagatcgggcggcagacggttgacgaccacggcgcgaacgtcgcgttcgagctcaccgagcgccgtgcgcagccgacccgccaccgccatggcgtcctcgtggatcgtggtcacgagcaggtagcccgttctcgcggaggcgagcagctcctcggtctgggtggcgcgctcgcgaaaggccccttcgagtcctccgaacgcctggaagaacgcgatagtgtcgtcgaccacttgggcgcccaccacagaggcgatctgacgaacgaggctgcgggtggcgagtgccagcggtcgcaacaggagcggcggttggcgaaggaggagacgaaagacccgattgtcgaggaatcgggcgagtcgactcggtgcgtgcaggaagtcgatggcccactgcgcgggcggtgtgtcgaccacgatgacgtcgtagcggcccgtggctcgcagctcccacaggcgctcgaaggccatgtactcctgggtccccgacagtcgtgagacgaggctcgcgtagaccggactcgagaggacctcggcgacctgctcgggcgagttcgcccctcgccggaccatcgcctcgaaggtagcctgggcgtccagcatgaccacgtcgaagcgtgcgctccccacctcgacggtgaccgggtcgttgccgacccccacgaggccgagcgcgtccgcaaggcgtctggccggatcgacggtgagtacgcacgttcgccgcgaactcgcaaggagtgcgccgatggcagccgccgtcgtcgtcttgccgacgccgcccgccccgaccaccacgatcgtctcgaacggctggagtgcaccggtgagcgtcgtcacggctcgacctgctcgaggtggtcggccagcgcgtcgaggaagtggccgtggggaacgagatcgaggtgcggcaggacgaagctgcgcgctccgaggacgtcgcgggccccttcgagctgcgtctgggcgagcgcccaccgctggcggaggtagctggcggcggttgcctctcgagagcctggtcgagctgatcccgcaggcggcgcaaggggcatctgattgaccacgaccgagaggacgttgatgtcggcgcgcgtcgggagcgcctcgaggagctcgcgcgtctcggcgatcggcgtctcctctgggatggtcacgacgagggctccggtggtgtcgtggtctcctaggagttcgatgacctcggcgctctgctgggcgatcggtccatcggacgcgatatcggcgagcccctcgggagaactcagcaaggagagggcatggccggacgctggcgcgtcgaggatcacgagatccagggtcgccgcgttgacgagctgcttgaccttggcgagcaggaggaggtcgcgaatacccgggatcgcggtcgcgacggcgtcgagcaccccggcctgcaccagccgcccggcgagggcgccgaagccgtgcgtctcgaggtattcgagcatcactgcctcggggcgcagggtgaccgcgcgaacctcggggtgctggcgcggtgcgtcgtcgacgtggacgacgagcggtcgaaggcctgcacgctcggccaagaggccgacgaggagggacacggtcgtcttgcccgtcccgcctttgccggtgacgatgacgagtcgagggtcgccgacgagcgcgccgagacggatgcgcgcggtgtcgacgtccatgcctccaccctagagccggcgcagggctcgagcatgtgcacacagttgtgacgcggacgtcacacgacccttgacagcccgagcgaaggctgcataggctgcccgacaagaggtacggacaaagcgacgaggtggatggagtggacggggcgtgtcgtcgtgaccgactcggaggggcggtgcgaagatgatgcggctgatgtcgagcaggagcggcgtgctggaggggggcgagtgagccgacgtgctcggtgtgtggagatcgaccgggctccgatgtacgcctcggcgatcgagtcgactcgggcgctcgctgggcaccatgccatggcgatgcggggagcgacccctcgggcgtggggcgtagaacgctcccgtgcacaggcgagcatgtggtgtgggcgtcgccggtgcgcgtgggggtgctcgcacgttcgccgcatcagatggtcggcgggtgggcgcgtgtgaggtcgataccgacagtcggtatggctacgttggcgtagggtggtctgacgtcgtggcgtcggaccgatcgatgagctggaggggggcgtgctatgcgatcggagtcctggagggagcgagcccagtgtcggggagtcgggttcgacgtcttcttcccgccggaagatcctcgcatggaagggctcgcacagcgacgacagcgcgaggcgtcagccaagcggatttgtgcgcggtgcccggtcgcgggagagtgcctcgaatgggcgctggaaaatcgagagacgcgcggcatctggggcggacgtacggaacttgaacgcaaggccatcttgcgcgcccagcgtcgcgtgcgactcgtcgtgtgatcccgggcctgatcgagggcatgcggtatactttggacaggcacgctggttgggcaatcggctgcaccaaggtgaggagggctcatggcagtcacgagtgtgaagatcggtaagcgcccttcggtgatctcgctgacggattcggcggttcgcaaggtcgccgagttgatcgcgcaggaggacgacgccgcgtcattgttccttcgtgtggcggtggcgcccgggggctgctctggttatagctacgacatgttcttcgattccgagcgtgcgagcgatgacatcgaagcagagttcggtggagtgcgggtcgtggtcgatccgcagtcggcagagttgattcgtggctctgtcctcgacttcgtcgatggtctgcagggagctgggttccacatctcgaatccgaacgcaacgcgcacgtgcggctgcggttcgtcgttctcctaacccgcctcgttcggtctcgtcacgagccgggcagccctctggggctgcccggctcgttgctgtgagttcccctccgggtcgcatcggaggggtggagggggccgtggctcggcagcagtgtccagttggcgtggcttcgatgtctgggctggcagcgccaggaggcagcggggccgacgcgcggagggggcgcaatgggtgggattggtcgacccagtcgtggtcgggacccggtcaggcgtcgccgaagcggtagccgaccgagcgtacggtgtgaatgaggtgctcgtgcgcttcgccgagtttggcgcgtagccgtcgcacgtggacgtcgacggttcgtgcgcccccgtagtattcgtagccccacacccgcgagagcagggtctcacgggagaagaccttgcccgggtgcgatgcgaggaacttgaggagctcgtactccatgtaggtgagatccagcgcggtcccgttgatcgaggcatggtaggtgtcgagctcaagcgtgagcgggccatagcgaatgacggtcctcacgtcgccgcgtccgaagcgcacgaggaggtgccgaatgcgcatggtgagctccctggcgtcgaacggcgacaccgcgaagtcgtcgagcaggccctcgcggagcgcgaggtcgtcgacctggtggcgctcgacgaggaggagaatgggtggcgggggggcgaggcggcgcttgagttcccgggcggttccgagcgcccattcgagcccggtggttccgtcgacgaccgctgcgacgagtggtccgacggtcggcggcagtgcgtcgagggtcgtcacctcatggctggtccatccgatgagctgtgcgatgcgcgtcgcgtgctgcggcgagatgatcgcgagctgctccatgtcagatcagcgtgaggtagcgggctcgttcggcgtcggagacttgactcgccgaagcgcgccactcgtctcgcttgttgcggaggaaccactcggtgacgtggtcgccgagaaccgagcgaaccaggggcgacgcttcgagctcttccagcgcttctgagagtgtctggggaagacgggcgatcccgagtgaggcgagctcgcgctcgggcatggtgaagaggttgtcgtggacctccggaggcagctcgtagccctgttcgatgccttggaggccggctgcaaccatgagcgcgagtgcgagatagggattggcgccggcatcgggtgcgcggtactcgacgaacgtgtcctccccacgagctgcttcgggacttggaaccctcacgagcgcggagcggttgttgcgtgcccacgcgacgtgcatcggcgcctcgaagccagggacgaggcgcttgtaggagttcacccactggttggtcaccgcggtgatctcccgagcgtgccgcaggagtcccgcgacgaacgatcgtgcccggcgcgagagaccatcgggagcctcggggtcgaagaaggcgttgtgttcttcgtcgtgacggtcgtagagggctaggtgggtgtgcatgccggacccttggagcccctcgaacggtttgggcatgaacgaggcggtgatgcccttggcccgtgcggtctcggtgacgacgagtctcgcgctgatgacggcgtcggccatctgcaggacctcgtcgggcgcgaggtcgatctcgtgctgagacggcgcatcctcgtgctgagagtgcttgacggggatgccgagctcttcgagtaccacgaccgcctcgcggcgcagctcgctcccgaggtcgttcaatcgcagctcgaagtacgagccgtggtcgaggggctcccagtgtcccggggtggtctcgcggaggtagaagtactcgagttcgggggctgcgtggacgaggtagccctgctgtcgggcgcggtcgatctggcgacgcaggacgttgcgggggcaaccttcgaagggcgttcgatcgaggttcaagatgtcgcagaacatcctcgcggtgctcggtaggcccggcaccacgctgaacgtggccgggtcgggcatggcgagcacgtcggcctcgtggatgcgtgagaagccgtcgatggccgatccgtcgaaggtcatgccctcgtcgagggcggtggcaagttctgcctgcgtgatttggaaggctcgtgggatgccgagcacatcggtgaaccagagctggatgaacttcacccggcgatcctcggccatgtgacggacgtagtcgacgccgacactgcgctggtccggcacgggccacctccttcgcggtcatgctacgggggacgtccctggatcgctcgtcgcgccccgagcatttaactcggagttcacatggctctccggtctgcgtgctcgctggccataggttgggcgagcaacggcgacggatggaggagcccatgcaaccacgcgcaccacacgaggtgatcgcgatggccgaggagcagggggtcgagatggtcgaccttcgcttctgcgaccttccaggaacgatgcagcacttttcagtgccgatccgacagctcaccgaggattccttcgaggaggggttcgggttcgacgggtcctcgattcgtggcttcaagacgatcaacgaatcggacatgatcttgaagccagatccccgctcggcgtacctcgatccgttccgcaagcaccgcacgctggtgctgaactgcttcatctacgatccggtgaccggccagccctacgatcgtgacccgcgtcgcgtcgcagcggctgcggaggagcacctgcgcgcgagcgggatcgcggacacggcctacttcggtcccgaggccgagttcttcatcttcgacgacgtccgctaccaccaggacgagcactcggcatcgtacgtggtcgactccatcgagggtgcgtggaacaccgaccgtaacgagcagggctcgaacctcggcggcaagattcccttcaagcgcggctacttccccgtacccccaatggacaagttccaagacctccggtcggagatggtgctcaccatgcaggcgctcggcatcgagatcgaggtgcagcaccacgaggtcgccacggcagggcaggccgagatcgacatgcgctatgacaccctgctcgccatggccgacaagctcatgctctacaagtacgtcgtgaagtccgtcgcccagcagggtggctacaccgcgactttcatgccgaagccgctgttccaggacaacggctcgggcatgcacacgcaccagtcgttgtggcgcgacggtgagccgctcttctacgagtcgggggggtatgccgacctgagcgagctggcgctccactacatcggtggcatcctcgcgcacgcgccgtcgatcctcgccttcgcggcgccgacgacgaactcctacaagcgcttggtacccggttacgaggctccggtcaacctggtgttctcgcagcggaaccgttccgcggcctgtcgcatcccgatgtactcgctctcgccgaaggcgaagcgtgtcgagttccgctgcccagacgcgatggcgaacccctacctcgcgttctcggccatgctgctcgcggggctcgatggcatccgcaacaagatcgagccggccggacccgacgatcgcgacctgttcgacttgccgccggacgaagcccgggctctgccgacggtcccgtcgtcgctggagggctcgctggctgctctcgaggccgatcacgactacctgctcgaggggggtgtcttctcgcaggacctgatcgacacctggatcgcctacaagcgtgccgaggaggtcgacgccattcggcttcgcccgcacccctacgagttcgcgctgtactacgacgcctagcgcgtcgttgatccttcgcgaggccctgctcgtcctcgggcgagcggggcctcgttgctgtcatgggttttggtgcgatgggatcgagcgcgacacgatcgagcaacgtccacagggcgctcgacgatggccagctcaggcgaggcctgcgctcccgaggagcgcgcgcgggtcgaactcgtcgatcgggatgatccgaaccctcggcaggacgacgtcgtcgaggaacgcgtgcatgtcgcgctcgagatcgaggagctcgaggtcgtgtcggttgagcagctggcccgcgacgtactcggtgaagcaggccagcgcgacgcggtgaccgtggtcgaggagctgctcgagtgccggagcgaagtcggcgtcgtgcgaggcgagcacgacggacccgtgacgccgtccgatctcgccgagcgtcgccacgatcgcatcgtcgacgaccttgccgggacccgagaggaggaccggcgtgtagccgtgggagcggatcgcctggatgaacggcccggggatgaggcctgaggtggcgttgatgaagaagtagctcttcagcggcgccgatccccacgacgctgcggcgccagcgactcgatcccagcgaggtcgctcgttgggttctggccggtggcccaggatctggccgaggacgccgtcgatgttctcaccgtcgacgagcaagaacgtgaccggcgctaccaccccggccaccccgccgggagtgagccgaccaccggcccgtagacgatcccgcccggggcccccagtgccgacaggagctgtgagaagttgagtccgaaggccgtggagttcgagttgttccactggccggcgtagcccgcgtaggcctcgccgatcccgcccggcgccgcccagccggtctcgatgccgtcggatcccgggaaacaggttgcgatctgctgtccagcgctcaccgcttggcctacggcgaccgttgggaccacgtcctcggcgacgtagacgtagtcgccagcggctggaccgctcgtcagttgataatccaggaatacgccgttgggccagccgccttcgtaggtgctcacgatcctgccggccccgagcgcggtgatcgggccgttgcagaggtaatccacaccctggtcgatccgttcgacctggaggatctgggtgtcggcgagcggattgacgtagccgctcgggctggtcggcgttggggctggggccgacccgccgctcgggctcacgaccacggccggggtgggtgctgagtcctgggcggcacgggcttgctgggcctgggcggctgcgagtgctgccgcctcgcgctgggctgccgcggctgccgcctgggcctgggccgcttgttcggccgcgagttgctgggcgacgagctgctgaatctgggagttgacgctcgcgagctgggcctgggcctgcgcctgggcgttctgggctgcttgggcggcggactgagcctgtgcgctctgggtcgcaagatcgctcatggcgcttcgcagcgaggcttgctggagctcgagggcctgcttggcggtgacgtaggctgcaacggcggcttcctggttcgcggtcgcggcggtgacgtcggtctggatgatggccgcgtcgttcggggtgcccttggcgatcgagatcaccgacgaggacgcccctgcttgcgtgaagatgttcaccgcctccgaggcgaccttggccttgagccgggcgacgtcggcctctcggcgaacgatctgcccttggagggtggcgatctggctcttcgtcgtggcgagtttgagctgcagctgatcgtaggtgttcatggctgcctgggcctgttgatcgagcttggagatctgggcagtgagctgggcggcctcagccttggcctgggagagttgggtggttgcgtcagcgggtgtcacgttcggtgtcgccacggcgaacgtggcgatcgctgtggcaacggtcgtcgtcacaagcgtcttccaacgcacgagcgaacctccgtgcgagattcggggacctccgacgtcctcgacgaggtcatcggcatggtcgacaatcggttgagcccgtcgtgggcgccggcaccgcgagcctagcgggcgaggactcggggctcgggtgctctgtggcaatgttgccaaagttgccgtgctgcctgggaggagctcgagccgtgtcccatcggacgcggcgagcaaacggtgacgggcggtcgggacgacgggattggcggcgcgggttccgatccctgggtccgcgtggcgccgagcgcggcactatcgtggtcgcgtgcgctccctcgtgatccaggctgcgcagctcaacctgaccgtgggggccgttcggcgcaatcgcgacgcggttcgtgctgccatcgagtcggcacgtgcagccggcgtcgacgtcgtggcgttcccggagctgacgttgaccgggtacccacccgaggatctgctcctcaagcccgcgttcatcgaggagcagcgagccgcgctcgacgagctcgccgggtcctgtcgtgacatcgtcgccgtcgtcggtttcgtcgatcgcgagagcgacctccacaacagcgcggcagtcctcgccgacggtgcggtccaagcggtctatcacaagcagctcctcccgaactacaccgtgttcgacgaggctcgctacttccagcctggctcggtggcgccgccggtggtcgaggtcaacggggtgcgtctcgggctggcgatctgtgaggatgcgtggtccccgacgggtgcgatcatgcaggcagccgtcgctggtgccgaagtcgtggtcgtgatcaacgcctcgccgtacgaggctggtcgccaagccactcgcgagcggctcgtcgcggtgcgagccgccgacgcccacgtcgcggtgtcctacgtcaacctcgtcggcggacaggacgaactcgtcttcgacggcggatcgttcgtggtggacgcggtcggtgcggtcatcgcacgcgcaccgcagtttcgcgaggcgaacctcgtcgtcgagctcgagctccgaggcgaccgctaccgacagcgtctcgtcgacccgcggggcaaggtcgcgctcggcacgtcgagcgagcctgccgtccgactcgccacacccggagtgcgcgtggcgcgcgatccgatgccgctcgccccggctccggtcgacggtttcgaccccggcgaggtctacgcagcgttggtcctcgcaaccagcgattacgtgcgcaagacgggcgtaccgggtgcactcgtcgctgtgtccggcgggatcgattcggcgctggtggcgacgatcgcggtcgacgccctcgggccggatgcgctgaccctcgtggccttgccatcgcggtactcctccgagggctcgctgcgcgatgctcgtctgctcgccgaccgtctcggcgtcaccttggaggtcatcgccatcgagccggcgcacgcagcgctcctcgagatgctctcacctgccacggcgacgtccggggtcgtggaggagaacctccagagccgcgtacgcgggacggtgatgatggcactgtcgaacgccagcgggcggctcgtcctcacgaccggcaacaaatccgagctcgcggtcggctattcgacgctctatggcgacatggccgggggtttcgcggtcctgcgcgatctctacaaggaacaggtctacgccctcgcgcggtgggtgaacgaccgggcgggcatcgaccggatcccgacggctattctcgccaagccgccgtcggcggagctgcggcccggtcagctcgacacggactcgctgccaccgtacgagatcctggatcgggtgctgcgctccctgatcgacgaggatcgcaccgcggccgagtgcgagggcgtcgatcctgagctcgcgcgcaccatcgaggcgatggtcgatcgcgcggagtacaagcgacgccagggacccatcggcccgcgcatctcagagcgcgccttcggcaaggaccgacggatgccgatcgtcaaccggtggcggttgtgaccgacgagctgcgtcccaggtggctgggtggtggtgattggtggttaccgctcgcggaggtttccgaactcatccggcgtctctcggcggtgctcatcgatctcgcacgggtgtgcgcagacgcgcgcctgccggacgtattggtgagggccagcttcgagtgctcacgcgttctcggaggacatgcgggcgagcttgcccacttggacctgcatccacagcccgatctgctccagccagtggccctcgacggcaacgacgcgttcgcggcgctgcgtgatcgcctcgtcgagatcgcacccaccgaggaggccctcgacgtggatcggtggcgtgagacgctgcgtgtggggttcgacgaactcgaactggtcgcacgagggctcgggtcgtcgagcgggaccggccagacgaacctcgccgcctgggcacgcgagctgggctcgagccttgcgacatggcgcgagcaactcggtatcgacgggagcgtcggtacgaacggccgcgatcgatagcatgaatgcgtgctgtcctgcgtggctcggctccgcatcggttcgtgcatccagcgagccaggagtcctcggggggtggggaactcgtgacgaaggaacgtcaggaacgtgaggacgaggacctcgtccggctctacctcggagacattggcagccacgagctgctcaccaaggatgacgaggccgaactcggtcggcgtatggatcgtgcgcgtgacgcccagcgtcagctcgatgccggtgtgaaggaacctgcgcgcagggccgagctcgaggagctggtgcggcagggagaagaagccaagcgcgccttcatccaggcaaacctccgcctcgtcgtctcgatcgccaagcgctaccaggcttccggactacccctgttggacctgatccaagagggcaacatgggtctgatccatgcggtcgagaagttcgactggcgtaagggcttcaagttctcgacctatgccacctggtggattcgtcaggcgatcactcgaggtatcgccaacacgggccgaaccattcgccttccggtccacgctggtgactcgctctcgagggtccagcgagcccaggtccagctggaggtacgactcgggcgtgccccgacggttcgtgagctcgctgccgaggtggatctgccctacgacaagctggtcgaggcgcttcgcttccgtgccgagccggtctcgctgtcggagccactgcgcgacgacggtgatgctgagcttggcgacgtggtcgaggacagccagtcggcgacgcccttcgacgtcgcggccgagcacctgctcccgtcggaggtgtctcgtctgctcgctccgctcgacgggcgtgagcgcgagatcctgaggcttcgctatggtctcgatcgcggggagcctcgaacgctggaggaggtcggagagtatttccacctcaccagggagcgcatccgccagatcgaggcgcgcgcgatgtcgaagttgcggcacccatctgctgacatcggcgcgcgcgacctgttgaccggatagccgctgccgttccgagatcgcggcccgtcgcggctaggctggatgcatgaagaagctgttgatcctcgcggttctcggagccctcgctgcgttcgcggtgaagaaggttcgcgaaacgctcgcatagctcgtgggggcgtgggcagtcgtgtccacgccctttgcggccatggtgtgcaaaccggcgggtcggaggaccgacctgctgaggccggtgttgtcgggtggcccgatcggatgggaatcctcaagggcgcggtcgagtgtcgtggcgccacgagccagcgcgacggtcgcggcgcatggcgtcgtggcaaaggtcgcccgttgagcccgagacgcacgaggccgaggctcgggtggcctgatgttcggacggcttggctccgatgggtcgtaaggccgagggcaacagttggggctgtcggtcgtcatggcgcatctcccgggtgaggtcggtgcccaacgaggtcgtccgggtcttcgagtgaggagctggcgatggcctcgcctgagggttgtcagatgcccgggccggcccgactggtcctgaccgacgcctcgccggtaggctggtagtgcgccgctgtgtgatgctgtggcgtcggatgggtgccaaagagaggtccggtgtcgctcgttgctctgagcatcgcggaacgtgaggtcggtggccggtttgaggcgtgtgcgctcgaccgcgaccggaccgagcgcctcgaggacggtctcgcccgtctggtcgccaagggagcgattgtcgaggccgctgtgctcgcaacgtgtgcgcgcaccgagttgtaccttgccgtgacgcagttccatgccgccgtcgagcaggcagctggcgtgctcgccgaggtcctggacgtgccgcggagtctcgtcgagcagctcgcgaccgtccacttcggcaccggcgcgctccgtcatctctaccgcgtgagcgcgggtatggagtcggtcatcatcggcgagtccgagatcgtggctcaggtgaaggacgcgatcgcacgggctcagcgtcgacgtctcgcaggtggcgagttgacgcgcgtcttcgaccgagcgctcgaggtcgccaaggacgtgcgcgcgagtaccgaactgacgcacggctcggcttcggtcgtcacgatggcgaccgagctggctctcgacggagcatccgcgcgcgacgtggcggtcggggttgtcggcaccggtgcgatcggatccgaggtggctcgcgtgctcagcgaacgcggggcttcggtgacggtgctcacccgtcgggcagacgtcctgagtcagcaacccgtcggcgtcgaggtccgagccttcgagcagctccggagcatcatcgaatcgttggacgccgtggtgctggcgaccaccacggattcggcagtgctcgatgcgtcgatgatgccgagcggacaccccttgcggatcgtcgatctgtgtcggcctcgtgctgccgatccggcgcttgccgccgtggacggcgtcaagctggtcgatctcgaggaggtcaacgaactcgtcgcggcgcaactgtcgaagcggcgtgaggcgctcaccgatgcggaactcatcatcgagcgggcgctcgccaacgacggagtgctgctccacgctggtgaactcaaccccaccctcgctcgtctgcacgcgtggggtgaggcgttgcgccagtcggagctcgagcgcgcgctcgctcgcgtcggcgacgacgagaaggcgagagccgcactcgaggaactgagccatcgtctggttcgcaaggtgctccacgagccgagcaaggccctgcgtgctcacgcctcgtcggaggatctcggcgcattgctcgcgagcgtgcgcacgctcttcgatctgtgatggctccggtacgcatcgccactcgtcgtagcgccttggcgcgctggcaggcgagcttggtcggcgagcggctcggtcgctacgagctcgtcgaggtccacaccgcaggtgatcgcgaccaggcgagctcgcttgccgagatcggtggccagggcgtcttcgtcaaggaagtgcaggccgcggtcgtgcgtggcgaggccgacatcgcggtccacagtgccaaggatctgcccacagccgcaggcccgctcctgctcgcggcggtgctcgagcgcgcggacgcccgcgacgcgatcgtgggcgcgcggctggaggagctcgcgatcggcgctcgggtcggcacatcggccccgcgtcgagctgcgcagctgcgcctcctccgccctgacctcgaggtggtatcgatccgcggcaacatcgcgacccgtctcggtcgcgttggggagctcgatgcgatcgtgatggctgtcgccgcgctggagcgcctcggcctcgaggagccgccttggtggccgctccccgaggaggtcctctgtccacaggccggtcagggggccattgcggtggagtgtgcccccgacgccgatgggctgatcgagcgccttcggtccctcgacgacgatcggagccgccgcgagatcgaggcggagcgggccgtcctcgccgcgttcggtaccggctgcgcgctcccgctcggtgcgcgggcccatgccgatgggtcgagtctgcggctccgggcggtcgcggttgatcccgatggcacgcgccagctggaggtcgagcgcgagggagtcgatcccgcgacgctcggtgcaacggtcgccgaggtgctgcggcgcctgggcgccgacgcactcgtcggagctcgtccctgatgggacgcgttgcgctcgtcggtgccggccctggcgacccagagctcctcacgctccgcggtctgaggctcgtgcgtgcggccgacgtcgtcgtcaccgacgctctcgttgatcgacgtgtgcttgccgaggtgcggccggcggtcgcggtgcacgacgtcggcaagcgtgctggagcacccttctcgcaggctgccatcaacgaactcctgatcgacctcgcccgcggccatgagctcgtcgtgcggctgaagggcggcgacccgttcttgttcggtcgcggcggagaggagctcgaggcgctgctggcagcgggggtcgccgtcgaggtggtccctggcgtgccgagtgcgacggccgcggcggacctcgtcggtgtcccgctcacccatcggggcgtggcggacggcttctgtgtgatcaccggtcatcgccacggcgacgcgtcgctcgactacgactggcgtgcactcgtcgcgagtgggctcacgctcgtcgtgctcatgggggccgcttctcgtgcgaccatcgccaaggagctgatgggcgccggagctcctggtgagaccccggtcgcggtcgtgacacgcgcatcgtggatcgatgaagaggtccgctggacgagcctcgcggcgctcgggtcggtgcctgtcgcgtctccgagcacgatcatcatcggcggcgtggtcgatccgcggcgccgatggcgaccctcgctgccgctcggtggcctccgtatcgtggtgacacgcccgagagcggtcgcagatgcgctcgcggtgcgcctccgcgatctcggtgccgtcgtcgtggcgagcccggcgatcgagatcggtccgccgtcggatggcggtgccgcactggccgcggcgctctcgcacatcgaggactacgactggctcgtcctcacctcgcagaacgccgtcgatcgcgtcgtaggaggcatcggcgaccttcggcgtctcggtggcgtgcgcatcgcggccattggccccgcgaccgctcgggcgctcgagcgggtccacctcacggccgatctcatccccgggacgtgggttggggaggggctggtcgaggtgttcggccctggtcctggctcggtgctcatcgccagggcacgccaggcccgcgacgtcgtgccacggggcctcgaggcgaaggggtggcgcgtcgacgtcgtcgaggcgtacgagacgcgcacagcagcggcgagcgtgcctccagagctcgtcgagagcgccgatctcgtcgtgttcacggcaccgtccaccgtcgagggtttcgcgacccagtacccggggctcgtccctcgggccgcggcggcgatcgggcccgtcaccgaggaggcgctggtgcggcgagggtggccggtcgcgctgaccgcgacgcactacgacgccgatggcctcgtggaggtgattcgcgaggcgcgcgaagcgggtcggctcgtgcctcgatccgaggcgccctaggctcgtcgtcatggcttcgttcccaaggcccaggcgcctgcgtgccacgccggcgcttcgtgacctcgttgctgagaccgtcgtcagaccccaacagctcgtgctcccgctgttcgtgaaggaagggatctcgacccccgtgcccatcgcgtcgatgcctggggtcgtccagcacacggtggactcgctcgttcgagaggtcgacgaggcgctcgccgtcggcgtacgaacggtgatcctcttcggcgtcaccgacgagcgggacgaggacggctcgctcgcgtgccgcgcggacttcgtgctcgagcgcgcaatcgcggcgctcgttgcgcgcttcgcaacggacgtgacagtggtggccgacctctgcctcgacgagtacaccacgcacgggcactgtggggtgctcgatgctgccggacgcgtcgacaacgacgccaccctcgttcgctaccaggcgctcgccgtggcccttgcgagcgcgggcgtccacttcgtcggcccctccggcatgatggatcaccaggtcgccgccatccgtgaggccctcgacgctcatggattcgacgacgtcggcatcctcgcctatgccgcgaagtacgcatcggctctctacggccccttccgcgacgcggtcgaggtcgagatcgcaggcggcggcgaccgcgcgagctaccagcaagatccccgcaaccgtcgcgaggcgtggcgagaggtcgacctcgacgtcgccgagggcgcggacctggtgatggtcaagccggcgagcttctacctggacgtgctgtcggacgtcgccgaacgctcaccggtgccggtccttgcctaccaggtttcgggtgagtactcgatgatcgtcgcggcgagcgcgaacggttggctcgatcgccgtctggcggtgctcgagtcgctggtcgccatccgacgagccggagcggacggcatcctcacctactttgccaaggaggcagcgccgtggctgcgatgatcttcgagtccaacgaagcggcgttccgtgccgcgtccgaactcatggtcggcggggtcaattccccggtgcgttcgttcgcgtccgtcggcggcacgccgtatgtggtcgagcggggcgagggtgcgtgggtcatcgacgtcgaggggcggcgctaccttgattacgtccagtcgtacggggcggtgatccatggtcacgccgatgcgcgtatcacgcgcgcgatcgccgatcaggccgcccgagggaccaccttcggtgcaccaacggtgggcgagatccggctggcgagcgcgatcgtcgatcgcgtggccggcgtcgagcgggtgcgcctcacgagctcgggcaccgaagcgaccatgacggccatccgattggcgcgaggcgtgaccggacgatcgcggatcgtcaagttcgatggctgttaccacggccacagcgacgcgctgctcgcggccgctggatccggggtggcctcgctgtcgctcccggggtctgccgggatccccgatggagcggtggccgacaccatcgtcgtcccctaccaggaggtgcccacgctcgacgagcgcgtggctgcggtcatcgtcgagccgatcgcggcgaacatggggctcgtggcgccggagccgggattcctcgagggcctgcgcgccgagacccagcgcgtgggagcgctgctcatcttcgacgaagtgatcaccgggttccgcgtggcgcgcgggggtgcgagcgagctgctcggcgtgcaaccggacctgtggtgcttcgggaaggtcatcggcggcggtctcccgatcggggccgtcgccgggccagggaccatcatggatcacctggcccccgctggctcgatctatcaggcaggcactctctcgggcaatcccgtcgcgaccgccgctggcgccgtcgcgctcgaactcctcgacgccgggtcgtacccgcagctcgaggggcgcgcacgggcgctcgcgaccggccttgcctccgtcatcgccgaggcggggctcccggtgcaggttccgcaggtggcctcgttgctgggcctgttcttcagcgacgaaccggtgcgtacctatgccgatgctcgccgggccgtcgggtcgggttggtacgccccgttctttcatgcgatgctgcgacgagggatcgcgctcgcgccaggcccgtacgagatcctcttcccgggactcgcgcacagcgccgacgacgtcgaccggacgatcgacatcgcctcggcggccgcccgtgacgcgttcgtcgccgggcctgtgcgctaacgggtggaggcgcgcggagccagcgcgctgatcactcgcccgcgcctgcgaggcgcgcggagtagatcgagtagccgtcgaccgtgcgtgccaccgcggtcgcgagcaccgttgcgatcatgagcggcacgatgaggtcgaggcccgagtgggtgagctccagtaccagcacgatccccgcgagaggggcttgcattccggcacccatcatcgccgccgcgccgatcatggcgtaggagccgatcgctgcccccggcatgacgaacgaccagatgccgccgaggaacccgccgaggaccgcgcccgtcgacaacgtcggggtgaacaggccgccggaggcaccggtacccagtgccatcgcggtgacgatgggcttcaagaggaagagtgctgcgagcaagccgaggctaccgagctggttcaagaagaccgcgtgcgccatgtccttgccgttgccgaagagctggaaatagcgcatgccgatgaagccgaggatcgagaacgacaggagtggtccgatgaggacccaccgaccggtgaagcgatggtgcgtgacgaggcccatgaggcgcacgaaggcgaccgagaagaggccgatcagcggtccggcgatcacggcgaagacgatctgggcgaggtggaactggtagttggccaccccgacgtaggtcgcgtggtcggggaggtagaggtagccgacgtacgtggcgatgacggatgctgcgagtgccgggaggacgacgggcagggtgacctcacccatcatgatctccgcggtgaacagggcgccgccgaggggaacgttgtagacggcggcgagtcctgcccccgcaccgcaggcgatgaggaggcgcttctgcgctggcgacagcttgccccatcggccgaggtagctgccggacaccgcgccgaggagcttcggggcggcctcgcgtccgagcgaggcgcccatgccgatgacgacctcttggatgatcgaggtgccgaggctcttgcggatgtgcagatcgccctcgcccttccagacgacgtcgtccacctcggagcgctcacctttggtgaacttcgagaggatgaaccatgcgggcccaccgatcgcgccggcgagcgtgagcatctcgaggcggtagatcggcgcggagcgcccgacggccgcctggaacgagccgatgtggtagtggtacgtgatgtgctggacgttgaagaggatgaccatcatgaggtcgccgaagagcccggccccgacgcccgtcaggatgaggaaaatccagaacttgagcgtgagctctgcgtcaccatcgccggtggcgttgggctgctcggtcgcgcctcgcccggtggggagtcgacgcctgatgagcggctggggtgagcgaacgcgacgcaggtgccagggatgctcgcggtccgccttgaccatcgggactctctccagtcgctcgcttgcgttcggtgctgtcgcggggcctcggacgtcactcggcacccgccggggtatgcgcgctgagtctagtggccgtcacgtccggacaagtgcaacgcgtcgcatgctactgcatgagtatgcatgtcactacgacccagccgccccaccaggctaggcggcgatggtcgggaacagcgaggatcccccaccggatcaccgccccaggggagccgtgacgacgcgaggacgtggcggactacgccaaccagggaaaggctgaccagtcgggttcgcgtcgctggaggaaggcgtctcggccctccgttgcctctcgggtgccatagagcaggcgcgtcgcttcgcccgcgaagagctgttggccgaccatgccgtcgtcgaccaggttgagcgcatacttggcgaggcgttgcgcggtcgggctgcgatcgaggattctgcgcgcccatgcgacagcaaccgcctcgaggtcctcgtggtcgacgacggcgttcaccatgcccatggcgtacgcctcctcggccgagtagtcgaagccgaggaagaagatctcgcgggcgcgcttctggccgacgagacgagcaaggtacgccgagccgtacgcgccgtcgaccgaggcgacgcgggtgtcggtctgcatgaagcgtgcatgctggcgacttgcgatggtgaggtcggcgacgacgtggagcgagtggcccccgccgaccgcccagcctggcaccacggcgatgacgacctttggcatggtgcgaatgcggcgctgtacttcgaggatgtggaggcgtccatgggcgtgctcggtgtcgtggtactcgtagccctctgcgccacggactcgttgatcaccgcccgagcagaatgcccagccgccgtcggtcggggacggaccattgccagtcaggagcacgcaaccgacgtcgtcgcggagcgtggcgtcctcgagcgcacgtgcgagctcgtcgaccgtacggggccggaaggcgttacgcacctcggggcggttgaaggcgatgcggacgaagccgccctcacgggcgcggtggtaggtgatgtcggtggcgtcgaagccttcgacgggctcccacagcgacgggtcgaagagcggtgagggccgatcaggctggtgcacgatgccatgctatcgacgacgcgcccggtcgtctcaggctcgagcgcaggcgcgcctccagcgaccacgcagctcgggggcgcgggtcccgacatccaatcgtcggctggacgtaacctcgtcgtcggacgggctcactacggtcgaggtggggcggccaagtggcgccgcgcaaacgtgaggaggtggcgtgaccacgctgctgcacatctccgatctgcactacgagcgagctccggagcgcctgagcgtgggcgtcggcgagcgtctgcgccgcgcaaggaccgcactgcgctctcgtacgttcgatctgctcgccgtgagcggggatctcacgagctacgggacctgggacgtccgcgagctcgtcgaggcgcgccggtggctggaaggcttcgagcgccggatgctcgtcgtgcccgggaaccacgatctcggggccaatcccgagcgcgccgaacgatttccggtcttcgagcgctacgaaccagttccctggagccggacgaacttcggtatgaccttcggggagggcccgctcgtggcgcgtgcgacgggtgacctcctggtcgtcggcgtcggcctgaggcgcggcgatcccgatggcgcgctcgcgctgttggagcgagcgctcgcaggtgcgacgacgcccgtggtcgtcgttggccactacccgatcgtgccggtacgcgagtcgggcgtgctcgcgtccttcggcgcgatgggctacgtggatggcgaggtcgcggagctccatcgtctgatggtccagtccacgcgggtcgtcgcgtacctgtgcgggcacgtgcacgcggcgagcgcggcggtcctcgaaggtggtgtgctccagctgagcgcgggagctctcggcccaggccccgcgctgggatggctcgtgcacgtcgagcgcgatgaggtgcgcttcgagcaggtggaagcgcctgggcgaacgacgttttggccgagcgatcagttggggggtgtcgaccccgtggcctaccacgcgggggccgtcaggagtggcgtggtgccgctcggtcggaccggtcgccccaccctcgtcgattgagttcgcggttcgcgggcgccgtcgcgagaccgccgcggccagacgctgagctccgacgatcgccgcggtccgtgcgcggtgtggaagctgtgaggcgctgcgagcgttgccacctgccatgagtcatggtgctgcgcgctatgtcgtgaccggagcgaccggtgccgtcggccgctcgctcgtcacgcgtctggtcgaggggggcgccgaggtcgctgtcgtcgtacgcgatcgggatcggctccacgagcgcctcggtccggtcgccgacgcgctcgccgccgtcgaggttgctgacgcgcgcgatctcgagcgattcgaggcggcgctggtggcggcagccggtgcccttggttcggtggacggcatcgcccatctcgtcggtggcttccttcttgcgacgccggcacggacctcgatcgcgcagttcgaggagctcatgcgcctcaacctgacgagcgccttcgtggtcgtgcgggtggccgagcgcgtgatgggatcgcgcggtggctcggtcgtgctgatctcctcggcggcagcccacgtcggcctcgcctcgcacgaagccgtcgcggcttcgaaggctggtgtcgaaggactgacccgatcggccgctgcgacgctcgccagagctggcgtgcgggtgaacgcggtcgcccccggactcgtcgaggccgagatgacgcgcgggatcgtcgagcgagaggatgcgctcgcggcgtcgatcgagctgcacgccctgggtcgcatcggcaccggtgacgagatcgcccgaggcgtggcgttcttgctcgacccggagtcctcgtggatcaccggcagcgtgctcggcatcgacggcggtctcgggtcggtgcggccgcgcccgcgccgacggctcccttctcagaccgggggccaaggatagggccgtccgtgctccggcatgggcgggagcgcgccgcgtcgaacgagacgcattgctcgctggaggagcgcacgtcgttcttcgggctcgagcagccgtgcgaggtcgtcgggcagatcatctgccaaggaggcaagacgtgcggccaacgcggtggggagcggatgacccgcgagatcccagatcacggttcgtagcttcgactccgggtggaaggtgagcgcgttgtcgatcgcccagagtcgcccctcgtcgtcgaggaggacgtggctccccttgcggtcggcgttgtttgcgacgatgtcgagtgccgcgatcaccgcgagagactcgtggtgggcctggtcctcgacgagctcgaagtaggtgaggtcgaagtctgcgtccacgaaggcttggagggtgccgctgccgtagggtaggtcgtggcgcacgacgataggcggcacgtggcagatgccgacgaactcggcgagtgctcgaaaggcgagttcccggcggcccagccccggggggaagtcccacaacgggcgctcgagggcgtcgggcttgtagatcgcgagtgctccggagtggaccagctcgacgaggtgggcgccgttggacgacgcagtgatccgcccgaggaggcgaacctcgtcgtcgaggatggcaggatcgtctaacgcgctggggcgcgatgcccgttcgtccgtggacacgcgtggccttcgggattgatcggatagccgcagagcggacaggtcggtctgccttgttcgaccacctcggcgatgcggatcgcgagacgcgctgcgagctcccgcgagagggtgaaccgtgctcgacgtggctcgacgtcgacgtcgcgctcgtcttcgatggcctcgatgacgagcactcctgcatccacgtcgaccgcgagctggagttcgccgacgcggaaggctggttcggcgggttcggtgagcggtgtcgtcggtggcagctcgccgggtcgcgcgaggtcctcgagcgccgtggcgatggccctggcaagggcggccatctggagcttttcgacgaggagggtcacgatctcgccgttggcgccagcctggaacaagaagacgcgttcgccgggtctgccgtgggtgccgagggtcgcgaactccgcaggatcgaactcccagacgaactcgttcacctccgccacctggccccagtgcgttcgttgagcgtgagcaggccaaggctcgtcggcgtcacgctgaaggtggtcgacgaggccgtctcgacccagatccggtggacaccgtcgacgtggataccgagcgcatcggcggcgagcaggcggatggggtccgcgtgtgaggtggcgacgacgacctcgccgggatggcgctcggcgatcctggttgcgaagcctcggatccgggcgagcacatcgacgagtgattccccctcgggaaaccggaacgtcgacgcagccgcgaggagcgttgcccactccttgcggcgacgcacgcgtcccaacgaccagccggtccaggcgccgacgtcgacctcggcgaggtcgtcgtcgacgatcgcggtggtgccgaagacagcctcgagtgcggctgccgtctggcgagcgcgctcgagcgggctcgagtacagcctgatggcatcgaagcgccctgcaagcaccgctgcggtgcggcgcgcttcggcctcgccgcggtccgagagggcgagacccggccgtcggcccggcaactcggtgccggtcgtcggtgtgcggccgtggcgaaccagcaccagcgtcgccggtcggtcgctcatcgggccgtggctgtggtaggagcgattggcaccctcgtcaccttagcgccgaaggcgcggtccgtacggatcgacgcctcagtcgaggcgctcgacgatcatggccataccctggccgccaccgacgcacatggtctcgaggcccagacgagcccccaactcatcgagctcgtgcagcagggtcgtcatgatccgagcccccgtcatcccgaacgggtggccaagcgcgatcgcgcctccgttcgggttgagttggtggtcgatcgagatgcccgtctccttgacgacggggagcacttgggctgcgaaagcctcattgagctcgacgacgtcgatgtcgccgatcgtgagaccggcgcgttcgagcacggcgcgtacggcatcgatcggtccgacgcccatgatctccggagcgatgccggtcacggcggaggcgacgatcttggcgagtggccggatgccgagtgcctccgcgcgtgagcgctccatgacgatgacccctgcagccccgtcgttgagcgggcaggagttacccgccgtgacccgtccgtcgggcctgaacgctggcttgagcgtggcgagcacctcgagggtggtgttggggcgcggcccgtcgtcgcgccgaacgacgttcccactcggcgtcgtgacggcgatcgtctccgcatcgaagaagccccgttcctgggctgcgaccgcacgctcttgcgagatgaccgcgtaggcgtccatcgcctcgcgcgtgacgccgtagcgatcggcgacgttctcggccgtgaggcccatggggatgtacatgtgattgacgaagtccgcgcggctctcgtcggtgaagcgagggttcatgtcctcggggtcgaaccccttgatcgatgcacgtgtcgtcgactccacaccgccagcgatgaaggcgtctccctcgtcggccatgatcgcatggaacgccatgcgaatcgcttgcagcgacgatgcgcagaagcggttcacggtggtgccggggacggtctcgggcaggccagcgagggctgccacgttgcgcccgaggttcatggattgctcgccgtgctggatggccgctccccagatcacgtcgtcgacgctcgccggatcgagggccggcactcgggtaaggagctcggcgatcacgaggccagagagatcgtcagggcggacgtcgacgagggatcccttgaaggcgcggccgatcggggtccgggcggtggcgacgatcaccgcctcgcgcgccgtcatcgctcgcctccggtcgccagcgcgctccgttggcgcagctggcggagcacgcgctcgacgtggccggtcgcgcgcacgttgtagagcgcgtcgacgacggcgccgtcggcgtcgatgagcaatgtggaccgcaggacaccttccgtcgtgcggccgtaggacttcttctcgccataggcgccgagggctgtgatgacggaccgatcgggatcggcgaggatgtcgaagcgtaggccgtgacgctccgcaaagcgggcatgggatgcgaccgtgtcgggagagatcccgacgacgcgccaaccgagcgccgccagctcgtcgacggacgcgttgaactccgtcgcttccagggtgcatcctggggtcatgtccttcgggtagatgtagaggatggtcgcggtgccagcaaacgagtccgcgcagacctgctcgcctcgttggttgggcaggcagaagctcggaagacggtcgcctggcgcgagccggttcgtttcggtcatgggccaacgctagcgcgatcgcgcggcggtcacagggcgggcgtcgctacgctccgtcgaagaaggaggagccatgggagatgacgagctcgtagccctcgcgtcagcacttggccaagcacgcggtgatgctgagacgctggcatcggtgctcgccgatgcgctcgagcgatggctgggcaccggcgcggtgcgcgtgcagcggcgcgggttgcgcacgcgacggatcgtcgagctcgcggtcgacatcggcgaccgtcgactggtgttgcgcccaggaccaccggtcgtggcggagatcgtcctccgttcaggtggcgttgcgatcgctcatgatcgggtgtcgctctcggcgtggttgtccgcgctgaccgaggcactcgccgcgcagctcgggacggcaacggacgacgtgcgggcactgcgccgtgccctgggcctcgatgactcggtcgactagcgtggcactggtcccaggaggtttgcgtggaactgcagccatttgaagcaccccagtccgtcctcgtgatcagtgcgcacccggacgatgtcgatttcggactcgcgggcacggtggcccgttggaccgcggcgggcacggaggtcgcctactgcatcgtcaccgatggcaacgtgggcgggttcgacccgtcgatcccccgttcggacattcctgcgattcggcgccgcgaacagcgggctgcggccaaggtggtcggtgtcgagacggtcgagttccttgggtacgtggatggcgaggtgacggtgacgctcgggttgcgacgcgaccttgccgcggtgatccgacgtttccgtcctcacaccgtggtggcgcagtcaccagtgcgcaactttgcgcggatcggtgcgtcgcacccagatcacatggccgtcggtgaagccgcgctgtgcgcggtgtatccggacgcgcggaaccccttcaccttcgtcgagctggcagaggccgggctcgaggcgcacaccgtcagtcaggtcgcactgatggcgtacccggagccgacccacttcgtggacgtcacggaaacgctcgacgcgaagctcgaggccatctcgtgtcacgcgagtcagttgcccgatcccgaggcgacgcgcaccttcgtgcgtggctggctgcgtcaaggagccgaggctgccggtctcggcgacgatcgctacgccgagctcttcttcgtgttccccacggcctagggcgcccatggcgcgcacgtacggatcgggtcgccctcgctcgcgatcaggtgacgcgtgtgcggcttcgacgtggcgcacgcgtcgtcgtggcccagatgggacctctgccgtgggtgtgctcggtttcgagtagtgtggtggttgctgagtcggcagggctcggcgctccccgtgttcgagcgcgttgctccccgccaggtgagcgggcatgagttcgcgcgtcagagacgagcacggcgtgtctcaccacttcgtggtcatcggcgtgatgttgaggagtctcgttgcgtgctgctgtctttcatcgtccgggtctgatcacggtcgacgagcgtcctgatcctcgggtgctcgagccgaccgacgcggtcgtgcgggtcgtgcgagggtgcgtctgcgggtccgacctctggtactggcggggcctcagtgagcgcggtccgggctcgatcggccacgagttcatcggggtggtcgaggagatcggctccgccatcgacggcctccgccccgggatgctcgtgatcgccccgttcgcctttgcggatctcgcctgccccaactgccagtggggcgccaccgtgaactgcgtgcacggtggcctgttcggcgacggcactatcgacggaggccagggagaagcggtgcgcgttccgctcgccgagaccacgctcgtgcccgtcccgggtacctcgtggtcggacgccgagctcgcgtcgttccttgcgctctcggacgtcatgccgaccgggcaccacgcggcggtgtcggcgggggtcacgaagggtagcaccgtcgcggtgatcggcgacggcgctgtcgggctctcggcggtgctcgcggcgcatcgactgggtgcggagcgcatcgtggccctgagttcgcacgcggaccgacaggtcgtggcccgggctttcggggcgaccgacatcgtcgcccaacgcggcgccgaggccgtcgcgaccgtgctcgagatgaccggcggcatcggtgccgacgccgtgctcgagtgcgtcggtacccaggaggcgatggagaccgccgctgcgatcgcgcgccctggatcgatcgtcggtggagtcggcgtgccccacggtgtgatgcccgcgacggcgctgttcggtcgcaacgtcggctggcgcggtggcccggctccggtgcggatctacctcccggagctgctcgaggacgtgctcggcggcacgatcgatccaggtcgcgtctttacgtacgagaccgacctcgacggcgtcgtcgaggcgtaccgggcaatggacgagcgtcgggcgatcaagtcgatcctgcgcgtcagcgagccgtagcacgttcgctggggcgacacgacagggcgaagggcagaggcgagacgagaagcggaggtgaccatgcagtatcgaatgctcggcacgacgggggtggaggtctccgtactctgtctcggggccatgatgttcgggagctggggtaacccggaccacgacgagtcgattcgtatcgtgcaccgggcgctcgatgcgggcatcaacttcatcgataccgccgacgtctactcggagggcgagtccgaggagattctcgccaaggcgctccgaggtcgccgggatgaggtggtgctcgcgaccaaggtgcatggtcgtatggggcctgatcgcaatgccaagggcaactcgcggcggtggatcatccacgaagtcgagcagtccttgcgccggctcggcaccgagtggatcgacgtctaccagctccatcgccacgatcccgacaccgacctcgatgacacgctcggcgcgctcgacgacctggtccgcagcggcaaagttcgctacgtcgggcactcgacctggcccgcgagtgccatcgtcgaggcgcagtgggtggccaaggagcggggctacgcgcgtccgcgcaccgagcagccgccctactccatgctcgtgcgttcgatcgagcgggaggtgctcccgacctgtgagcgctatggactcggtgtgttgagttggagccccctcgccggaggttggctctctggccgggaccggcgcgatcgcttcagtggcccgcagtcggctgcacgccagcgggtcgctcgacgtttcgatctctcgctgccggagaaccagcgcaagctcgacgcgaccgagcgcttggcccagatcgcggcggaggcggacctttcgctgatcgaacttgccatcggcttcgtgttggcgcaccccgccatcacttcggcgatcatcggaccacgcaccatggagcatctcgagtcccagctgtcggcggccgatgtcgtcgtgccgaccgcggtgctcgacgcgatcgacgacgtggtggcgccaggaacgacgatcaatccggtcgacgatggctgggttccgccctggctcgagccgactcggcgtcgccgtccctcgggtgcgtgagctcgacgcagtcggcgcgctcgatgagctcgtgggttcgttcgggccgcacctcgcgttcggccgacggagctgctcgcacctcgacgacgatcttcgggaatcggcggtgctgcgacgaacgatcgaaccgagtcggtgatgcggcgtcctggccgcgtcgtggtcgctcgtgcaactcgagcaggacacggttcgcgaacgccgtctagcggcgacgcatcgtgactctccagagccgtcggggcaggtcgccctcttcgaaggcggtcacgtcctcgagctcgaagccgtcggcgaggcgatggacgaggtcctcatcgaagaagtggaccgcgaagccaccgttctcgaagcgatcgtcgccgaggtcgatgccctggccgtagtgggcgtcgcccttgtggcgcaccgtgtagacgcacgtcgcgcccggtcgcaggactcggtgcagctccgcaccgagggcgacgagctcggacgtcgtgaacgccatcgtgaagagcatgtgcgcgaagcaggcgtcgaagtagccgtcggccagcgggagaggccgacataggtcgtgggtgaccgaggtgagccgggcgccggttccacggccatgtgctgcgtcccagagggctgcgagtccactcacggcgtagtcgaccgccgtgacctcgaggcccgcatcgagaaagtgcagggtgtcacgaccgtgcccagcgccgagttcgaggacccgagcggccccgtcagcgagcatgcgtgagagagcccatcgaccagcctcacttggcgccgaaccgtagagctgcgggctggcacgaaaggtggcctcccagtgggcttgctggcgtgttccgagatcctcgaccggtgtgctcattggtctgcttcctccgtcgcgtctgcagggtgtgcgctcccttctccccgatgccatggcgtcgctggtcgtagcggcggcccacggtccccggcggctcgatcgggagatcgtcgatctgcgctctcgactcgatctgcgctctcgaccccctgcactgctcgtccgtccatgccacgatcggatttgtcgtcgggaacatcacggagggccccgtgagcatcgccgtcgcgctgatcggcaccgtgaccatgggtcttggcctcggtctcgcgtggctgtatcgccggctgatcgagccatccgaggcgcaacgcacccttcgagcgtactcgagtcgcgagcgccgttcgatggaacgtcggctgcttcgcggtggtggtgacgagttgcctcgctcgtacctgatggcgctggtccaagatccgtcaggtcgcccgatcatggtcgccatcgcggtactcatcgcgatcgtcatcgggttcggggtttggctcgtcctctccgccctctggggaccgctgcgacccggagtgatgctgtgggacttcgtggcgacccaagtaccggcgtggagcggcgtcgcttatcggcgacggcggatcgtccgggcagcgcaacgtgctcttggatcctcaccggcttcgttgcgtcgttgacccgctgaacggcacgatgcgtgctgcgtccctggagcgtgtcgctcgtgcgacctcgctgtgacgtgcctacactcaggagcatggttacggggaagtcgcagagcgtgctcgatgccatcggatcgacaccgctcatcgaggtcgagccctccatcttcgccaagctcgagtacctcaacccatcgggctccatcaaggcgcgcatcgcgcgctacatgatcgaggcagcggaggcacgcggcgagctcgagcccggcatgaccatcgtcgaggcctcgagtggcaacacgggcaacgccctcgcgatggtcgcggcggtgaagggctaccgcatggtcgtcgtcatgccagaggggctctcgtcagagcgcgcagcgatctcgcgcgggttcggcgcggaggtcctgcgcgtcgggaacttccacgttcagcatgcccgcgagaccgcggtggagatgggcgagcgcccgggtttcttctgcccgcgccagttcgattccgaggacaacgtggccgagaaccgtgagtggctagggccggagatcgtgaccgatctcggtgcaccgccggacgcgttcgtcatgggtgtcgggacgggcgggacgctcatcggcgttggtcaagcgctccgggcggtcaaccccacgactcggctcgtcgcggtggagccggaggagagctgcacgatcctctgtggtgaagttcaccaccatcgcatcgagggcatcgccgatggcttcgtccccacgatctacgagcgccaccggacgatggtcgacgaggtgatcccggtcacgagcctggacgcggttcgcaccatgcgcgagctcgcgcgccgcggcatgttggtcgggccgagttcgggggcgaacctggtcgccgcccgtcagctccgcgagaaactcgggccgaacgccacgatcgtgacgatctttgccgacgagggggagaagtacctcacggagtacttcttgacccgtggcgagctcgctgcgatcctcgagggcagccacgacgacgactgggtcgccgcctcgggcggcatcacggcgccgttgcctccccttgctcggtgaggaactgacgctcgaagagctcggcgtagagcccacctgcggcgagaagctcggcgtggctcccttgctcgacgacactgccggcggccatgacggcgatggtgtcggcaccgaggacggtggagaggcggtgggcgatcacgatggcggtccgtccctggagggtgtcgccgatcgctgactggatgagtgcttcgttctgagcgtccaggctcgaggtcgcctcgtcgaggatgacgatgcgcgggttgcgcagcaggacgcgcgcgatggcgagccgttgcttctcgccgcccgagagtcggtagccgcgctcgccgacgagggtgtcgaggcgatcagggagggcctcgatggtcgcgaggagctgggcgcgcgcgagcgcatcgcgcagctcgtcctcggtcgcggatggcttggcgtagcgaaggttcgcgcgcacggtgtcgtggaagaggaacggatcttgggtgacgacgccgatctcggcccggagctcctcgaggtcgagctcgcgcaggtcgatgccgtcgagcgtgacgcgaccgcgctctggatcccacatccgcgtcaccagcatggtcaccgtggttttgccagcccctgatgggccgacgagcgcgagggtatggccgggctcgacgtggagcgtcaccccggcaagcgcccaatcacgctcctcgctccgcgggacaccctgcttggtgaggctcgcgaccgcctggttccgaggatagcgaaaccacacgtcctcgagggcgaccctaccctcgacgcgctgcaggtgacgtgggttcgggggcgaggtcacggcgggttggacgtcgaggacctcgaagatgcggtcgaagctcacgagtgcctggagaaggttgacccgagccgaggagaggtcggtgatgggcccggtgaggcgggtgacgtactgcgcgagcgcgacgagcgatcccagggagagtgcgccgcggatcacctggtcacctccgagggcatagaccgcgatggtcccgatcgcgctcgcaagcccgagaatagcgaagtagaccctgccgaccagggcgaagcgcacacccgcgtcacggacgcgacccgcatgatgggagaaggtgtcgagctcgtcgcctcggcggccgaagagcgcaacgagcagcgcgccggagacgttgaagcgctcctgggtgaaggcgttcatctcggcattggcttgcatctgttcgcgcgcagcgtgtgcgacacgacgcgacaagaggcggtcgacgaggacgaagaccggcacgatgagcaacgagagggcggtgacgagcggtgagagcgcgaccatgaagccgagcgtgaagatcagggtcgaaagatcgctcaccaccgagccgagggtcccgacgacggcttgtgagctggtgacgtccgaggagatgcgcgagagcaccgagcccgtctgtgcctcggtgaagaagccgagcgacagctcctggaggtgggcgacgagacgggtgcgcaggtcgaagatgatccgctcgccagcgaccgaggagacgtagcgcgttcccacgccgagcgcgctctgagcgagcgacagcgcggcgatgatgacgacgtcgatcgtgaggcgcccgatcgagcgccgaacgatggcgacgttgatgatgtctcgcaccacgagcggcaccagtgcgccgaggagtgcggagatggcgagcgtggccaggtagacgatgatgagggcccgatggcgcttcgtgacgctccaggcccgccgaagcgtgcggcgatcgatcgagcctggccgcaccggatcggcggccatgcctcgcagcgcgcgcattccgccgaagccccctccaggctgcaccgcgcctcctctctcggaaccaggctagacgcggtggtgttggccgagcagggcggctcgcgtagggttgagccgtgaaccagctcgcgcagtcgctctacgaggtcgtcgtccgtcgtcgagacgtacgtcgggagttcatcgatgggcccctcgatcccgaggtcctcggacgaatcctggccgcggcccatcacgctcccagcgtgggcatgagccagccctgggacttcgtggtggtgcgcgatcgcgagctcagggcggcctttcgagatcacgtgctcgaggaacgggcgaacttcgccgcgtcgctggatccggagcgtcgggaacgtttcgacaacgtccggatcgagggcattctcgaggcgcaggtcggcatcgtcgtcacctacgacgcctcacggggttccccgaacgtactcgggcgccacgcgatcgccgatgccggcctctactcggtgtgtctcgccatcgagaacctctggctggccgccaccgccgaggggatcggggtgggttgggtctcgttctatcgggagccgttcctcgcctcgctgctcgggatccctgcggggatccgtccggtggcctggctcgcggtcggtccggtggcacgattccaggaggttcccgatctcgagcgagccgactggcagcgccgtcgcccactcgcgcccttcgtccacctcgaccgcttcgacgccgacgcccccggcgaggacctggtggtcctgccggagcgcctggtcggggaatcggcggacatggactgagcgatctgcgggtcgcgttcgtctagggcgcgatcgtcgtcgcgaccagcagcgcgagcagcacgtcgcgggcgccgagcgctcgttcgagctcgcccagagcgtcgtcggaaggacgcggggccccgtcgatgatctcggccagggcgaggcgagcgatccgatcggtgatctcctgcagtgccgccgcttcgacgagattcgccgggaccaacgcgcgtgcgcgctcgcgcaggcttcgtgcccaggtctgatccagcagccttgctgcgtcgtccgcacccacgcggccagcgatgatggcggccagcgcgagggtcgcgccgcgccaggctgcgaggcctgctacgtgggcgtcgtgtccctcggcctcgagcgcagccgcctctgtgcgaagccgctcgtcggccgtcagctcgttgacgagagccgcgcgctcggcaagcgtggttgggtcggcaagctcgagcggatcctccacgagcagacggaggtcgagcgccgcgtcgacgagggtgtcgcggatccgtccataggcaccaagccgacccgcgaagctcccgtcgcggcgccagagaaggcggcgagcgacgtcctcggcccccgtcgcgaagatggcgatcgtggcaaactcggctgcgcgcagatagctcgttctgccaagctgggcgatgcgggccacaccgaggatgccgaggtggttcacgaggaggttggcgagcgccgtcgcgaccaactcgcggcggagcgggtgcgccacgcctgcgtccgagacgaggcggcgtacctcgatcgggaagtagttgaggaagagctcgtcggtgatcggatgatcgagcaatgaggaggactcgaggagctgcgtgaggtggatcttcgcgtaggagatctcgatcgcgagctccgatctggtgagcgggcgccccagcgagcctccgcgaacggccgctggatcgggcagcgtctcgaccgccacgtcgagctcggcctcgcggaccaggcgctcgagcagcgcgccatgctcctcggcccttcgtccggcctcgtgctcctcgaggctgaggacccagttctggtagacgttgtcggccaggacctgcgcttcgacctctccggtcagctgtgcgaggagctggttgcgctcttcggtggtcaggtgaccctggcgccgcagctcttcgagggcgatcttgatgttgacctcgtggtcggaggtgtcaacaccggcagagttgtcgatcgagtcggtgttggcacggccaccgtgcatgcagtactcgatacgccctgcctgcgtgaggccaaggttgccgccctcggcgacgatgcgtgctcgtagctcggatcccgtgacgcggatgcgatcattggcgcggtcgccgacgtcggcgtcgcgctcggtcgtcgcacgaacgtaggtgccgatcccgccgttgaacaggagatcgaccggcgccatcagcatggcgtggatgacctcgtcgggttcgtgagctccgggggcaaggtccaggagcacggcagcctctggcgagaggtcgacgtgcttggctgatcgcgagaagacgcccccgcccgccgagatggcatcggcgggatagtcggcccagctcgtgccggccccgcgtgcgaagaggctcgcgcgtgcggcaaacgaacgttccgggtcggggtcggggtcgaggaagatgtgccggtggtcgaaggcgcccacaaggcggatcccgtgcgagcgcagcatgccgttgccgaagacgtcgccggacatgtcgccgatgccgatcacggtgatggggccgtcggggtcgcgctcgagttcgtcgaggtggtgtcgtaccgagatccacgcacccttggcggtgatgcccatctccttgtggtcgaagccgttcgacccacccgaggcgaacgcatcaccgagccagaaacccatctcgagtgcgatctcgttcgcgatatcggagaaggtcgccgtgcccttgtcggcggcgaccacgaggtagtggtcgttgccgtcggtgacgaccgtgcgagggggatggacgatggttccgtcgacgaggttgtccgtgagcgagagcagggtgcgcatgaaggtgcgatacgagcgctcgaccttgtgcgggttgcgctcaccgggtgcgaggtcgcgaacgacgaagccgcccttggagcccatcggcacgatcaccgcgttcttcacggtctgggccttcatgagtccgaggatctcggtgcggaagtcgtcgggccggtcggagaagcggatgccacctcgagcgatgcgtccgccgcgcaggtgcaccgcctccgtggtgcgcgagcgcaggtagatctcgaagcgtgggcgcggcgagggcaggtaggtgagctggcgcgggtcgagcttgaacgcgatggcctcgcgttcgggctggaagatattggtccgcgtcatcgccatgacgatctcggcgagcgcgcgcagcaccttctcgtcctcgagcgtcgctgcggcctcgatatcggtggcgagctgggtcgtgatggcctcgacgtcacggggtcgatcgagttcgctggcgtcggggtcgaaccgcgcgtggacgagccggacgagatcgcgagctgcgagcggggtgcgggtgagcgtgcgtcgggccgaagcctcggtgacaccgagcgtcccaaagcgcaagtaggcacacagcgcgcgtgtgaggtcgatgtcatcgaggtcgagcgcggccgtcgtcacgagggtgttcaggtcgtccgcctctgcctgacctgcgatgaccgcttcgatggcgcgttcgaggcgatgggccgctgcgtcgtcgccgagcccatcggcgacccccgctggccagcccaggcgaagctcgatgatccacacatcctcgccggcgacccgtcccgtgtaggggacttcctcgcgtacgcgtgcgccgaagccctcgaggaccgggacgatgtcggacagcgctggtcgttggccgaccgcgacgagccgaagtcgctccacctctccggtcgcgggtcgacgtaccgcgagccgtactggcgagcgtcgcgctcggccgagcgcgaggacgtcgagcgccgcctcgcgctcggtggtgtcgatggcgtagctctcctccatgccctcggcgagcgccgtggcgaggctcgaggtctctggatcggcatcgggggtgctgagggcattgacggcagcctcgaggcgcagacggaagggggtcgtggcggcggcgatcgccgcctcgagctgactcggatcctccgggacgcgatcgaggaggtagtcgaggacgagtcgccgctcggagaggttctgcgtgagctgtgcggtggcaacgaggccacgctcgacgagcaccgcctcgaggcgatcctcgacgccatagtcgacccgagcggccggcaccacgaccacgagcctcgcccccgcctcgaccgggatcacgagggcacggggcagcccgagttcctcggcgagcaatccagcgcgacacagctcgtcgaaggttgcgtcgtcgactccgatcgccaggtcggcagggagcgagccgacgaagtcgcgcaacacgcgccatgagtggctcgatggcaggagcgcgaggagctggcggacgcgctcgaggcggctggcgatctcgggtgcgccaaccccgatcccgctgacgagcgacgggcggaaggtccccacgaagtgcacggcgcccgacgacgtcccgatggacagtgtgcgcagcggcgagtgatcgaggatgggggctgggatcgcggtgggctcgaggcgccactgccctgccgagaccgccagggttggcacggcgacgtcgatgccccgccgctgttcaccctcggcgctgactcgcagttcggcgatcgggaggaagtgggcgatcgccgaggttccgggcgtctcgccaccgtcgaggccctcggtcgcctccgcaagcgttgcgagctcgtcgcccatggcctcgcgatcgtgctcgagtcgcagcagctgcgtcgcctgcgtcgcgagggttcgcgcgaggtgctcggtctcgatgcgtgacaggcgggtcggtgtcgtcgctgcgaagaaggagacgaggtgggagccctcgacgaactcggcgttcgcgtcggtgagctcgccttcttccaagatgggatggaacgtgctcgcgttgtccacgatctggcgtaccgcggcgatgaaggtgtcgacgagccaagggacatcccagctcacgaccacgatgctcgtgagggggcgcgccggttcggcgatgacccgctcgagatcggtcgcgccgtcttggccacagtgcacacggaggacctcgttgtcctgggcgatctcgacgatgcagcggtcggagcccttggcgttcgtgagcgcatcgaagagggccgcgaccgcgacgccgatgcgctcggtggtgagcgcgctggtctcctcgtcgtcgaggtggcgcgcgaggctcgcgacgaagtgttccagggcgccagcgtgcgacggcacggcgccagaatgtctgcggaccgatgacaagagggacgccgtttctggacgcccagtaccagcttcgagcatcgtacgactcctttgtcgactttgcgatgccccgagcctaccgagctcgtgcgacttcgccaagggctcgccgggcgctcgaggcgctcggagccctatcggcagcttcggcgacgacttgcgtgcgtcgtgcacggctgcggtggagcgagctgcgacctggaggttctcgcccgtcgcagcgcccctcgcagctagcggcgcgcgatctcaggggccataatcgagatgaggtggtaggcaacgtgggaggccgcgatggtcgtgacctcagcgtggtcgtaggcaggtgcgacctcgacgacgtcggcgccacggatggaaagatcgcgtagcccatcgaggatcgcgagcaattccctggaggtgagccctcccgcctctggtgtgccggttccgggcgcaaaagccgggtcgagcacgtcgatgtcgatcgagacgtagacaggtgcggtgccgacacgatcgcggatgcgctccaccacgccatcgacgccgatgcgatcgacgtcacgtgcggcgaggacgcgaaagcccatgtcagcgtcctcggtgaggtcggagcgcgcatacagcggtcctcgggtgccgacgtgcacgctcgcgtcgggggcgaggaggccttcttcgaacgcgcggcgaaacggcgtcccgtgcgtgtagggcgcgtcgaagtaggtgtcccaggtgtcgaggtgagcgtcgaagtggacgagggcgagtggtccagtgcggggcgccagggcgcgtaacagccccagtgcgatggtgtgatcgcctccgagggtgacgatggttcgaccagcctcgccgagctctcgcgcagcactcgtgatggcagtgagcgcagcgtcgatcgagaacgggttcgccgccacgtcgcccgcgtcggcgacctgtacttcggcgaatggccagacgtcgaggtcggggttgtatgggcgcagcagcttggagcccgctcgaatggctgaggggccaaagcgtgctcctggtcgatacgacgtacccgcgtcgaaggggacgccgaggacgaccaggcgagcgtgaggcgcctcgtcgagacggggcaggcgtgcgaaggttgcggggccgccgaagcgcggcgcgacgagcgcgtctggcggtccgatgatctcgtcagtcatggagccctcctccgttccccgggcccatgcgcgctgtgcgctggtgctccttgcaccttagaggcagtgtgcggcctccgccatggcgagctagcgtgaggacgtgcaggctccacgctttccgatcggcgagcggctgcgccatgctcgcgagcaacggggtctctccctggccgcagttgccgagcgcactggcctgtcgaaggggttcctctcgcgggtcgagcgcgacggggtgagcccgtccatcgactcgttggtcgcgatcgccgatgccgtcgggctcgccgtcgcggacgtctttgcggtggcaccggtggtggtttcacgctccgtcgatcgcttccccgatggactgcctggcgagggagtccgggacacgttgctctccccacccgacgatcggcgcgttaccgttctcgagacggtcgcggcacccggagggagcggcggtgacgagctctatcacctgccatcgcaggtggaactttgctacgtggtcgccggtcgtatcgaactcgttttcgcgagcgagtgctacaccctcgatgcgggtgactcggcgaccttcgctgccgacgcagcccacacatggcgcaacctcggcgacggcgaggcccgggtgctctgggtgctcgcaccggcccttcgggatccctggacagccaaggagcgccgcgacgacggttcggtcgcggacgtgcagggcgaacgtgtctaggaggacgcctgccaccgcaggagccgctcgtgtcgtgctcctgacgcgcgacctgttgggcgcgagccgactcgactcggtccggatcgtgcgctcgagcacgagcctcgtcgacggagacctcgacctcgtcatcgtcgatgtgcgtgcggcgcccgagggatggcgatcggccgtggcgggactctcatgtccttgggtggccgtcgtctcgcacgtcgacgacgctggccgggatgaggcgctcgcactcggtgctcgacgcgtggtgacgcgcagctggctgttcggtgcccgcgacgtgggcgcgcgtctcgagcgcttgctcgtcaccgacacgaaagcgacgggaacggacgcggtggcggacgcggaggacgactgatgcgccaccatggcttcgtcctggcgcccgtgttcttcgtggtgctgggcgcgttgttcctcgggtccgttgcgttgatcggactcgatgtgctgtcgtttgcctatgtccgcgttggcgtgccggccgcctggctcttcggtgtgctcgtggcgtcgctgctcggaagcttcttcaatgtgcctgtatggcacctcgagacgcctggcgatccctacgacgagggcatcgtgagggtgttcggcgtgcagtatctgatccgacgcccggtcgcaccccagcggacggtcgtggcggtgaacgtcggaggtgccctcgtgcccaccgcgttgtcggtctacctggtcgtccacgaccacatcgagctcgttgccctcggtgccaccgtgatcgtcgccctggtcgtccacgtcgttgctcgaccggtgcgcgggctcgggatcgcagtgccgacgctggtgccggcggtgctcgctgcgctcacagcactcgtcatcacgagtcgcgacgtcgccgcggtcgcctacgtcgccggatcgatcggagtcctggtcggcgctgatctgaccaacatgaccaagacgcgttccttgggcgctggcatggtctcgatcggcggtgcgggaaccttcgatggcatcttcgtgacggggatcctcgccgtgctcctcgcggccctctaggaccgctctcgggttcgtcgcaccgatcgggtccttcgctgcgtgcacgcgagccgaaggaccctggtggcgcgccgcctcgctcatcacactgaggtgccccagatttcgtagacacccaggttacttcacgcgagcctcctccgcgacgaggtgctcgaagacgactggggcaaggtagccgatcttcgagcagctgcgctggtggttgtagaactggatgtagctctgtatgccgcggcgcagctcggcgaggtcgccaaaggcgtggcggtagaagaactcgtgtttgaagatcgaccagaaggactccgcgctcgcgtggtcgtagcaggtgccggttcgccccatggagcgcgtgatcccgtgtcgggcacagaaggccacaactcgatggtcgctgaactgactccctcggtcggtgtgccagatgaccccctgcgcgtgggacccacgcaccgcgacggcctggccgagggcctcgagcacgagcgtggtctccatgcgctccgcgacgctccatccgagcacccgccgcgagtgctcgtcgcgcaccacacacaggtatgccatcgcgccggcgagagcgaggtaggtgatgtccgaggtccagagggcgtgcaggcgccccgggtcgaacttcctggcaacgaggtctggtgggtagatcgccttcggatcggcgtgggtggtcgctgggcggaacctcctggggctgataccggcgatgccgcgcctggccatcgctgctgccaccgtgttgtggctcgtcaccacgccagcggcgaggagtgccgccgtgatccgtcgtgcgccgtaggtgccagaggatgcctggtggaccgcgaccactcggttctcgaggtcgcgtcttgcacatgcccgacgcgacggtgctacctgggtgcgtcgccatcggtagtagccagcccgggagacctcgagtaagcgtgccatccgtttgatctcgaagcgagcgtactccgcctccatcagcgcgaatctctcttgcttggtggcttcgcggcgaagtacgcggctgcttttcccaggaactcgttgtccttgcgcagctcctcgagctccctgcgcagcctgatgagctccgtgcgctcctgcgccgtgaggggcgggctgccagtggcgttggctgcttcgatccgcctgcgctcctcccgcacccatcgatagaggttgtgctccccgatcgcgagctcacgggccacctctgggacgctccggccgctgtcgatgacccggtgggccgcctcggtccggtactccagggtgaacttccttctcgacgtccccatcgacctccccttccctctgccatggtacgtgtgacttacgacgtgtcaacggaatctggggcggctcacactgtcaatggcggtcgttggagtgcgaatgactccaccgtcgcccatgcatccagattgaggaggtacaccatgagacgccgcgtctttgacgtgctgacgagcgccgtaggcctggcgatggtcgtcgtcttgctcgttgcaggatccttgctcatgtgggggtccagctttgcgagctcacaggtccacaaccagctcgcacagcagcagatctacttcccgcctgccgccgcgttccgccacgccaagcccggtacggagatcaccccatcgatgatcccgtcggtctcgcagtacgcagggcaacagctcctgaccggtcagcaggccgaggtctacgcgaacgacttcatcgcggtccatctgtccgagatgccctatcacggtgtctacgcgaagatctctgcggcagcgatggcgcagccgaagaacgccgagctccaggcgctgcgcctgacgtcgttcgaaggcaccacgctgcgcggcctcttgctcgaggcctatgcgttctcgatcttcggtgagatcgcattctgggcttcggtcgcggcgttcgcgctcgcggcggtgatggccgtcctcgtcggactcggcttctggcacgcggggcgcgtcccgctcgacaaggagatcctggtcgattcgaactccgaacgccaggtccacacgatggcttgagggcgagatcgttcacacggtgtcagcgcgctctggggcaggtcctcagggcgcgctgacgtctgcgtggttgtctcgccacgtagagttgggtcgtgagcctccccagtcgtcgatcgcaggagcgtcgagccgatctgacaacccctgctcgcacctcgacaggggtcgggcgccgaacgacgtctggagccctcgggccagagcagctcatcgagctgcagcgcacgatcgggaacgaagccgtgcagcgcaccctcgcacgccacggttccgttggtcgccggcgctcgggcgccgtcgccgggatccagcacgctccgtcgacgttggcggcgatctctgcacacgggtcgacgatccggcacgcggtggcggcggcggttgctgcggtcgtcgttgcgggggtccagaaggcgacgggatcgaagggcgggtcaccggagggtgacctgctggatgcggcgctgggcttcgcacgtgcgctcggtgcgagcctcgagcgagacgtgcgcacggggagtggtctcgtcgcacgatctggcgacgatcgcgcgacgcttggcgcacgggcacagttgctggccggcgaagggagcctgtccgacacgaaggcggcctcgacgatggccaccaggctcgccgaggtctacctgaccacggctctgaccgaggaggcagcggccgccgctgagcgcaggctcgccgagatcgcgcccgagatcggtcagatcgacggcgagctcgctcgagcgatcgcgcacgcgcagtccgaattggaggtcgaacagcagctctcggcgacgacgcacaccctgaccgatcgtctcacgaaggtcgccgtcaaggcgatcggtcagaagcagcaccgtgcggtgcgcgatgcgatcgcggccgatggccttcgtggcgcgacggacgtgctcgagcggacggtcatggcggagtccggcccgaaggccaccttgagccagacgtcgaagtcggtcatcgccaaggcactcggttcgtcgctcagtgcggacgcgctcgaggtcgtcgacgaggcctatcagtcgctgcgtgcagcggtcgcgacggcggttgcggcggagatcacctcacggatcgagggtggatggttctcgcggggatcgaagcgagcttccgtgctcgaggcacgagccgaggccgcccggctcgccgacacgctggcgttcgccttggagcgggaccttcggaccggcaccggcgtcgccggcacctatcgcgcgaccggagacgcagccacggatcgggtgggttcggcgacccacacccgataccgggctggtctgctctcgaaggagcgcagcaaggcacccgagacactcgtgtcgcagcttgccaaggcctatgggcatctgtcgctctcgcgtgcggccacgacggcggtgacgtcacacctcgacgagatcgatccgtcgcttcccgaggcacggctccggctcgtgcgcgcggtcgacggtatcgccgatcgggatcaggcgcgcgccgtggtcgccaagcagctcgcgtcgctcacgagccgctccagcgcgaacgccgtcaaggccatcacctcctcgtcgaacaagccgcttcgcgacgcactgaaggatgagagcgcgaagggcgccgtcggcgagctcgaggctgtgcagcgtcaggagtcgggtccgagcgctcgccaaagctccttgaccgatcaggtcctcgcccagaccgtcacgttgccgtcgctcacgccgttcatgtcgctcgtcggggcgatcatcgatcgatcggtgcagcacaacggggacgagatcacccttgatcacagcgtgcgcatcccggtgtcgcacggcgcattcgtcgggctccgagccgtgggcaaggcgtcgcgtgaccacgacgcgacacgtgcgggcatgaccttcagcttcacgggcggatgggacgccgccatcgcccgggcgatggccggtctcggtggctacctgaccatgacctcgaaccgtggtggacacggcgccatggagatggcttcgtacaccctctaccgacgctttcgggagtcgcggttggtgcccgccgatctcacgagcaccctctggggcatggggggcatcacgaagggcgccgacgaagagcaagctgcggcacagtaccgtgaggcagagtcctgggcctcgggcatcgagcagtcgatgacggaggcagatgccgctgagtcgggtctccacgccgaggtgagcggtcgcctcgggcatgcgagcgttgcccaggtcgagggtggattcgctgtcaacaccggtactcgctacaccaagcagacgttggagcgctctggtgcgctcgcagcaccgcttgcaacagcgggctccggccgccagccgttgcgcggcgagcgggtgacgaccttcgaagcgttcgccggagcctcgggtgggggcggcatcggcaccacggaggcgtacctcacctacagcgctcccgacgcgagcctgcacaagccctatcgcttcagcgtccaggcctcggccggggccatgatccccggcatgcccggtcagatcgtggactgggcggtcgagggagcgtccaagctgacgagcgctgcgatgggggcggtcaacaagtgggagcagggcagtaaggggagcgcggcgctcaaaggggcggaagtcaccgccaaggccgggctcgaggtcatcgagttcccggtgctcaagaacgctctcaaggaatcggctggtgtggcagcgatcctcggggcgccgatcgtcgacatcgccgagtcgtcgacgctcgcccaccagcccagcgtcgtcggcgtggccgctgcgcccctcgtcggaaaggccaatcgggagtacgccaaggaggctggctcgctcgcctccacgcggttgatgtccgcatcgaacccgacgagtgggctttccttcaccctctacatcgacttcttgcacccgaaggagcgcagctacttcgcgctggcgcgccagacgtcgacgcaccatgacgcgcacgtggtcgaggcgaaggtcgtcaagcgcacgtcgctcttctacttcgatccgaagtcgggtcgcctcgaggctggcggtgcgcgcctgggaacgacgcgctgatggcgttcgatctgttcgacgtcgttgtcgatgcgtgtcgtgtgcagggcttggacccccagcctgtcggcggctacgaccatgtcgtcgtggccgaggtcgaccggggggatcgccgttggcgcttgttcgccgaggccgatggggcaacccccggcgtcatcgtctactcggtgttgccgtacgccgtcgcgtcgacccatcgagacgaggtggctgggttcgccgtgcgggtgacctacgtgctccgctacggggatctcgaggtcgatctcgacgatggggaggtgcgtgttcgaacgagtgtcctggtcggggctggcccggtcgcactcgatgtcgtggcggaactcatcgagcacaacgtggcgatcgccgagacggtcttcccgctcgtcgagcgtgtcgccgtaggcgagctgagcgccgacgaggcgttcggtgtgcttgcgtcatgatctggggagggtcgacgttcgtcgtcgcattcgccccgactcggacggacgctcgagggacggcgctgctcgagatcgagggtgacctctcggatcagcgaacgggagtgtcgagaggcttcgggccgcctgagggtcggtggctcgcgcgggtgggccgttcggcgcgaggagcgggccgctgcggtgttgcggtgtgtgcacgcaagcggacggtttctgtggggcgttgagacggcaggacgcggtgccgtggttgcctgtctcggtggggctgtcgtaggatcgtcgcgtaccgatgaccatccgagtggaggttggtatgcggagtctctggcgtgttcgccatccggtgcgggcggcgatgccacgctccatccgacgagcacggcgtcgggcgtggcgcctacgtcatcctctgcgtgcgtcgctgtggacgctcgcgagaggtcgccgtccgcgccgacaccgccatcggtgaacaccagtgcgatcgacgggcgtccgtctcgatcctcccacgtggcgtgagctacgatccgctcatggatcgcgcggctcaggcgtcgtgggagacctggtgggtcgagggcgaagcgtgcttcgcagccgttgtggcgacgctcgaggccgatgccctgacagggccatccttgctcccgggatgggatcgtgcgacggtcatcgcgcacgtcgcaacgaacgccgacgcgctcagcaacctgctccgctgggctgcaacgggagttccgaccccgatgtacccctcaccggaggcgcgtcgtcgagcgatcgccgagacggcgagcctccctcgcgaccagctcgtcgcgcgagcggagagcgcgcgaggcgagctcgccgcacgcatgcacgatctcgctccagaggcatgggatcgcccggtcgagacccgtgacggacgcgcgatcgtggcgagagaggtggtgtggatgcgttgtcgcgaggtgtgggtgcacgccgtggacctcgcggcgggcgttgggttcgagtcgatgcctccagccctcctcgtcgcgctcgcggacgacatcgtggccatgtgggcgaggcggagcgtcatggcgccgtgtcggctggtcgccggtgagcacgcctggggcgtcgaaccgccggtcgtggaggtcgatctcgcgaccgcggtggccgttctgagcgggcgtaccccgctcgagacgctcggccctgcggtggcagggctcggtatgcctgcgtggatctgaggttgtcgtgcgcaggtgctgtcgggtcggtgtcggcgccggcgcggatgtggcaacgacctgtcgggcgacggtgacggccacgtgcagcacggcccgctgcccgacgaacgctccgcgcgaccgacgttaccactgggtcgggactcctcagagcgcatcttgttcggggatcgttgtcccatgttggccggcgcgtctcgcacacggccgtgaccgagggcgagggcgaccacactgggacgatgaccaacgtcgagaacgtccctgaagttcgtgtcgtgagtgccgctcgagaggtgcacgcgacaccggcgaccatcttcgagctgatcgccgacccgtcccgtcatgcgtcgtgggacgggaacgagaacgtggcctccgcgagcgaacaccagcgtgtgacccgtgccggcgatgtgttccgcgcgaccctcacgaccggcgctgtccgggagaaccacgtcgtggagttcgaggagggtcggcgcatcgcgtggcagccggctgagcccggcaaggagccgcccgggcacctgtggcgctgggagctcgagcccctcgacgcggagcgaacgctggttcgccacacgtacgactggacggccctcaacgatccgaatcggttcgctcgggcccgagccacgacctccgagcggctcatggcatcggtcgagcggctgtgcgcactcgcagagcgcgaggcctcggatcctgcctgagcgtgcgcacgccgttgagcgtgtgttcgatggggcgaacgttcgctcgtggatcaaggccgatgcctcagacgtcgatcgggtgatctcgaaggcctggcagagccggcggtgggattcgaacccacgacctgacgattacaagtcgcctgcgctaccactgcgccacgccggcgggcgcctgcaggttagcttgcctccaccgaacgtcgggttcaccgcagcgccgctcgccgtacggttcagcgagcgtcgtgggcgaggccacggtcctcggggccctcgcgatcgcggggccgagtgctgaccgcgaggaggtgggcgatggtcgttgccgcggcgaccatgcgatcggtctcgcgcatgatgacgcggttgcgctcgctgacgtgaggtgcgctggactcggatgcgaggagcgcggtcgccagctcgatctgggtcgtgcgggcgcgagcgacgtcgacggcgaaccgatctccgcgggccgccgccgcacagctttggaggaggtccgcgaggtcgttgccgaggcgtccgaggggcacgcttggagccggtgtcgtgcgttcgaggtcgaggagtcggtccagcacgagggcgctccagacatagcgccgcacggcggcgaggacgccgaggacccgctcgtcgtcgttgacggggtcggagcccgaatgtcgtggctcgtcgagccagcggctgaccgaggcctctgcccgctggcgcgccagccgtgctcgtcgacgcgcatcggtgaccgcgacccgagcagtcggggtgcctgactcccacgcgctgccgagtagcgctgcgtgctgcgcatccgcctccaggagggtggcgagccgctcgccgactcggcctcgttcccagctcggccacgcgatcaccgccatcaccgcgaggagactgccgagcaccgtgtagacgctgcggtcgatcgcgaggccgagcgcaggcgctcccgtgaaggcgagcagaacgacgacgagcgatgacaccgcgaagctgaagagcaggtagttcgcgcgctgggtcgcgatggcaaggccggcgagtgcgacactcgccgcggccagcgtgacggtggatggatgtgtgagcgcgagcagtgcagtcacgagcccgacgcctatgaccgtgcccatgctgcgcgcgaacgcacgacggagcgtcgtcgtgaagtctggtcgaagcacgaagatgaccgtcagtgggagccagtagcggtgggccaccggaagcgaggccgcgagcgctactgctactacgagtgtcgccgcgacacgtgcgccatggtgaccgacctcggacgagggtgccagggaccgtcgaagcgtcgccatggcgtcgtggagcgatgcgcggagctcaccctcgacgcggagattcgtgccgtcggcacggcgcatcggtgccgctcgccccaggaccactgcgccgagatggtcgaggctgcgcaggctcgcggcgaggttctcgatggcgaccgtcgcctcgcgagccccctcgccgagagctccgtgatcgtctcctgcacgctcgagcgtccagagggcgacgccgagtatccgcgcgatcgtcggcggcggctcatggtggcgctgggtcatgagccgacgtgcgagcacgtcgagcccgtcggcgagcgccgtgagcgccgtgtcgatcgcgtcggcgacgatgcgtgcgtccgggacgtcatcgtccagcgccacctgaacatgggttcgggccgtggcgatcgcggctgcctcgaggcggatgcgctctgcctcgtcggcgatggagcgtagagcgtcgaggatcgctgggtcgctaaagggctgcggttcgcgaagagcctgtcggagcgtctccgatccctctaggtcgagcacgctcggaggcgcagaaccgatcgcacgaagggtcgaggcgcgctctgcgagaagcgtcgcggcggcggtccgctccatcggtgacctgacgaagggaagggcgaagccgacgaggagcagctcgccgagcccaccggcgagcgtccaccaccctgcgacgagcgctgggccgagcgccaggtgttgatccgcgaacagtacgacgccaagcacggcctcgaggccgatgacgccagccgcagggccgagcgcgacggcccaaccggcggccaggccccagatcgcgaggatggccatctcggctacgaggacgtggccgagggtcgcccccacggtggccgaggcggcgaagacgatcgccccgaccaccatggtcacgatgcgagatcggtaggcaccttcgagcgagctcatgccggcgatgatggctccgatcgctgcctcgatggcgcccccgagatggtggctcagcgcgccggccgtgatagcgaccgcgacggcgagggctactcgagcgccagcggcgactcgcaggccgcgccgatcgaatcggtggagatcgagagccgggcgcgaggccgctagcgccgtcaccgtagccccggccccagtgctccggtgctggcctcaagacgcaggagccacgtcttgcgttcgtcgccgccggcgtagtgaccgggcgcaccgtctgcgcggatcacacgatgacagggaatcacgagcgggagcggattgcgggcacacgcagtgcccacagcgcgcgcggctcggggccgaccgatggcggctgcgatggcgccgtagctcgcggtggtgccgtagggaatgcgcacgagcgcggtgcgtaccgccgcgtcgatgccgcgtgctggtgcgagatcgatggggacgtcgatgtcacggcggcgcccacggaggtatgcatcgagcgcgcgctcgacgacgacggcgagcgccgcacgtcgcggcgagagtccgggcgtcggctcgaccgcgtcggcgtcgaacgtgatgcgcgcgagcccacgatcgctgaggccgatcgccacggttccgaggggtgtctcgacgagtgaccacgacacgtcgtgtccgttggctctgccgtcgtcaccgaggtccgctcgcacgtggcgtgccgtgacgtcgtgaccagcccctcggggtccccgatcgtcgtgcgggctgatcgctgtggcatcgatgccatgtggtgccagcgcgctgctcaccgcagtgcctcctcgtgttccaacagagaacccgatgcgcggcgcaagcgctgcggctcgggacgccccgtgcggtcacggtgcggccaccaggcggcgctggctagcgaccactggggagagtctactcgcctcgcaggtgctggtgccgggccgcgcccgactccgtccccctggtcgagatctcgctcgcaccagctagggtggttccgatgccgtgagcgttgggctcgcggacgctggcgcctcgtgacgccaggcgggccaacgagatcagttctcggccggtgtgatgcactggccgtggtgtcaagtcggccgttctttctcgagccgacaggagacattacgttcatgcatgctgacctcacgacgcccacctccaagcccgttgctggctcgtcgttcgccgacctcggcgtcccggaaccgctcgtggcggtggcgacggcccaggggctgctcgagccgactcccattcaacgcgctgcgcttccggacgccctcgctgggcgtgatgtgcttggctcggcgccgacgggaaccggcaagacgctcgccttcggtcttgcggtgctcgcacgtgtcagcgcgagcgcacgcgcgaagcatccgagggcactcattctcgcgcccacccgggagctcgcgatgcagatcgcggacgcactcgatgccttcgcacgtgcagagcgccgctcggtcgcggtcttctatggtggggttggctacgggcgccagctccagcagctgcgccgcggcgtcgacgtcgtcgtcgcgacgcctggtcgcttggctgatctccgcgagcgtggcgacgtcgacctcagccacgtcgaggtcgtcgtcgtcgacgaggcagatcgcatggccgacatgggcttcttgcccgaggtgcgtcgtctcgtgcaggcgacgtcgagcgaacgtcagacgatgctcttctcggcgaccttcgagggtccggtcgagacgctggtgcgcgagctgtgccacgacccggtccgccacgtcgtgacgcgaccggacgacgagcagggtgaggtgggtcaccacttctggaacgtcgatccgagcgagcgtctccaggtcacggccgccgccgtgcgagctgcgggaccggcggtcgtgttctgccggacccgtcgaggcgcggatcggatcgcggagcggctccgcggcgagggccttgcgacggccgcgatccacggcgatctcaatcagcgtcaacgcgaacgcgccctcgagggctttcgtgctgggcgcatcgatgcgctggtcgccaccgacgtggcggcacgcggcatccacgtcgatgacgtgccgctcgtgatccacttcgatccaccagagcggacgaccgactacgtccaccgttcgggccgtactggtcgagcgggtcggcgtggctcggtggtctcgttggtcggaccacgtgagcgctccttcgtccgatcgctccaacgcgaactcgggttgccgcacggtcttggagcaccggacgcggctctccttcctggctcaggtcgcgtcgagcatgtcgggggccgccgtcccgccgtcgggcgcgaggtcgaagagtctcgtgcggcgagcgaggggcggggtgtgccacgtcagcgcgatccgagagcccgccgtggctctatcggctcgcgtcagggtggcgccgttcggagcgacgcgcgtagcgcgcgtgcggacgcaccgagaggcggggctgcttcgcctcgtcggcctcgtcgtccggagcgctaggcgcgaggcgtctggtcgctgctcggcgcgctcgagcgtgcgtgtgttcgccaggcgccgagcagcgccagtcgacgtcgctgctgggaggcggcggcgcgatcgaggccgtggtcgcgctcgatgagagccgcgctcaccgcatcacggagctcgaccggcttctgatcgtcgtacttgaacttggcgctgacctcgacgatctcgagctcgagcgctcggatcgcgccgagcatggtgccatagggcggctcgccggggacgacggcagcgtgacgaccctcgggctggagatcgccgagctggcgctcgaggatcgccgcctttgcctcggggtcgtcgacgatgcgtggtcgacagacgaactgaacggcgctgtagtagctcgtcggcacgccgtctgccggggccgtcgcatctggcgcgcgccaatagcccggaatgaacgcgtagtcgccgtggaacgcgacgcgcacgcgcgtggctcgctcgaggtgtggccatacgggattggtgcgcgcgagatgagcaacgagcacggtgtcgacgagggagaggtggagcggcaggacgaggggagcctcgtcggggtcgaggttggcgacggcgaggacgccgaacggctcgtgctcggcgagccaacgacgccactcgtcctcgctggtggctgcgtcccacgggtgaatcagcatggcaggtcccttgcgtgtgtcgcgacggctctcggtgcgccacagcgcacctgcgcagcgtaacacgatcgccacgcggacccacacggtgccgtcgagcgcgccctagccttcgcgctgcgcacgagcgcttgtgcggactcgtaggtgacgacggcgcacgagtctcgtccgaggcatgggtcgtgaggggatgatggcggagtggctcgaggaccatctggcgatcctgttcgtggtcgcggtcgggatcggcgtcggcgttgggcggcttggcgggggaggtgccgtcgcgatcgggccgacgctcgcactgctcgtcgcagcgagcgccgtgaccgtgggcgctggcagtggcgtgcggtcaggttcgcgttggcgactggtgctcgtcgtcgtcgttgcccaggcggggatcgtcgtcgtcaccgagctcgtcgccgcgatcgagtccggcccgcttcgcgatgcggtgctgtgcctcggggtcgcgcccagcgaaatcgcaacgatcggtctggcggcgttggtggggcgggaggcagcccgcgctgcggcggtgctcgtggcgggctcggcgatcctgagcgtcgtggttgcgggccccgtgctcgggctcctcgcagtctcggggcatgtcgcgtcgaacggcgtcctcgtcgctctggcgctcgaggtggccctgccgggagcgatcgggatgggggtcgcgcgtctcgtccgacgtccttgggttcgcggcactgggcgtctcgtgagcccactcgcgctcctcgccctcggcgtcgaagtggggacgttggcgccgatcgccatcgctgacgtggctgcgatcggaagcttcgcgctcgtcatcgttgggagtgcggcggttgcgctcgcgatggcgatgctggttgggacgactgcacgtgccggtgtggtgctggcggtaggggtgcgggacttcgcggtcgcctcgggcatcgccgaggcggcgatcggggcgcacgcagcaggcgtgcttgcgctctacggactgctcggcgttggcgtcgcggccggtgccgagcgctggtggcgctcgagaggagcgcgctcctagcggctcccgagcaccatcgccgtcggcgaggcggcgtgcgcccgccgcctcggtggtctagcgtgaggcgcggaggcgatgggcgtgggagcgacggtgcgcatcgagcgagcgggtgccgtgtggacggtcctcatcgatcggcccgcggtgcgcaacgccgtcgatcggccgaccgccgaggcactggccgatgcgttccgagccttcgacgccgatgacgaggccgctgtcgcggtgctgagcgggaccggcggttcgttctgtgccggtgccgatctcggggccttcgggaccgagcgcgagaatcgtctcgacccgaccggtgacggtccgatgggcccgacccgtatggtcctctcgaagccggtcatcgccgccatcgagggctgggcggtcgccgggggtctcgagctcgccctctggtgtgacctacgggtcgcggccgaggacgccgtgctcggggtcttcagccgtcgctttggcgttcccctcatcgacggcgggaccgtacgcttaccgcggctcatcggtcgatcgcgggctctcgacctgatcttgacgggtcgggcggtcgacgcgaccgaggcgctcgcgatgggactcgtcaatcgcgtcgtcggtcgaggggccgcgctggatgcggcgacggagctggcgaggcagctcgctgggtttccgcaggcgtgcttgcgcagcgatcgcgcggcactgtatgcggccgagggacagtccgaagccgacgcgcttcgcacggagttcgtcgcaggtcagcgtccgctcgaggcagaggcgagagccggtgctgggcggtttcgccgtggggcgggacggcacggacggccactggatcaatgaccagggacgtggctgcgttgacgatggcgggccgcgcccagatcagggacgatcacgaccgcacccgtgcagtggtgcgcgacgcgggcgctcacggacccgatgagtgcatcggcgaaggggcggtgtccgtgcgcgccgacgacgaggagctgggcgtcgcgggcttcgacgcagagctgctcagcggggtctccctctcgaaggaccgactcgacggcgacggtgggatggtcctcgtcgatgtcggcgagcacgtcgtcgagcacacgtcgagccgcgcttgccaatgccgtgtcgtcggcgatcggtccgagatcgcccgctccagcgagttcgtagtcgtagggcgagcgccagacatgcacgacgcgcaccgtcgcgctgcgcagggcggcctcggcgagcgcccaacggagcgcgagtcggcttggttgggagccgtcgacgccgacgacgatcagttcggccatcagatcatgtcctccttccggtcgtggcctcggtagcgcccgctggagcgagggccgccgatggctccgctctcgacggtgcgctccgtacctgtctgagcagaggcgccttgatcgtgtcgagtgcgagtgtgagcaccccgacggcaccgatgaggccgacgacgtctgggaacggtacgggggccatgaggatgcccgtggtcgcaaggaccgccacgatcacgagatcggcaagggacgtgagggcgagccaccaactcgggggcgaggtccacagatggccgggttcacgcacgaggtagaccgtcgcctgaccggttgcgacgagcatgacgaacgcgagcgtctgcgtggatgccagcgacagcccgagcacgtcgcgtccgatcgcgacggtggcgaaggccacgaggagccacggcacagcgatgacgagggcggccagggcgagctggttcactcgccaacggtccggggagggggagtagctgacacggtcggtggcgagcgacatggtgacgacgtcgttggcgaacagcaggaggaggacgagtcggggcgtcgtcacgaaggtgttcatgacgaggagcccgagaccgagaaacagcgagacctggaaggtcttcgcgatcttgttgagtgtgtacgtgagcatgcgctggtagacacgacgcccggtctcgacggccgcgacgatgccgccgaggcccgggctcgtcagcacgaggctcgccgcactcttggcgacgtccgtcgcgttcgagaccgcgataccgacctccgcacgcttgagcgcgggggcgtcgttcacgccgtcgccggtcatcccgaccacatggccgcgtcgctgtgcccgctcgacgaggaggagcttgtcctcgggaaggacgctcgccatgacgtcgacgtcgatcgggccgtcgcttcgtcgccgaaggtcgtcgaggtcaccgaggcgctcgccgatgccgacctcccgagcgaccgcgagtgccgtctgtggtgtgtcgcccgtcaccatgatgacccgaacgccgagctcgtgcaggtggctgacgagcgcgccggagtcggggcgagcaggatcgccgagggcgatgaggccgacgagctcgagggtcgtcgtgcctcgcgcgaccgcgaggacccgcgcgccgcccgaggccagcgccgcgacggcgtcgtcgaggccggggggtgggttctcacagaggctggcgacggtcgctggcgcgcccttgacgatgcgcgtctcggtgtcggccgcgtcgcgccagagcgcctcggagcgcttggtcgcaggatcgaacggcgtgaactgcacgcgctcacctggtccggctggcgacagtgtgcgagcgagcaccgcgaggtcgatcgggtcttgggtggctgcgtcggaggcggctgcggcgaggccgagcacgtcgtcgcgggaagtgtcgccgaaaggggtgaccgccgtgaccgtgaggacgttctgcgtgatggtgccggtcttgtcgctgcagagcagatccatcgccgcggcctcttcgatcgcactcaggtgcgtcgcgagcacgccctcgcgcgcgagcgccatcgccccgacggaactcgccagcgtgaaggtcgccggcagggcgaccggaaccgccgcgacgagcaggatcaagacgaacgggacgagggttgcggggtcgagatggcgaacgagaccgtcgacgacgatcgcgaccacgagcagagcgtccaaggcgagcagggcccgcacgatacgcaggatcgtctgctcgaggtggctctgggtcgtcgccgtccgcaccagttgtgcggtgtgaccgaagtaggtgcgctcgccggtcgcgctcacgacggcggtcgcctcgccgcgcacgacgaccgaaccggagtagcacgtccccgagccatccaggttgaccggtcgcgattcgccggtgaggacggatgcgtcgagcgagatgcgtccgtcgacgacgtcgaggtcggcggggacgatgtcgccgacgcggacgtggacgacgtcgccagggacgaggtcggcggcgtcgacggtgcgccaggtgccgtcacgccgcacgcgagcctgtacggcgagtcgttggcgcagcagtgcgagcgcgccgtcggccctgccctcttggacgaagctcagggcgccgttgaagacgatcaggagggcgatgatgatcgcttcggtgaggtggtgatcgagcagctcgagcacgaccgcagcctcgaggaggtaggcgatcgggccggtgagcttggacagcaagcgccgcaggacgtgtggccgttcgggtgcgacggcgttggggccgatggcggcgagtcgagacgcggcttcgcgctcggtgaggcctgcgggctcgggcgccgaggggctggtcgcagactggaagggatccgatgtcgtcggttccgtgtccgccatcgggcctcgctcagcgatcggtcgcagattgcgggaggtccgtggtgtccggcacgatgacgatggggaccggtgcgtggtgggcgcacgtcgtcgcgatcgacccgaggaggagtgccgcgagcgagtgggtgcctcggcgccccacgacgagcaggtctgcatcctcggcgtggtggcacagctcgcgtcgcgggtcgccgcctacgaccacggcttcgacctcgaccgaaggcgcgacggaggcggtctcgtcgatgaccgcctcgaggcgctcgcgcaccgcgcggagcgcgacctcgtggtcgacttggaacctcggggcctggagctcgaaggtgagatctccttcgtaggggtcggaccagaccgagagcgccgtaacggaccaccctcggcggcgagcgtcatccttggcccaggcgagtgctcggcgcgatccgtcggacccgtcgatgccgaccaggatgcggccggaccgcggaggcgcgtcgcctgcgtggccgggccgtgtgatgagcagcggggacgccgcgtggcgggcgcaggccgaactcaccgagccgaggagcaggcgctcgaagccgccccgcccacgtgatccgacgacgaggagcgacgctccgatgctgcgatcgcagaggacgtggtcggggccgccttctgagacgaccgggtcgaccgtgagcccaggcgggaccgacgtggcctggagcgcatcagccagcacacgtcgggcggcctcggcgatcccgtcgtcgagtgctgggtcggggacgtcggctccacgtgcggccacgccctgccatgcggtgaccgcctcgaccgtcgcacccctgatggcggcctcgtcgagcgcccatcggagggcgccgagcgatgcgtccgagccatcgacgccgacgacgacgcgctctgccatgacgacctcctttgccaccgtgtccgtgagtgtagggctcgctcgacggctcgaccagggacctttggtcatggggagcctgccgaccggctcatgggcccgtgatcctacggtcgtagcgatcgggcggctcggtcgatgccctccgacgccatggggtgggggaaggccatcgtcgcgagctggtccaccgtgagcccggcgtggatcgcgagcgcgagcggcgcgatgagctgcgctgcgtcgacgccgagcacctgggcgccgagcagggtgccgcggtgcggctctgcgatgagggcgaggaacccttcgcgttcgtcgaggatctgggcgcgcgcatcaccggcgaagtcgtagtgacccaccatgacgtcgccatggcgcgtccgcgcctcgacctccgtcagtccgacgctcgcgacctcgggctcggtgaagacggtcgtgggcaccgcatcgaagtccattgcgtcggtagatcgaccccctgccatgatgcagtgggcgacgaccaggctctggcgtacggctgcgtggaacagtggggtccgtccattcacgtcacctggggcccacacacgtgggtgcgaggttcgaagctgggcatcgaccgtcggcgcgcggtcgggagcaagcccgagcgcgtcgatcccctcggggagctggacgtggcggcccgtggccatgatcacgagatcaccccgggtgacgtggacgtcgccgccgtgctgccagctcacctcgtagtcgctgccgacgcgcgtgatgctccgcacgagcgcgtcgacgtggagctgcacgcgctggccgaggaggctcgcgaggcccgtcgcaagcgccgcgtcgtagcccggcagcaggcctccggttgcttcgaggatcgtcggtgcggcccccaggttcgccagcatggaggcggtctcgacgccgatgtagcccccgccgatgatgacgggtcgcgatgggaacgggagatcggcaccgaggcggaagagctcgtgcgatgtcacggcgagatcagcgcctgcaatggcgaggcgactcggtgcggagccggtcgcgagcacgaggtcgtggaagcggacgagcgtcgtggaaccgtcggcctcctcgatcgcgatccgttcggcatcgtcgatgcgggcggtcgccgtcatgaaccgaatcgtggaggctcgcagttcgtcggtgtgctgctcgtagcgcaagcgctggacacggtccttgtgtgcgagcacccccgaccagtccacgtcgagcgcggtgcccctcaggccaaaggtctcggcgcgcgtcgagcgcgcacggatgaggcttgcctcgcgaacggccttggatggaatgcagccctcagcaaggcagttgcctccgaggttgccgatcggatcgaccagcaccaccgagcggccggcccgatccagcgcgaacgccgcagggtagccaccacctccggctccgacgatgacgacatctgcggttgcttctcgtgccatggtgacctccaccgtcgatgacgaccgtagcgcagccttggcgtcctctcccgtcacgcccgtgggcgtcggcgagcggctggttgcgctcgtcacgagtctggagcgcctcggcgcggcgggggctgcgagggcacagaaagggacagaaaagggaagaaggtcccatattggaatggatccaaggttggaagtgtgctaggttggacgtcatggagaacgacggcgagcgccgtgcgacgcacgcgaccgagcagcttcgcgcggcaggtctgcgggtcaccgctgcgcggctcgccgttgtgcgggtcttggagcgccacccgcacgccgatgccgagtcgatcatcgccgaggtgcgaggcgaactcgggaccgtgtcgcaccagacggtctacggcgtcctccaggcgctcgtcgaggcaggactcgcccgccgcatcgagccggcagggagtccgggccgctacgagctgcgcgtcggcgacaatcatcaccacatcgtgtgccgaagctgcggtgcgacggtggacgtcgactgcgtggtcggcgagcggccctgcctcacgccctccgagacgcacggctacctcctcgacgaggcggaggtcacgttctgggggctgtgtccggcatgtcgcgatggcgagcgcgcaaggcactccgagagggtcgatgcggacatcgacactggcatccgtggaggtacgcaatggatgagatgacagacgcccagggctgtccggtgctgcacaccgtcgagctcgcgaatgcggccaagcagtggtggccgaatcaggtcaacctcaaggttctcgatggacctgctccgaatcgatcgccctatggtccgagcttcgagtaccgtgcggcactcgcatcgctcgacgtggaggcgctccggcgggacctcatcgagctcatgacgacgtcccagccgtggtggccggctgactttggccactacgggccgctgttcatccgcatggcgtggcactcggccggtacctatcgcatcgccgacggacgcggtggggcgagccgcggggcgcagcgttttgccccggtggggtcctggcccgacaacgccaacctcgacaaggcgcggcggttgctctggcctatcaagcagcgctacgggcgtgcgctgtcctgggccgatctcatcgtcttcgcgggcaacgtggcgctcgaggcgatgggtcttcggacgatcggcttcgccttcgggcgtgaggacgccttcgaaccaccgctcgacacgtactgggggcccgaacggacctggctgggcgacgagcgccatgacgaggagggcgagctcgagaacccgttcggtgcggtgcagatgggtctcatctacgtcaacccggagggtccgagcggtcaccccgatcctttggctgccgcgcgcgacatccgcgagacgtttcggcgcatggcgatgaacgacgccgagaccgtggcgctcatcgtgggcgggcacaccttcggcaagttccacggtgcggcaccggcgagcttcgtcggccccgagccggacggtgctcccctcgagcagcagggcctcgggtggcgcaacacctacggcacgggtatggggaacgacacctacacgggtggcccggagggcatctggaccccgacgccgacgcagtgggacaacacgttcctcgagcagctcttcgcctacgactgggaactggagcggagcccagccggcgcgtaccagtggaccccacgcaaccccgaagcgcaaggaacggtgcccgacgcgcacgatccgacggttcgtcacgcaccgaccatgctcacgacggatctcgctcttcgcgaggatcccatctatcgcgagatcgccctgcgcttccgcgaccatcccgacgagctggccgacgcgttcgcacgtgcctggttcaagctcatccatcgagatctcggtccggtgagccgctatcagggtcctctggtcccgagcgagacgttcgtgtggcaggatccggtgccaccggtgacccatggcctcgtgggcgaggcggagatcgcagagctcaaggatctcatccgcgccagtgggctcacgactgctgagctggtacgcaccgcctgggcctccgcctcgacgtttcggacaaccgatcggcgtggtggagcgaatggtgcccggatacgcctgttgccacagcgaacctgggcggtcaacgatccggccgagctcgctcgcgtgctcgcggtcctcgaggccatcaaggttggcttcgacgagcgccatgggcctgcggtcggtgtctcgctcgccgatctgatcgtcctcggcggcgtgacggccgtggaggacgctgctcgtgcggccggcgtcgaggtgtcggtgccgttcacgcccggccggaccgatgcgaccgaagccgacaccgacgcagagagcttcgcggtcctcgagccacgggccgacggctttcgcaactgggcccgaccgggagagaaggtgccgctcgagcatctgctcgtcgagcgggcgtgccgcatggggctgaacgccccacagatggtggtgctcgtgctcggcatgcgtgcgctgggcgcgaacgctggcggctcccctcacggtgtcctgacggagcgtccaggcgtcctcagcaccgacgtcgtgcgcaacctgctcgacatgggcatcgagtggcgtccggcgaccggcgaggatcagacctacgtcggtgtcgatcgtgtctcgggtgctcccagatggacggcaagcgccgtcgacctcgtcctcggcgccaatgccgagcttcgggccatctgcgaggcctacgcgagtgacgacggtcaggcgatgttcgtgcgcgacttcgtcgaggcgtgggacgccgtcatgatggcagaccggttcgacgtgcgctgaggtcgcgtccatacgagcgcgtcggcgggaggggtgaatgcccctcccgccacgaccatcggcaccggccggacggcgaaggatccaggccgcggccaggcttgccggcgtgcgcgggctgccgagctcaggtgtcagccgtccaggccgaggacgaacgtcggcttcggtgacgtgtcggggaggcggtgctcgtcagcgagccgacgtacggcggtcccgaccgcgaggaactcggtcgcatgttcaccccagacgtggttcgcgacctcgacggagaccccgacgatcccgttggcaccagctcgggtggcctctgcctgcatcctggtcagcgcaagttcgcgtgcctggtagatggcctcggtgaaggtgaccatctcctgattccacatcgactgacggagcgagccgaacacgctctggtgggcgacgtggtacacgcaggtgccgaggacgaacgcgaccgggacgatccctgtcgcgaggagccggtagaagtcctgggcggacaggtctgacgtgaagggcccgccgtcgggagcacggtgcgcgcctgcgcccgacagagaccgcaccgcggtgccggtggcgatgaactcgagcacatcttgtccccagacgtacatctgcatcgtgaggttgacgcccacgatgccatcagcaccaagctggtcagcctcggtgcgcatccgggtcatggcgagttcacgagcctcgtacatcgcctgggtcagaacctggagttcctggctctgtccccagcgtgcgacctgcaggccgacgtggtagatcgacgagccgacgacgaacccgaggggctcgaatccagcctcctccaggaggacgtattcggagaccgacaaatcggacgtgaagacgccgtgtggatcgcgtccgagggtgtgggcgagacgctcctcagcggcgcgtggttcgtaggcacccgaggcggcaggtgctgttcccggttgcgcgtttgacgggtcggggcggaacaagggcatggtggcctcctcgaagagcgacacgctgacgctatcacctggggcgcatcggcgctgagcgcctacgctggcagtggtgacacgtgcgcagatggcgggcggtcgtggtgagcgccgcggtttcgccgacgcgcgtgctgcgcttcgtgtgaggcgcttcagtgcatggtgggtggcccagctgctctcgggcatcggatcctgggctcaggcggtggccattccgtggtacgtcctcgagcgcaccggatcggcctcggccgtcggtatcgtcacgaccctgcaattcctgccggtgctcgtgctgagcctctttggcggggcgatcgccgaccgtgtgtcacgacgtggcctcttgctcgtcacgcagctgctcttggccttctgggcagcgatgctcggcttccttgtcgcgagccatgaggccccgatttgggtcgtcgacatccttgcgctcgccatcggggcgacgaacgcgatcaacaacccgacccagcaggcattcctgccggagctcgtaccgcgtgagctgcttgctccggccatcgcgttgaacagcgtgcagttcaacgcagcacgcatgatcggaggtgcggttggcggcgcgctcatcgccgcactgggagtcgccgcggcgctgtgggtgaacgccgtcagttttctgccggtcgtggccgtcttgatcctcatcgcctcccacagcgctcgggccgttcggcgcgagcgacccgccggcagcatgctgagcgagctcggttcgggacttcggttcgtgattggggcggcgccggttcgcagcgtggtcctcgtcttcggcttcgtcggcttgttcgggttcaactggcaggtcgccgtacccctggttgctcgctttgcactgcacgagcatgcgaacgggctcgggttgctcatgggagcgctcggcgcgggagccctcgtcgcgtcgttgctggcatcagcgttgggacaggcgacgcagcggcggctcgtcgttgcggggactgctctcggactctcgctgatcggtctcggcctcgcgcgctcgatgctggttgcagggttgctgctcgtcgcgggtggcttctttggcgtgctcgcttcggtgagcgccaacacgaggctgcagatgctcgctccgccgacgctgcgtgggcgagtcatggcgatctatgtgctgctcatgggcggtacgacaccggtgggcgccttcgtgctcggcgagcttgcgagctggctggggtccgcgtgggcggtgctcgtcttcggggtcgcaaccgcggccggcgtcgtcgctgcgagcctgtggggacgacaacgttcgggatcgagcggccagcgtgctgcgacggcccccatcgactagataatcgtgccgtaggaggcccaactcgaagcgacgctgctccgggcgtgccgtcatggtcgggttggttcgaactccgatgatccttcgtgcggggctcgtaccggttcggtgattcggtctcgtccgtgctagccggccggattcacgattgccgacagtccctgcgaggtgaattggccgtaggtctgcacgatgacgcccacggcggggtcgacggctgactcgacgagcccgtcgccgaggtagatgccgacgtgtccagggtcggccagggttccgtcgctaccagggacgagcaccaggtcaccaggggcgatctcgctcggggggacttgtacaccttcgttcatctgcgacacggtgtagtggtcgagtgccactccggcctgggcccaggcctccatcgtgagcccggagcagtcgaacacattgggtccggcaccgccccagacgtaggcgtctcccagcttcgagagggcgtagttcagcaccacctgctcttggggggtggtgcccgaagggatcgtatagccggccggaagcccatactcaccggcgggcaggttgccaccaagcccccctgtggctggaggcgcggccgcctgctgtgccgcctgctgtgccgcctgttgggcggctgcttgctgtgccgcctgctcagctgctgcttgctgggccgcctgctcagctgctgcttgctgtgccgcctgttgggcggctgcttgctcggcggcggcgcgcgcggctgcagcttgctgtgccgcctgcgcagctgctgcttgctgggccgcagcctgttgggcttcttgctgggcgacgagcgtttgaatctgggagttcacgcccgcgagctcgttggctgctgcttgctcagcgttcttggcggtggtctgctgggaggcgagctgggccaccagcgtgcgttgccgttgttgctgggcagcgagcgttgcctgctcttgctggagttgctgcttggcagcgacgtaggcgctgagtgcctgctcctggatggacgaagcgacgttgacatccgtctggacgagtgctgactgattcgggttcgccgagaggaccgacacgacggtcgagccagtgcctccgcgtgagaagatcgtgatcgcctcgtcgacgacctccgcatgcagctggtgcagccgcgtgagttggtgggcaatggcctggcggaccgtgctctcctcgcgcaccgtggctgcaaggcccgcttgcgcagccgtcatctgggacgtggcttggttgtactcgctctcgagtgcattgagcttctgagcgatggccgcggcttgggcgcgcatcgacgacaccgagtcgacgagacgtggaggtgggctgtcgacgtaggagaggccgatcaggccgacgagcgcaagtgttgcgacgaggtggcctggtcgggggcgacaggcgcgccagcgcgtcactgcgctcgtgcgggcggcctcgcgctgtcttgctccccaaggagcgtggagaccacctgatcgctgccgatgcgcgtccgtggcgccaacctcctcgtgacccgtcgcgtgttcttggtccttggatcggcacgcagcctatcactcctgaagggtgtcggagggtcgcgctagatctcgcctcggcggacgggctccgcggcgcccgccgtccgatgccagatggcgacttgctctcggcgcgtggagcctcgcgacatcgctcggagcgttgggtccggggatgtccaaccatacgaggagccacccatgcctgctgcgctcgatcgatcccgtctgctcgaggagctcaccgatggcgttctcgcgctcacgcagtcggagccctggcggcgctacctcgacgtgcagcgccgcttccatcgctacagtccacagaacgtcctgctcatcgaccgtcagcggccatcggcgacgctggtcgctggctttcgtcagtggcagcgccttggccggagcgttcgtcgtggtgagcacggaatctggatcgtcgccccgatgcgagtgcgacggacgacctcggacgatctcgacgaggaggtgctggctggctttcggtgggtctgcgtcttcgacgtggcgcagaccgaaggcgctgcgcttcccgaggtagcgacccgcctcgtcggagaggatccggctggggtcctcgccaagctcggcggcgtcgctcacgcactcggctttgccgtcgaggatcaccgcttcgagggggcgaccaacggcgactgttcgcacgagcagcgacgcatccgcctctccagcgaggtctcgccgcgccagcgcgtcaagacgctggcccacgagctcgcgcacgcgctcatgcacgagcgactcgagtcgcgtccgcaggcggagctcgaagccgagtcggtggcctacatcgtgtgtcgtgcgctcgggatcgacgcctcgaacttttcgttcgggtacgtcgcgagctgggctggaggaggcgcggcggctgtgcgtggcatcaaggcctcgtgtgtacgcatccagcgagcgtccgcgcagatcctcgagctcgctggcttcggcgtcccctcgggagcgggctcctagtcggtgcgtgagaactgccagatggctacgccgagcagactcaccgcagcgagtgcgacgagacccacctcgagcagggtcgggaggcgatagctaccccaggtgatcccagccccgaggatgcgagcgaggggtgccggtaccgacacgtactcgaagaccgcacggcgaagcggatcgaccgcgtacgacagcggatcgaaccgcgtgagcaccttcagccacgtcggcaagtcgcccgtggggaacaccgcccccgacaggaagaacatgggcagcacgatgaactgcgtcaccatctggaagctctccacctgagcgatccggctggcgacgaggacgccgaaggacgtcagcgcgaacgccgtcaggcccatctcaccaagcatcgtcaggaggaggagtggacgatagggcaccccgaccgcgccagcgagcaccaacatgatcgcgccctggatcgtcgcaacggtggccccgccgagtgccttgcccagcacgagcgaccatcgactgaccggtgcgaccagcatctcacgcaggaagccaaactcgcggtcccagacgatcgagatcgccgagaagatggaggtgaacaggatcgtcatcgcgatgacgccggggaacatgaacgtacggaagttgaagtgcgcggagctgacgacgatgccggagagtccggttccgagcacgaagaggaagagcaccggctgcacgagtgaggtgatgatgcgcaagcgattgcgcgcgaagcgaatcagttcacgcttccacacgatgcgcaccgctcgaagtgggcttccccccatttgcttgacagtctgaatttaggccacggccacctcccggcaggcccaggagagctcgtactcgacgggcggtaggtacccgaggcttgagtgcaggcggaccgtgttgtaacggtgaatccagctagcgatggcagagcgagcccctgagaggttcgcgaagcggtagcgagccaccagctcgcgcttcaagctcccgaagaaggactcggccacggcgttgtcgtagcaggtcgcgaccctccccaccgactggcgaatgccaagggtcgcgagcaggctccgtaccttccgggagaggtactggctgccgcgatcgctgtgaaagatcgccccagccaggctgccccgagtcccgagtgcttcgcggatcgcctcgaccaccaggtcatcgggcatgtgacgcccaagtgaccagcccacgatgcgcctcgagccaagatctgccaccgtggcgagatagcagaacccctcatcggtgcggacgtaggtgatgtcgctcacatacctgcgcttcggctcaccaggagcgaagtcctgacggacgaggtccgggagcgctgcgtcctctccccgcctcgtcgtgactacgaagcgccggcgtgggcccgctgccatctcgagctcgcgcatcaggcgttccacccgcttgtggttcacgcagaacccgcgccgtcgcagctcgtgggtgatgcgggggctgccgtaggtgccgtcgctctcgtgccagatggcgcgaagctcgctcgcgagcaccaggtgctcgggatcctcgcctcggtcccgacggtgtcgccaggcgtagtaggcctggcgagagaccccgatgactcgtgctgctgccgctacagagaagcccttggcctcctggcgggagatccagtggtagcggctcactgtcccccctccttcacccagaaggccatcgctcgcttgagcagctcgcgttccacggtgagctgcttgacctggcggcgcagccgtgtcagctcctcgcgctcggcgctcgtcaggccctctcgctcacctcggtcgatgcgttcctgacggacccagttaccaagggtctgctcgttgatgccaagctcacgggcgacgtcagcgatggtgcggcgctggtcgagaaccaacgctgccgcgtccttgcggaactggctcgggtagcggccgcgtcgtcgtccagcggggccgtcgcccggtggtgggttcggtgtctggctcatcccttcctcctatagcaggtgtcaacctggaggggggaaggccaaaggtcgtccgacacacgaccttctgcctgggcgtagccctcccgataggcgttgtcgaacacggctgcttcggtggtcatgatcgcatcctcgctcgcatgaagggattggcacggaggccctcgagactcgagcgttcggcgtcgcggatcgtgcgacccgtgtaggtcatgaagacgtcgtccagggtaggtcgtgcaacccggaccgacgtgatggcaacctgcagttcggcgaagagtctcggaacgaactcctccccgttggcgacctggaggaggattccgtcgtcgctgtggcgggcctcgatgccgaagtgctcgccgatggcttcgatcgcgcgctcgtcgtcggcggtgcgcaactcgatgcggtcggtgcccacgctcgccttcagggcctcgggtgtgccaccggccacgatctccccgtggtccatgatggcgatgcgatcgcagaactcggcctcgtccatgtagtgcgtcgtcatgaaaatggtgatctgctcgcgctgctggagctctcggatgtaggaccagatgcctgcgcgcgtctgcgggtcgaggccgaccgtgggttcgtcgaggaagagcacccgtggagcgtggagcagaccgcgtgcgatctcgagcctgcgcttcatgccgccggagaacgtcttgacgctgctgcgtcagcgatcgccgagccccaccatgtccaggacgaagtcgatgcgctcggccacccgctcgcggtccacgccgtagagctcggcgtgaaaccgcaagttctcctctgcggtgaggtagtcgtcgagtgtgctgtcttggaagacgaggccgatattgcgccgtactcgtgcgcgctcgcgcgcgacgtcatggccaccgaccgtcgcactgcccgccgtcggggtcaggagcgtgcagagcatcgagatggtcgtggacttgccggcgccattggggccgaggaagccgaagatctcgcctgcacccacgcggaagctcacgcctcgaaccgcttcgacctcaccgaagcgcttggcgaggcctcgcacctccagtgcatacggcggtggcggctccgcatcgacgaggctcggtgtcgtggtcgtggccggctccgtactcatcgatcacctccatgcgccgaaagcttggcgcatgcaaccaccctaagggctccgggtggacgccgctacgcgtggagaacgcgcgcctagcgcaggcgcattcccgagatcgctcgagcgatgatcaggcgctggatctcgcttgttccctcgaagatggtgtagatcttggcgtcgcgatgccagcgctcgaccgggttctctcgtacgtacccgtagcccccaaggatttggatggcctcctcggtgacgcgaacggcgacctcgccggcgtggagtttggccatggagccctcggcgtgctcgaaccgctgtccctgggccgccatccaggctgcgcggtgcacgagaagacgcgcggtgtcgacggcgagcgccatgtcggccagcttgaaggcgatgccctggttctcgatgatcggtcggccgaactggacgcgttccttggcgtagtcgagagcccattcgtaagcggcacgagcgataccgaccgcttgtgcgccgacgagcgggcgggaggcctcgaaggtcgccatcgcggcttgggattgggcgcgcttgccctctcgggcacgggccagccgctcgtcgagccgttccttgccgccgagcagcgccgacccgggcagtcgcacgtcctcgaggatgacctcggccgtgtgcgaggcgcggatacccatcttcttgaacttctgccccatgcgcaggccaggggtgttgggagcgatgacgaagctggcctggccacgggcgcccagttccggctcgacgctcgccacgacgacatggatgtcggcgatcccgccgttggtgatccaggtcttcgtgccgttcagggtccacgtatcggtggccgggtcgtagaccgcgcgagtgcgcagcgaggagacgtcgctgcctgcgtcgggctcgctcacgcagaacgcggcgaggttggggtggtcggcagtcccgaagcactgcggcacccactcggcgatctgctcgggggtgccgttggccacgatgcccgagacggcgagcgtcgagccgaagatcgcgagcgtgatacccgcgtcgccccagcagagctcctcgagcacgagcggcatcgtgagaccggtcttgtcggcgaacgcgttcagcatgaagtcgtaggagtacaggccgatgcgggccgcttcctcgatgatgggccgtggcgtctcttcacgttcatcccattcgtgagcggcgggacgaatggtctcagcggcaaaggtgtgagcccactcgcgcagctgttgctgttcgtcggtgagtgcgagggaaaagggttccacggggacctcctttcgcgcgaagcgcgaacgttaccgagtggtaaccatagcgctggcttcgaggccgcgcaaggcatcaagccggcaggatctcgggcccgttaggggtgtcacgtacctggtaaccgagggcggcgatctcggcgcggagcgcatcggcgcgcgcgaagtcgcgatcgcgcttggcgtggtcgcgttcggcgaccagcgcagtgacctccgatggaatcgaggcacgcgggggcacggggagcccgagcgtctccagcatcgcagcgagcgctgcgcgtcggcggttagcgagagcgctctcgcccgcgagcgccgccgagcgcgcagcacgggcggcttcggccatgacggcgagtgcggcgggcgtgtcgaggtcgtcggcgagggcagcgtcgaactcctcgagatccgctggttcggccgcacgggcgtcgcctgcgccggcttggctgtcgaggcgggcgagctgcgcggccgcttgctcaagtgtggtggtggtcagctctactgggctgcggtagtgggcgcgaagatacgccagtcggaccacccgtccgccggcgctcgcgatcgcatcgtggaggccgaaggtgttgcccagcgacttcgacatcttctcgccttcgagctccacgaaggcgttgtggacccagtgctgtgcgaaccccatgtcgaggagggaggcctgggcgcgctcgttctcgtggtgcgggaatacaaggtccatgccaccgccgtggaggtcgaacgtcgatccgaggagttcggtcgacatcgcgacgcactcggtgtgccagccggggcggccgtagccgaggctggtcgcgaagccgtaggcgtcgctctccacggtcttccagagcgcgaagtccagcggggagcgcttcgcgtcgtcgacctcgacgcgcgccccagcgcgtagctcctcgagggcttggtgcttcaggaggccatagtcggggacgtgatcgacgctcagatagacgccgttcttcgtcatgtaggcgtggccgcggtcgacgaggcgctcgatgagggcgaccatggcatcgagccattcgctcgcgtgcggtgcgaccgtcggtcgacggacgccgagcgcatcgatcgcgtcccaccagcgggactcgtagcgctcggcgatcgctggcggggtcaccccttcacgagctgcacgatcgacgatcttgtcgtcgatgtcggtgatgttcgagacgaagcgtaccggagccacgagccgctcgagggtccgccggagggtgtcgaacacgacggcgagccgtccgtggccgaggtgcgggtcgtcgtagacggtggggccgcagacgtagacggtgacctgctcaggggtcccaggggtaagctgaatgagctcgcggcgggcagtgtcgtagagcctgagcatccaccgaagtctaggcggggtcccctcgccccttcggaggcgataccgtcggttgcgacccgggacctgcgtccacgaggcacccatggctgatcgggtgacccgtgcggacgagggggtgaggccggggcgaagtccagatgaggaggcgtggtgcggatcccggacaaggtcgagctcgaggggctcgagcgcaagtggggcgcgttctgggaggagcacgggctatatcgcttcgacgacacagctcccgccgcgcaggtctacgccatcgacacaccgcctccgaccgtctccgggacgctgcacatcggtcatgtgttctcctacacccatgccgacatcatcgcccgctaccagcggatgcagggcaaggaggtgttctacccgatcggatgggacgacaacggcgtcccgaccgagcggcgagtgcagaactactatggcgtgcggtgcgacccgtcgttgccctatcgcgggaccgacgaagagctgcctcgggaaggggcacggcaggtcccggtgtcgaggcgacgcttcatcgagttgtgcaccgagctcacggcgaaggacgagcaggcgttcgagcagctgtggcgtgcgatcgggttgtcggtggactggtcgctcgtctacaccacggtcggtgagcgtgcccgtcgcgtgtcacaggcggacttcctcgatctcctcgagcgggaccaggcctacctcgccgaggccccgacgctgtgggacgtcgatttccagaccacggtctcccaagccgagctggaggatcgcaccgtcgagggtcgctaccaccgcatcgtcttcgaccttgagggtggtggcgaactcgagatcatgagttcacggcccgagctgatccccgcctgcgtcgcgatcgtcgtgcatcccgaagacgatcgttaccgcgaggtggtcgggcgccgcgccatcaccccgctgtttcgcgtgccagtaccggtgatcgcgcacccgctcgccgagccggagcgcgggaccggtgcggccatggtctgtacgttcggggacctcaccgacgtcgtgtggtggcgcgaggcatccctgccgacccgggtcgtgatcgaccgggccggccgactggtgccacgcgtggacttcgccgccttcggttccctcgatcccgatggcgcggctgacgcctacggacgcctcgcgggcttgcgtgcgagcgacgcacgtgccgaggtcgcggaggcgctcgcggccgcgggggtgcttcgtgggatcgagcaggtccgtcacgccgtgaagtactacgagaagggggagcatccgctcgaggtccttgcaacccgtcaatggttcatccgcgtcctcccgctgcgcgatcgtctgctcgagcgcgcggccgagctcgactggttgccaccacacatgcaggttcgcctcgaggactggatccgcggactcaaccaggattggaacgtctcgaggcagcgcttcttcggcatcccgattcctctgtggtatccggtgcgcgaggacggctcggtggactacgaccatcccctgcggcctgcgaaggaggacctgccggtcgatccgcagagcgaggctccccgcggctacgccgacgagcagcgaggtgtaccgggtggcttcgtcggcgaccccgacgtgctcgacacctgggccacgtcgtcgttgaccccacagctcgcggggggctggggtgagcgtccagacctctttgccaaggtcttcccgatggaactgcggccccagggccaagagatcatccgaacgtggctgttctacacggtcgtgcgagcggagctggccttcggtcggctcccgtggcggcgggcgttgatctcgggctgggtgctcgaccccgatcgcaagaagatgtcgaagtccaagggcaacgtcgtcacacccatgccgctcgtcgagcgcttcggcgcggacgccgtgcgccactgggcggcgaacggtcggcccgggaccgataccgcggccgacgaggcgcagatgcgcgtcggtcgtcgtctcgccatcaaggtcgccaacgccagtcgcttcgcgctcagccgtgtggcgagccgctccagccacaagcccgcgtgggtgccgatcgacgcagcggaactcgaggccctcgacgccacgatcgcacgggccaccgagttgctcgaggcgcacgactacacgagcgcgctcgcggccatcgaggagcacttctgggccttctgcgatgattacctggaactcgtgaaggtgcgcgcctacggcgacgactcgccggagcacgcctccgcgctggctgcgctcgagatcggcgtcgagctgttcatccgggcgttcgcaccgtacctccccttcgtcaccgaagaggtgtggtcctggttccgcgagggatcggtgcaccgaagtgcctggccgcagccgggcgaggccatgcgccgctacgtcgagctcgtcggtgaaggccatggcgtcgtcgacccggccgttcgggcggcggtgtcgtggtcgctcgcccaggtgcggcgggcgaagacgtcggagcagcgctcgctgcgtacgccggtcgaacgcctcgtcgtgtgggcgccccgggcgtggctggaggcactcgccgctgccgaggatgacctcagggcggccggcggcgtgctcgcgctcgagcgccacgaggccgacgagccccgtgccgtggtcgagctcgctccgccagagcagcactgaatgaggtctgcgacctgaggaccccgtggctcgggtcgcagacggtcgcgcggtccgtaggcttgacggtgtggacagcctcaccccagaggagcttcccggcgaactcgcggtgacacccgaggtcgcgggggggttcgtccgacgccgatggctgttgatggggctgctcgcggtgtgggggcccgggctcgtcgtgatgttggccgacaccgacgtcggcagtctcgtgaccgcagcgcagtcgggtgcgcagttcggctaccgcatggtgctcccgcaggtggtgctgatccccatcctctacatggtgcaagagatcacggttcgcctcgggatcgtgacgggcaagggccacggcgcgctcattcgcgagcgcttcggcccgtggtgggccggcgtctcggcactcaccttgttcgccacggcggtcggggcgttgctgaccgagttcgccggcgtggcaggagtcggtgagctcttcggcgtctcgccggacgtcacggtgccgctcgcaaccgggttcctcgtcgccgtcgccctcacgggcagctaccggcgagccgagcgcgtcggcatcctgctcggtctcgtcgagctcgcgttcgtgccggcgatgatccttgcgcaccccgatgtcggtgcgctcgcgcgcggcgctctcagcctgccactcgccgaccatggcttcgtgatcctgctcgctgcgaacgtgggggccgtgatcatgccgtggatgatcttctaccagcagggcgcggtcatcgacaaaggccttggcggcgccaacttgcgtgcggagcggcgtgacaccgtggtgggagccgtgctgacgcaggcgatcatgctcgtggtcgtgatcgcgttcgcggcaacgatcggcacccatcatcctggggtcgcgctcaacacggtgggccagttgagccgagccttggctccgttcctcggtccggtggcggccaaggtcctcctcgggctcaccatgctcggcgcgggtctggtcgccgcgctcgttgcgtccctcgccggggcgtggggcgtctccgaggtcttcggttggcgccacagtctcaacgatcgaccgtctcgggcgtcggcgcgcttctacgtgacctacaccttggcccacgtgctgggtgcggccatcgtgctcctcagcttcgatctcgtctcgctggtgatcgacgtcgaggtcatgaacgcgctgctgctgcccatcgtcctcggtttcctcctcgcgctggaggccaaggcgctcccggaggcctaccgcatgcgcggggcgtatcgagcggtcgtgacggcgacctcactgctcgtgatcggtttcggcttgctcatggtgccgacgaccctggggtggtggtaaccggcgtcggctgcgctacgacgcggcccagtggtcgggccagccatctggctgaggaatgatcgcgcctttgcgacgaagctcggctcggaagatctctcgcagcacggagagtgcgtcgaggatctccgggtagcgcaaccggtaccacacgttcgacccctcgcgctgggcctcgatgatgccacggtcacgaaggacggcaaggtgctgggacacgttggcttggggcgcgccgatcagactcacgagctcgctcaccgtatgcggagcctcgcccaagatcaacaagatcaggatgcgcttggggtcgttgagcgccttgcacatcatcgggacgaactcctcgagttcggtgatgctcaccccggtcgtggcagcctcggtctcccccatggccccgagcctagctgtcggttcggcgagcggtgtgtgcagctccgagtcggttggtcaggaactcgtcgaggagcacggtgccgagctctccgtcgccggggtagtaggccttgccgtggttgatggcgaccacctgctcgacgaagcgtcgtagcccgcgatcgcgagcgaggacgaagacgctgatctcgatgcgctcgcgggtggcacggactacctcggcgagggtgcgacggagggtctctggggtcgggggataggcaaagtgcaccgagccctcgtcgtcggcgtgggcggtgggttcgccgtcggtgacgaggagaacttggcggcgtccgcgaactcggcgcaggcgctggcgggccagggccagggcgtgctgaatgttggtcccgtagacgtagtcccactgcgcctcaggcagcgcggtgatcgggacctctcgcgcggtctccgagaagaccaccaccgagaagtcgtcggcagggaaccgtgcccgcaccagggaggcgagcgcgagggcgacgcgcttggccggcaagaaggtgtcgttgagcggcatcgagagcgacaggtccagcgcaaggacggtgccttggcgcgcctggtcgtcgacctgttcgatcatgaagtcgtcgggatcgagccggagcggtatccccggcccgttccgagcgagcgaacctcgaagggtgtcagcgagggcgaggcggaacggatcgccaaagcgccactcgcgcacttcgccgttgggctcggtgccgaccccagtgcgtcgcacggcgtgctgcccgaggggcccgagcacgccttgacgcgcgaggtcacgaaggagcaggtcaccgaggcgccacacggcgcgcggtgagagctcgacgcgacccccggtgcgattcatgaggccggctgcctcgagcgcttcggtcgtgcgcgagaggcgctccagcgctgcctgggcgtccgcgccgaggaggtcgcgcacctcgtcgagctcgatcgcaccgaggcgatcgggggtcgtggcttgacggagtgcggcttcgagcgtgtcgaggcgcccgagttcgcgcatcaccgggccgagctcgccgagaccgagcggttcggagcccctgaaccccatcgcgtcggcgtcgaaccccgcgatggtgccgagtgcctccccgaggcgccgcatggcttcggcgatcgcgggggatccagcgagtgcgtcctggaggcgctcgagggcacgtcgcgtgtcgtcgtccacggatgccaggaggcgttcgaggtccatgcgactcgccgcgaggcgggcgaggaagtcttcgaacgattcccccggggcgatgatccctgggtagcgttcctggaacgcctcaaggtcgtcgctgatgtcctcgccacgcgcaaagcgctcgatcagcgacgcgaggtcgctgagcatcgccgcgtacgcatcggcgtcgcccgcctcgatcgccgacgccagctgctcgaacgactgcgccagcagcgaggagcgaaggctcgcgagcaggtcgtcgaagcgctcgtgggctgcctcgtcgaagaagtcgtagtgctcgagcgccgtgaggcgttcggcgatgtcgtaggggagcgcatcgagctccatctgtgcgaggaggtgctcgggcgcttgggtgcgctcgtgtgcagcttcgcggctggctcgctccttcgacacgatggcgtcgagttcctcgcgcacgcgactgagcgtcgcgttggggtcgtagcgcgcgagcagctggtcgcgacgttcgcgtagccgtgtgaggagctcggcaagcccaggcatgtcgtccaagcctcgctgcagcaggtcggcgagtgcgctcgcaaggttgccgtggtaggccaggtcgtcgctgagggcggcgaggacgtcgtcggcctccgggccgaggggctcgggatcgacgcctccatagcgcacggtcgacatggctcagctcccgtagctcactcggttgccaaggacgcgcttgccgagtctgcgtgtcgccacgagtccctcgagacacagttcggcgagtaccaggcgctccgacggcggggcgtggtcgcccatggcagccagcgccggtcgatcggcgaggatctgctcccatgtggccgtggggccatcgagatcgacggcgagcgggcgatcgttggtctcggcgatgacgtccgacgggtcgagatggccgagccgctcggtgaagactcgagcggtcgcttgagcgagcaaggtggccacgatctcgcgctccgaggtgtcgtgggcatcgacctcgatcttgcccgcgaaggccgcgatggtcgcctcggtatcgccaaggcgtgcgcgaggcgggtgctcgccgaggcgaacggcccgaacgagtgccgcggcagcgatcgcctctcgggctgcgatcgaccctcgaacggagacgcctgagtagcgagagaccgcagggtgccgccgtgcgaggtgggccgtgtgggcgacgagttcgtcgaggacctccggtatctcgacggttgggtcgcacagctgagcctcttgtcgcatgatggcgacttcttctgcgatcgtcgacgggtagtgcgttcgtagctgcgtgccgaagcggtccttcagcggtgtgatgaggcgcccacgcgcggtgtagtcctccgggttggccgacgcgaggaacacgatgtccaaggggagccgaatggtgaagccgcggacctggacgtcacgctcctcaagcgcgttcagcagaccgacctggattcgttcgggcaggtcggggagttcgttgatggcgaagaggccgcggttcgcccgtggaacgaggccgaacgtgagtgcttcggggtcctcgagcgtgcgacccgccgcaaccttgatcgggtcgacctctccgatcagatcagcgatggtcgtgtcgggagtcgcgagtttctcgctgtagcgctcgtcgcgggcgatccagcggatgggcgtcgcatcgccttgggcggcgagtcgggccttggtcgaggcgaggacgggcgcgagcgggtcctcgttgagcgccgagccctcgacggcggggacgaaggggtccagcagcgcgacgagggaacgcaggatccgcgtcttgccctggccgcgctcgccaaggagaatcacgtcatgcccgctcaccaaggcgcgcgtcagttctgggagcacggtgtcgtcgtagccgaccatgccctcgacgacggggcggcctgcgcggatgcgctcgaggacgttggcgcgaatctcttcgcgaaccgggcgcgggtgccaaccgatgcgcgcgaggtcgccgagcgtggttgggtggtcgcctgaagcctgggtcacatcgtcgagcctaggtcgaatgtccgtcgtcgattcgtgacgacgccggcgagcgagtaagactatgggggtgaacgttcaccatcacagctacgacgtcgtcatcgtgggcgcaggcggagccggcctgcgcgcggcgatcgagacggccgggaccgtgcgcaccgcggtgatcacgaagctctatccgaccaggtcgcacaccggggcggcccaaggtggcatgtgcgcggcgcttgccaacgtcgaggaggactcgtgggagtggcacgccttcgacacggtgaaggggtctgactacctcggtgaccaagatgccatcgagatcatgtgccgagaggcgatcgacgcggtcatcgatctcgagcacttcgggctgccgttctcgcgcaccccggacggcaagatcgaccagcgccgctttggtggccatacgcgcaaccatggcgaggctccggtacgtcgcgcgtgctacgcggccgatcgcaccggtcacatgatcttgcagacgctgttccaacagtgcgtcgctcgtggtgtccaattcttcaacgagttccaggtgttcgacgtcctcttcgaaggcgaagggaacgatcggcgtgctgcgggcgtcgtggcctacgagctcgcgacgggagatctccacgtcttcgccgcgaaggcggtgatgttcgcgaccgggggattcggccgtgtctttcagatctcctcgaacgcacacacgctcactggagatggtcccgcagtgctcctgcggcgcggggtgccgctcgaggacatggagttctaccagttccacccaaccggcatctacgggatcggcatcttgctcaccgagggtgcccgtggcgagggtggcatcttgcgcaacggactcggcgagcgcttcatggagcgcgtcgcgccgacggtgaaggacctcgccccgcgcgacatggtcgcgcgagcgattcacgccgagatccgtgagggtcgcggggccgggcctgacaaggactatgtctatctcgacctcacgcatctaccgccggagcagatcgacgcgaagctccccgacatctcggggttcgtgcggacctatctcggcctcgagcccaagcgggatccgatccccattcagccgacggcacactacgccatgggcggtatcccgaccaacgtgcatgccgaggtcgtcgtcgacccggcggggacggtgctgccagggctctacgcggccggggagtgtgcctgcgtgtccgtccacggggccaaccggttggggaccaattccctgctcgacatcaacgtcttcgggcgtcgcggtgggcgagcgatggtcgagtacgtcgctggcgtcgatcaccccgacatcgcccgaggcgccgaggagcccgttcgtgagcacattgagcatcttcggagccacaaggggtccgagcgtgtcggcgcgttgcggacgacgctgcaggctgccatgatgcgcgatgcgtcggtcgtgcgcactggggagtcgctcgccgaggcccatcgtgtgatccgcgagctgaaggagcgctaccacgacgtcgccatcgacgacaagggatcggtcttcaacttcgatctcacggaggcgctcgaactcgggaacctgctcgacctcgccgaggtgctcgtgatcggtgcggaggctcgcaccgagagccgtggcgcccactggcgtgacgactaccccactcgtgacgacgtgaactggatgaagcacacgcttgcctaccgcgagccggacggatcgatccggctcgactacaagccagtggtgttgggcaagtacgaacctatggagcgcaagtactgatgacgacgactcagtcaccggcgtcgaccgacgccaccatgcaggaggtggacgttcacctcgtgatccgtcgcttcgatccggaggccgactcgcgcccgcggtgggagagctacacggtgcgacagaagccgacggacaccgttctcgcggcgctccacaccgtgaagtggacgctcgacggatcattgagctttcgtcgctcgtgtgcgcacggggtctgcgggtcggacgccatgctgatcaacggcgagaaccgcttgagctgtgtcaccctcatcaaggatgtcgggaccgagctgcgcatcgagccggtgcggggtctgcccgtcgtcaaggatctcgtcgtcgacatggagccgttcttcgcccagtatcgccaggtcatgccgtggctcgtcaacgacgacgaccctggctttcgagagcgtcgacaatcgcccgaggagcgtgcacgtttcgacgacaccacgaagtgcatcttgtgcggtgcctgctcgacgagttgcccggtgtactgggctgggggcgattacctggggcctgccgcgatcgttgccgcgcaccgcttcatcttcgactcccgcgaccgtgcggccgccgagcggctggacatcttgaaccagcgaggcggcgtttggcgctgccgaacctcgttcaactgtacgcaggcctgtccgcgaggcatcgccgtcacggaggccatcgaagaggtgaagcgtgccatcgtctccgaccgggcgtgacgttctgacgctcgtcgttcgcgagcgtgacggggtgcgacgccagggccttcgcctcgtcgacggggtgctcgagcctgctgcgatcaccgaggaggatgcccaggtcgtcgtcgaggtcgacgactggggtgctgagctcggagcggccctgcgtgcgggtggtgtgcgcatcgtgcgaggtgcgaccgacctcgcccggaacgctaaggtgctgaggggcgcgacgggggtccgctcgagggggtgagccgtgcttcgcagtcgtcgcccgactcgtccgccacagcgaccgggctggtatccagacggctcgggatggttgcgctacttcgacggccacggatggaccgagctcgttcgtgagcggctcgtcctcgctgagttccgaccgcagccgccggtcgcggagcgcccgccgcatcccgcgtcgacgagccgccccaggcagggcgtgcgcatcgccagcatcgtcctcgcgtgcgtgctgctcggaggtgttgtgcttcagctcgtggcgttgacgctgtcgccgcggtcgcagggctcatccgttatctccgaccgcgaagtgctggtgctcgcgagacatgcatgtgaagacagtcccgtcggccaggctgcgatcgtggcgagctccaaggcggctcgatcggcggcggcgtcgcgcgcggcccgcttgacgcagcttgcttccgaggcacacctcgaagccctcgacgacctcgcggccgcgtggtcgaacgtcgcggtcgcgttggtgcaggcggccccgcgatcggcctcgctgcgtgcggccatcgacgcggtgaacaccgcggcgagcggtgcgcacgtggcgtcctgtcgagcgtgagcgtgcgccggtttactcgccctggcgagcgccgtgtgctatcctccaggcatcctgcccaaggaggagtcatgagcgaaccgttcatcgacgatcatctgttggtgcgctatcgcgagctgctcgatgccgaggatcaggcgttctcggagatggagcacgacttcgaggagggcgatgcgcaacgcttcgcactcgaccgcgaggcctggcttgcggcgatccgccaccgcgtgagttttctcgacgcgtgtgggttggtacgcctcgatgtcgtcgtgagctaggtcgcccccggcgccgacccttgacgctggtgatcgttcaggtcgcggcgctacactaagcccagcactgccgggggagtagtgctcggcgcacacggggggaacgatgggcgcgagtcacacagctgtcggggcgtcggaccagtcgtcggcaggcgacgctcggcgtggtccgctgcgagcgtgggacggtcaaggaacggcgccatgtctcagaacgctccgcttcgacgcggacgatgctggactgaggagccgggcgctgtcgggcgaatggcagcgtgaagcgagatgtcgaggcgtcgatccacggacgttcttccccgagcgtggcggatcggcgacgtcggcccggcgcatctgcgctggatgcggcgtgcgcctcgagtgcttggagttcgcactcgtgaccgacgagcgctttggcatctggggtggcctgagcgaacttgaacgacggagtctgcgcgcccggcgcttcgtcgtgtgagcgagacgctgtgtgagcgagacgctgtgtgagccgaagcatcggcgagcgtggctcaggccacgggacggctcgactggagcgcgaaggacgcccttgctaggcttgcccgcgtgcttcgtccctacagagtggttgtcgccaagcccggactcgacggccacgaccgtggagcgaaggtcgtcgctcgagcgctgcgcgacgctggcttcgaggtcatctacaccggtctgcaccaaacggtcgagcagatcgtcgagaccgtgctccaagaggatgcggacgcgctcggcgtgtcgctgctgtccggcgcgcacctgaccctcgtcccacggctcgtcgacgcgctcgctgcgcagggccttggacacgtgctgatcgtcgtcggcggcatcattcccgagcacgatatcgatgccctgctcgggctcggcgtgggccgtgtgttcacgccagggtcgtcgctgaccgagatcacgtcgtggctcgaggcgcaactcgatgagcgggagcgcactggagccgggcagggaggataggcgtggatctgaaggagtaccaaggcaaggacctgttccgccgtttcggggtgccgacctcggagggacgggtctgcgtcacggtcgaggaggcggttgccgcggccgagacgctggggtatccggtcgtcgtgaaggcccaggtgttggtcggcgggcgcggcaaggctggtggcgtccgtgtggccgccaccgaggaggcgctccgcgaggcagcgggtgccatcttgggcatggacctgaagggccatcgggtgaaggaggtctggatcgagccggcttccgacattcgccgcgagtactacgccagcttcacgctcgatcggacggcgcgtcagtacctgctcatgctctcggcgatgggtggcgtggacatcgaggaggtggctcggacgcaccctgaggcgattgcgcgggtgcacatcgatcccatcgacggtctgaccccggccctcgccgaacaggccgttgcgaccgcagggatcgacgagggtcgcgaggagctgccggcgatgttgggtgcgctctatcgcgccttcgtcgaaggcgatgccgacctcgtcgaggtgaacccgttgatcgtccgatccgacggcaagctctgggcgctcgatgccaaggtgacgctcgacgacagtgccgcgttccgccatcccgagtgggaggcgtatcgggccgacgaggagctcgactcgcgcgaggcgatcgctcgtgctcggggcttgaactacatcggtctcgagggatccgtcggcatcatcgccaatggcgccggactcgccatgtccaccttggacgtggtccagcaggtcggtgggcgagcggcgaacttcctcgatctgggaggaggcgccggcgccgacacgatgacggcggcgctcgaggtgatcgcgacggatccgcaggtccgggcgctcctcgtgaacatcttcggcggcatcacccgctgcgacgaggttgctcgaggcatcgtcgccgcgctcgagcgcgtgcgccttccgttccccatggtcgtccggctcgacggcacgaacgccgccgagggcagggccattctctcgtcggttgtgtcggacagcatcatcgtcgagccgacgatgatcaaggcggccgagcgcgccgtcgcggaagcttcgaaggcggtcgcatgagcatctttgtcgacgagcacacgcgggtcatcgtccagggcctgaccggccgccagggcatgttccacggactgcgcaaccgggcctacggcacgcaggtcgtcgctggggtgacgcccggcaagggaggcacggacgtcgaagggatccctgtcttcgatacggtgaaggaggcggcagccgcgaccaacgcgaacgcgtcgttcatcgtcgtgccgccgcgcttcgctcccgaggccatcctcgaggcagctgcggccgggatcccgctcatcgtgtgcatcacggagttcatccccgccaaggatgaggccatggtggctgcggtgttgcgacgtgactaccccggcacgcgtctgatcggaccgaactgcccgggcatcatctcgccggggcgctgcaacatcgggatcaccgcgggggagattgcgcgtccgggtggaccggtcggcatcgtctcacgctcggggacgctcacctaccaggcgctctatgagctcagtcagcaaggtgtcggccagacgacctgcgtcgggatcggaggcgatccggttcccggcacgaccttcatcgactgtctggcggccttcgaggcagatcccgagacacgggcggtgctcatgatcggcgagatcggtggacaggacgaggaactcgccgcagcgttcatcgcagagcacatgaccaagccggtcgttgcctatatcgcgggcgttacggcgccgccggggcggcgcatgggtcatgccggcgcgatcgtgtctggctcgtcgggaaccgcacaggccaagatcgaggccctccgagcggcgggtgccatcgtggcgcagaatcccaccgaggctggcgagcgaatggtggaggtcgtctcgcgtctcgcctagccctgcggccctaggcttggcgggcgtgcgtgtcgcggtgctggcatctggcgtagggacgatcctcgagtcgctcgtcgatcacggggtcgtgccggcgctggtggtcgcggatcggccggcgttggccctcgagcgagcacgtgacgccggcctggtctcgacgctggtggatcgtcgttcgtatggatggcgagactcgttcgaccgcgaggcgttctccgacgccgtcgccgacgtgctcgaggcggccaaggtcgagctcgtggtgctggctggattcatgaccatcctcgccggttccatgctcgcgcgctttccggctcgcgtcgtcaatacgcatccgtcgctgctcccgagctttcctggtcacgacgccgtggcccaagcgctgtcggcgggggtgcgcgtcagcggcaccacggtgcacgtggtcgtggagcaggtcgacgccggcccgatcctcgagcaagagccggttcgggttcggcggggcgactcgatcgagaccttgcacgagcgcatcaagcacgcggagcgtgagctctatccgagggtcgtgcgagcgatcgttcgggcgggggtcggcggcgatcggtggtgggaggatgctcgtgtgcaacgagcgatcgacgaggaggttcgtccgtggcgcgagcgctgatctcgctgtatgacaaggccggtctcgagcgggtcgcgcgaccgctgcacgccgccggctggcggatcgtggcttcgggtggcaccggtgaggccctccgcggcctcggtgtccccttcgagcccgtagaggaactgacgggctttgcgtccatgctcgacgggcgtgtgaagacgctccatcctgcggtgttcggcccgatcctcgccgacctcgagcgtcctcaccatgcgacgacgctcgaagaggccggctgggagccgatcgacctcgtcgtcgtcgggctctacccgttcgcgtcggatccgtcggtcgatctcatcgacatcggtggtccctcgttggtgcgcgctgcagccaagagcgccgaccgcgtgaccgtgctcgtcgaccctgccgacttcgggctcgtcgacgaggtcatcgctggcaacgtcgaccggccgttgcgccggcgactggcggccaaggcctttgcgaccacgagcgcctacgacgctgcggtcgcgacctggctgggcggtggagagggctcgttgcccgatccgctggtcctccctctcgagcgcgtcgccgtgacccgctacggcgagaacccccaccagcgtggcgccctctatgcaccgatcggcacccgccgtggcttcgccgaggcccgttggcacggcggcctcgagcccagctggctcaacatcgctgatgccgacgccgcggcgcgtctcgtcgctcggctgggaccggagcctgctgcggtcgtggtcaagcacgccggaccgtgtggtgcggccgtcgcaccgacgcttgccgaggcctacgagctcgccttcgctggggaccccgtctcggcgttcgggggcgtcgtcgcgctcgggggggtgctcgatgtggcagtcgccgaggcgctcctcgcacaccccaaggcagacgtgatcgtcgccacggcgatcgacgacgatgctgcccaggcgctgctcgcccgccgtccgaagacgcgactcgtcgagctcgcgatcgatcgcgacgagccgtggtgggtgcgcagcgtcgcgggcggggtcctcgtgcaagagcccgatcagctcgaggagccgacggatctcgaactcgtcacgagtcgcgttcccaccgacgaggagcgccgtgacgcctggatcgcgcacgtcgtgtgcgcgtcgacccagtcgaacgccgtggtgatcgcgaggcagggggctgtggtcggtgtcggccagggccagccgtcgcgggtcgatgcggcccggctcgctgtcgggcgagccggtgcgcgcgcccagggtggtgccgccgcgtccgatgcgttcttcccgttcccggacgggctcgagaccctcatcgacgcgggcgtgacgtgcgtcgttgcgccggcgggatccgtgcgtgacgacgagattcgtgcagtggccgagggtcgtggcgtgagcctgctcgtcgctccgagacgccactttcgtcactaggaggtctggtgggagccaagctgctcgatggggagcgcgtcgccgccgaggtgcgcgccgaggtgcgcgatcgggtcgagcgcctgcgtgcggcgggcgtgcgcgtggggctcggggcgatcctcgtcggggacgatccggcgagtgcgcggtacgtcgagatgaaggcgcgcgactgcgcgagcgtggagatcgcgtctcgcgtggtgcgcctcggcccggatgcctcacaggcggacgtcctcgcggcggtcgagtcgttgaacgcggacccggaggtgagcgcgttcatcgtccaactcccgctccctcggcacctcgacccagatgccgtgctctgggcgatcgacccggccaaggacgccgacggattgcatccggtgaacctgggcgagctcgcgctcggacgcccgcgcgtcgtggcgtgcaccccggcgggcatcgtggagctgctccaccgtcacgggatcgtcctcgacggtgcgcatctcgtcgtggtgggccggggcctgacgatcgggcgtccgctctcgatcctcgcgtcgctgccccgagcgggtctcaacgcagccgtcaccgtcgttcactcgcgggtgcgcgacctcgccagcatcgttcgcagtgccgacatcgtcgtggcagccgctggcagccccggcctcgtgaccggcgccatggtgcgccctggcgccgtggtggtcggtgccggcaccagcttcgaaggacggcgcctgctctcggacctcgccgacgacgttgcggacgtcgctgcgtgggtgacgccacgcatcggtggggtcggaccgatgacgagggccatgctcctcgtcaacaccgtcgaggcggccgagcggcgagccggtcggagcgagccgtgagcgacgtgctcgatcgctacggcgagcgagtctgttcggtcgagctgtggccagcgcgcacgagcgatcaggagcaccgtctcacggccacgttggacgtgcttcgttccctgccgccagcattcgtgtcggtgacctacggcgctttcggctcgagccgccacgagagcctcgcgctcatcgaacgggtgctcgccgatggccatcgggtgctggcgcacctcgcggtggccggtcacagcccagaacaactcgtcgcgctcctcacgcacgtcgagcgtctcggcgctgacggcgtgctcgccctgcggggcgacccgccgctcgacgaccccgacgatcgtgcgcgcttcgtcggtcgtcacgcactcgagctggtcgaactcgctcggcagcacacccagctcagcgtcggcgtcgcgctgcacccctcgggccaccccgaggcgcgctccctcgaggacgacctcgatcaccaggctgccaagctcgcgcgtgccgacttcggcatcacgcagttctacttcgaggccgccgcgctcacccgactgcgaggcgcgcttcgcggtcggggggtgacccgaccggtgatccccgggctcctcgtgccacgctcgccccgccagctcctgcgcatgggggagatggccgcggttcgcgtcccgcgggagttggtcgaggcactcgagggtcccgacgggccggctcgagcgaggacggtcgtcggcgagctcgccagcgccgccctcgaggaggggagtcccggggtgcacctgttctcgatgaaccaacccgagacgacggcgtggctgctggagcgccttgatcggcgccatcgtcgcgtcagttgaggtgtttgccgaacgttcaccgtctggtcagcgtgaggcaaactcagcgcaaccgacccgtcgccgaactccgcaagactgaacccgtcagcgaatggcgctggtatcgcgagtcactcgaggaaggagtgatccatgagtgatcgatccgtcgacgcggccctcgacgaggcgccgctgagtcggttccacacgaggtcgatcttcgtcgcaggcatggggttcttcaccgatgcctacgacttgttcatcatcggcacggcgacgaccttgatcgcgaagcagtgggggctctcgtcgaccgagaccggcctcatcaattcgatcacgttgctctcggccttcttcggagcggtgatcctcgggcggctcgcggatgtcctcggccgcaagcgcacctacggtctcgaggccgggctcatggtgctcggagcggtcgcctcggcgttctccccgagcctcatttggctgctcgtcttccggttcatcctcggtctcggcgtcgggggcgactacccgatgtcggccgtgctcatgaccgagtacgccaacgtgcgctcgcgcggtcggctcgtcgggctcgtcttctcgatgcaggcactcggtaccgtcgctgggtacgtggtcgcgctcgcgctcttgtcggcgggcgtcaatcatgacctcgcttggcgcctgatgctcggcctcggtgcggttcccgcggcggcggtcatctacctgcgccgcaagatgcctgagtcgcctcgctaccgcgctcgcgtggagggcgacgctgcgaccgcagcgcgcgacctcaaggcgtactcgggcggtgtcgtggatgcggccgcggtcgccgagccgaccttgcgcctgcgcctcggtcagttcctctcgaaccgcacctacctcctgtatctgctgggtacggcgggcagctggttcgtgttcgactacgcctactacggcaactcggtctcggctcctctgatcgtcaagagcgtgctcggtaagcacggggcgcacgtgctcacggaggcgatcgcgctgcagctcatcgtcttcacggtggcggcggttccgggctactacctcgcctcgttcttcatggatcggatcggtcacaagcgcctgcagctgatcggcttcacgttcatgggcctcgcttttctcctcatcggggtgatccccggggtgacccacgacgtgctgccgttcctggtgctcttcggcgtgagctacttcttcgcggagttcggtccgaacctcacgacgttcgtgctcgctgctgaggtgtacccgacgagcgcccgctcgactggccacggtctctcggcggggatcgcgaagttcggtgcgttcctcggtgtcttcatcttcccgatcgtcaagagcgcgttcggcgtgggtggagccctggagttctccttcggcatggcggtcctcggcctcctcgtgaccctggtgcttcctgagcctgcgcagcgttccctcgacgacgtcaccggcgagctcaagctcgcagaggcggcccaggagtacctgcgccgggcttcgaaccagcagcggatggccggacaagactgagcgacctcctcatcggaggtgatcgacgaaccccgaccggaaggtcggggttcgtcggctttgctcgcgggtggtgccgtgcggctcgtgtgaacgtcgaggccgccgccgtgaccggagatccgcggtggtgccgtcaccgtcgtcggggagccgcaaagctcgcgtgggcgcggtcggcgccggcctgcgtcctgcgacggctccctctgggcgaggtggctcgagccgtgcgccgcgagacgccgacggtgtgtccgcgtggctgacgtgggtcggatgcgcgtgctactgtgcgaggaacggactcggtgcgatcgcagacggtccgatcgtggtgccgacgagcgtcgtgcgggttggctcaagtctcgggaggctcaggacgatgaggccagtgtgagcgagccgtccttctgggaaacgctggagcgtgtcgccgcgctcgtcgacgggccaccggttgttcgtccccagctcgtgaccctcgtcgggggtgatggtgccgtggacgatgtggcctcggcggcgtcgcgaggagggctcgtcccttcgcccgtagagcatggcgacgccaccgtgccgagcgatgacggcgcgccgaggggagctggcgaggcagacgtcgccgatgccgtggctgcatcggcggtggcgccgccgtcacctgccgaggatcaggctggcgcacggccaggcacaccggtcgctcgcgctgacgccgtcttccaggttctcgagcagacccagcgtgcagaggtcgtcgccgagttcggccgacgggacgctggggcggctccggccgagctcaccacggcgtctacgacgcccgccacctgggacgacgtcgacgagggcgtcgtcgccgcgccgagcggtttcctcgctggcctcgcggccaagcatcgcatcttcgccgagaccggtgagatcgacgtggatctcgaccgcgtggatcggcgcaagcgtcgtcgacgcggtcgatctgcctagcgcaccagagcggtgcgtgctggcagcggcgaggagccggcgccggtcggcgtgaccgtacgaccacgacggtgggctctgtgcgccgacgacatcgtggacgccgggtcgctccacgtgcagcgacggtcccgcacgagctgtgtcggcgatgccggtggctgggtcagcgactaaggagcttcgtcgccgaggtcccacgtgagggcgatgccctcacgttcggcgtcgcgttcgacccgcgcttggttgcggcggaactgtgggtcgtgcgctgggagcatgaggagccgcgcgttcgtcctctgcgcgaactcttcgcccactcggcgatcgccgctcgtcgtcacgatctcccagtgaggagcgaccgggcccaggtagcggatgcgtgcatgcgccctgatgggtaccggtgcttcgtcctcgggcatcgcccctcctctgctcggtgcgccagcctatcgtgactgaggctcgagagggtgcgtccgcttgcgcagaaagttactctatggtagcttctcgcatcgcagagccacgtgggccgtcacctgcagagggagggagcatggcgacagagcgaggttcagcgcccgaggcaggtgcgctcgtgagcgagccctggatggcgtttggatcgtgccgtggtatggatcccgagttcttcttcccgaccgacggtgctggtgtcgtccaggctcgccgggtgtgcgctcagtgcaacgtccgcgagcagtgcctgcagttcgccctcgatcatcggatcgatcacggcgtgtggggtggcgcctccgaacgtgcgcgtcgtcgcctcctctcacagcagctctcgtcggtgcgagcgcctcttcgcgacgtctagcctcgccgtgtgctcgagtgcgtgatcaatctcgccgaagggcgagagacacgtgcggttgaggcgatcgtccaggcagcagcccccgcgctcctcgacgtccacgtcgacgccgaccacaatcgcagcgtgttcaccctcgctggtcccatggtcgaggatgcggcgtggtcgatagcggaggccgccgctcacctcctcgacattcggcaccacgtcggtgtccacccctggctcggtgcgatcgacgtcgttccgttcgtcccgctcggtaccgcgtcgttggatgcggcgatcgaggctcgcaatcgaatgggtgcgcggcttgcgagcgaactctcggtaccggtcttcttctatggtccggagcgcggcctgccggaggtgcgccgtcgagcgtttcgcgatctcgcccccgatctccggccgactcggccgaatccgcgcctcggtgcctcctgcgtcggtgcccggggcccgctcgtcgcctacaacgtcgtggtcgatgcgagcctcgaggtggctcgcgaggtcgctcgggagcttcggggacctgcggtgcgtgcgctcgcgttccaggccggtcgtcgagtgcaggtgtcgatgaacctgatcgaccctcgggtcgtggggcctgcccaagtcgtggatcgcatcgcttcccgagtgtccgtgcgcgtgtgcgagctcgtcgggttggtgcctcgctgggtgctcgacgacatccctgccgagcgttgggcggagctcgatcttggaccagaccgaactatcgaggtgagactcctggctcggggcctgccgctcccagcgtgagcggtgccgacgactcggtggtggcgacatcgctgcgaccgaggtgtcgcaaccccgcccacgccagagcggcggtgcgctcggcgtagcgcgccgccagtgaggcctcgaacggccgattcggctcgtcgtcgtcgacgtcgtcgatgtaggcggcggccgcgccgttggcgaggccgatgagtgcccgtgcggtcagcagccgatcggactcgctgggtgctcctgtgatcgactcggcaacgagatcggcgatcgccagctcgataccaacgacgatcgactgaaactcgacgtcgcggtagacacctggcccgaagagcacgaggtaggccgcgcggtgcgcgtgcacgaaggcgaagaacgcgcggatgccagaccacagccgcacgcgggggctctcgacgccgcgcgtcgcctcggcgatcgcgcgcgccagctcggccccggcaccgtcgatgacctcacgaaagagggcgcgcttcgaggcaaagtgctggtagatgacgggcttcgtcacccgcgcatggcgtgctacctcgtccatcgacgccgactcgaacccacgctgcgcaaagaccgttcgcgccgcgtccaggatgagcgctcgccgacgctcggctgggagtcggtgagcccgtgtgtcggcctgcatgtgctcccctctgcgaacgcaacgcctcctcggtggccctcgacactagccaggttggcacgccgcgtctcgtcgtgcgcgtgcgctgtcgtccttctgccgcgccctgagcccagagtgcccggacctctgcgcgcctaggctcggggtccgtgaagacagcactcgtcaccgggatcactggacaggacggctcgtacctcgccgagctcttgctcgccgaaggctatcgcgtcgtcggtatgcaccggcgttcgtcgacgctgaacttcgagcgcatcgcgcacatccaagacgacgtcatcctcgagcccggggacttgctcgacgaggcgagcctgctcgccgtcttgcgtcgctacgagccagaggaggtctacaacctcgctgcgcagtcgttcgtgcagacgtcgttcggtcagcctgtgctgaccggcgagaccactgcccttggtgtcacgaggctgctcgacgcgatccgggtggtcaaccccgagatcaggttctaccaggcgtcgacgtcggagatgttcggcaaggtcgtcgagacgccccagcgcgagaccacgcccttctatccgcgcagtccgtacggtgtcgccaaggtctatggccactggatcaccgtcaactaccgcgagagctacggcatgcacgcgagctctgggatcttgttcaaccatgagtctccacgccgcggcctcgagttcgtgacgcgaaaggtgacgttcggggtcgcacggatcgcccatggcctggcccacgagctgcgactcggcaacctcgacgcgcagcgcgactggggttttgcgggcgactatgtccgtgcgatgtggttgatgctccagcagcccgagccagacgactacgtcatcgcgacgggatcgacccattcggttcgagaactctgcgagcgcgcgttcgccgtcgccgatctcgattgggagcgctacgtcacggtggacgagcggttcatgcgtccggccgaggtcgatctgttggtcggcgatgcgagccacgcgcgacgccggttgggttgggagcccaccgtgagtttcgacgcgctgatcgagatgatggtccgggcggacctcgagctcgtcggctcgacgctgaagtaggcgccatggcccgcagggtcgttcggctgcggggtgtgaccgtcctgctcggtcggttccctgcactggctcgtgccgacttcgacgccttcgaaggcgaagtcgtcgtgctcgaagggccgaacggatccggcaagacgacgctgctgcggctcctcgtggggctggttggcgcgtccgagggcgaggtggccgtgttcggcctcgaccctgccaaggacgtcgcgagcgtgcgtcgcgcggcgacctacctcgggcaccaggccatgctgtacgaggatctgagcgccgaggagaacatcgctttcctcggacggctcggcgtcatcgatgccgaacgcgcccggggcctctgcgaccagcttgcggtcggccgacgcgagcgagggcggcgcatgcgacagctctcggccggccagcggcgcaaggtcgcgctcgccgcgacgctggctcgacctgctgagttgctcctgctcgacgagccgcacgctgccctcgatcccgagggcaaggaactgctcgatgcgctcctcgcagacgctggcgcccaaggtcgcaccgtgatcctcgcgagccacgaggcggagcgggttcgttcggtcgcgacgcgtcgctaccgcttgagcgggggtcatcccaaggagctaccctcgtgctgaaggtcgcggtcgcggtgtggcgcaaggaccttgggatcgagtggcgaactcgcgtcctgctcaaccaggtggtgccggtcacgctggtcatcgtggtgctttttgggttcgggctcggcgccgacgacccgctccttcgagccgccctccccgggctgtactgggtcagcgtcttcttcggtatgaccctcgccgttgcgcgcggtgcggcgatcgaggcagaggcgggtgcgggcgagctgtggcgtctcatggatgtgccccgcgctggcgtgtacctcggcaaggtgcttgccgtcgcgacctggggcgtcgtgatcgaggtcgtcaccgccgccgcggccgccattctcttcagcgccccgctcggtcaccctctcctgcttgcggcggctgcgctgctcgccgatctcggggtcgcggcggtcggggtcgtgctcgcccagctcgcgaccggggagcgtgcagccgagagcctgctgccgctgctcacgctgccggtggtgagccccgtgctgctggctgctgcgaccgtgtggagcgagggactcgctcaccacgcttccctggcaactccctgggtcgaggtcctcgtcgcgttttcatgtatctacctgatcgttggcatgcttgtatacggtgtcgtcctggaggggtgagtcgtgagacaacgcgcatcgatggtgcgacgagtggtgggtcttggcgcgctggctggtgtggcgctcaccgcctggctcggcctcgtggccacgccgcccgcggagttcttcggcaacctggttcggttgctctacgtgcacccgtcgatggcgtgggtcgccttcttggcctttggcgtgacgacgctcgcgagtgcgctctatctgtggccgaggacccgtcggcctgagtgggacctgctcgccgctgcctcggccgaggccggcgtcgtcttcaccgggctcacgctcgtgaccggctccatctggggtcgaccgacctggggcgtgtggtggacgtgggatgccctgttgaccgcgaccgccgtgctgttcctgctgtatctcgggtatctcgcgctgcgtcgaattccgatggacgaagagcgtcgtgcgaagcgctcggcgatctgggcgttgatcgccttcatcgacgtgcccatcgtgaaccagtcggtgtactggtggcacacgctccatcagcgtcccaccttgaccgttggaccgacgaacgcagtcgaggtccacgggatcatggccgtggcgctggccgtaagtttcgtgtcgttcacgttggtatggatctggatggtgtgggcacggttcgacctcgcgcggcgccagcgcgtgctcgaggaggccgaggtcgagcaggccctcgccgagcgcctcgaggccgtggaggcgggctcgtgaacggctacgtggaggccgggtatctcgcggtcgcgctcggtctgggtggctacgcggtgtggatcgccgccttgacgacgcgcgtacggcgtcgtgaacgcgaactctccgtgacgaggcaacgccgtggctagtgcgccgagcacgctcgacggtcgcgacgagtggaagacggtcccgagcgctcgtcggacgcgtcggcggatgctccagtcgttggtcctgttcgcagcgatcctcgtcgcgctcgtggtcgtgctggccatgggcgccaagagcgcgctcgagtactacctcacggtcccgcaggcgctcgccaagcgcgccacgctggccggccagaccttccgcatggagggcatcgttgtgcccggctccatccagtcgacacccgagggggtcgattttgccctccgctacgaccgtgcggtcgctcgggtcgtcgagatcgggaacccgccccagctgttccagccctccatcccggtggtggtccaaggtcacttcgagggttcgacgttcgtctcgaacctgatcatggtcaagcacacctcgtcgtacgtggccgcgcaccccaaccgcatcgctgatgccggagggacctacaagccgtgacgcaggcggtccttggtacggcgggactcgtcgttgccttcgtgttcgaggtcgcagggacggttgcgctcgccgttgcactctggcggcggaggcgactctggcgcgacgtgggccttcggctgctcgtggtcggggtggcggctgtggtggcatcggtcgcggcgctcgaagatgccctggtcacacacgactttgcgctgagttacgtggtccagaacaactcgagggagacccccctcatcttctcgatctcggggatgtggtcggcgctccaaggttcgctgttgctctgggctctggtcgggggggtgtatctcctcgggctcgcctgggtgctccgtcatgaggacgactgggtggtcggcgcgaccgcgctggcgatcctgggtgtgatcgaagcgttcttcgtcggggtgatcctgttcgccgcgagtccgttcgcactcgtgagcggggtcattccggtcgatgggcagggcccgaacccactgttgcagcagtatccgctcgtgctcatccacccaccgatgctctacgcgggtctcgtgggcatgagcgtcccgttcgcgctcgcgacggcttcgctctggcatcgccacctggacgacgcgtggctccggcgcatccgcaactggtcgttgatctcctgggtcgcgctcggcatcggcattaccttgggggcgtggtggtcctaccaggtgctcgggtggggcgggtactgggcgtgggatcccgtcgagaacgctgcgctcttgccctggctgatcatggccgcctacctccacgtcgccgtcggcgaacggcgtcgtcgccgcttgagtgctgctgggtatggtctcgtcgccgccgccgccgcgatgacgatcttcaccacctacatcacgcgttcgggcgtcctcgagagtgtgcacgccttctcggactcgagcctcgggacggtactgctcgtgttctttggcctcgtggtcgtcggcgcggtggtggtcgcgctcgcgcgcgccgatgtgctcacgcagccaggagcgcgaccgaacggggcacgcgggacgctgctcggcatcaacgcggcgctccttgcgctggtcgcggtggtggtcctcgcgggcaccatcttcccgctcatcgactaccaggtgagccatgcgagcgtgaacgtcggtgcgcctttcttcgatcgcttcgtggtgcccttgtcgctcgtcgcgttggccctgatggcgctcgccccctggtcgaggtggcagggcgcccatctcgacgaactcggttcgcgcaccctcgccccggctgccctcgcggtggtggtgctggtcgtcgccgtcgcagccggggttcgatcgctcgcaacgcttggcgcgtggtcgctcgccgccttcgtgctcgtcagcaccgttgccgcagtggcacgacagttggcggcgcgcccccgcggtcgtcggcttcgcgcggtcgcgtctcggcaggtggccgggatgatcgtccacatcggcgtcgcgatcgtcgcggtcggcatggcatcggcgacgaccttcggccaccagggcgaggtgcgcatcgcacgcggccacaccgtgagcgtctacggccagcgtctgacctacgagggcgtgcgcacggtggtgaccccgcagaagacttcgttcgaggccgaggtcgtcgtcgacggccaggggcgctactacccggctatcacgcagttcgggacctacacgacaccggtgggaacgcccgccgtcgcggtctctccgctgcgcgacgtctatctgaccatcgacgcgcccccgagcacctcgtcctcaccgatcacgctcggcgtcgtggtccagccgctcatcttctggctgtggctcggggctgcgaccatcgcgttcggtggtgtgctcgcggtggtggggatccggctcgaaccgtccggacgacgtccttcggagcgcccggaggcgccggtgccgagtgtggtgggtgcggatgcgtaggcgtcggccagtggtcgcgttcgggatcggggccctcgcgctcgtcggcggcttcacctggctcgctgcccgcgcggctccggccagcgagatccaggcaccctccccgctgctctacaagccggctccccgattggcaggcccctcgctgtggggctcggggtcggtgtcgctcgctgcgatgcgcggtcgctacgtcctcgtgaactacttcgcgagctggtgctccacctgtgccaccgaagagcgccagctcgtcgacctcgctcggggctcgggagtacgtgtgctcggcgtggacttcgacgacacgaacggttcggcccgttcgttcctcgcgcacttcgacgcgcacttcccggtcatcgtggacgcgagcgggcagcgcgcactgcgatggggagtgtcggcgccaccggagagcttcctcgtctcaccgagtggcgaggtcatcgctcgcatcgtcgggccgctcaaggcgatcgaagtggaggcgctcgtgcgcctcgccgaggcgaaggggtacggggcgtgacgcggacccgtcgcatcgcggtggcctggttcctgctcgccgcggtggccctcggggccgtgctcgtcgcgctcgtcgagcagccgtcggcggcgtcgcctgctgctcggatcgcctccttggagcgggaggtccggtgcctgagctgcggagagctcgacgttgcccagtcgaagagcgccgaggcctactccatggcggcattcattcgccacgaggttgcggccggcgcatcgaaccagcagattctcgatcaactcgtcgcgacctacggtgacgcggtgctgatggcgccaccggccaacgggctcggcctctacttgtggttgctgcccgtggcggtcggggctggcatcgcatgggagctggtgcgcggggcgcgccgtcatcgcgatccggaggagctctctggcggccgtctcggcaccgacgcggacgagccggcaccgcagccatcgaggcgtaccggcggcggggtcgggttggcgctctcgccgacggccgtggccgcggctccgtccggtgaggatgagcgccgcgctcggccgcgtcggttggcggtgccgaagtgggcggccctcgtcgggggcggactcatgctggtcgcagccggggttggtgtcggggtcgccatcggcgggtcgggcggcacggctcacacgacagcgaccctcggtgaggatctgcgcctcggggagacgttggcggccgtgggggcatctgctcaggccgagcgagccttcgaggctgcgctcgagctcgcgccgacgaatccgacggcgctcgcctacgagggctggctgcgcttcaacacggcgcactcgagtagggcgcgtgcggcggcgctcgcgatgctcgatgaggcggcgcagctcgggccgcacgtcgccgtcgcgcagctgttcgatgggttcggactgttctacggccgtcacgagaccgccggagcccttgcgcgtcttcgtgcgtacctggcggatgcaccgagctcgaagctctcgctcgaggcctcgccgctcgcggtgccgatctactcggcggcgcacctcgccgtaccggcgccgttccgaagccgaggttgatcgccgcatctgcgtgcgggccgatgtggtggtcgggctggctcgccggggctccgcttcctccctgggaagcccggtggccgcctcgtggttgctacggtacggctgctgtcaggaggttcgagtggggttcttcgatcgcaagcgcaccgagctcatcgagcggggcatcgacccgagtcgtctgccgccagggcagtacatgaccgaccgcttcccggtcctgcacgcaggcgaggttccggtctatcacgaccttggtgcgtggaacctgcgagtgttcggccgcgttgggacccctgtgacgctgtcgtacgatgagctcctcgcgctcggtaccgaggacgtcacgaccgacatccactgcgtcacgaagtggtcgaagttcgacacgcggtggcgcggtgtgccgttctcgcgcatcgtcgagctcgtacgaccgagcgaggacgctgcctacctcatcgtgcacgcggagcacggcttcacgaccaatcttcccctggccgatctcctcggggatcacgttgccatgctcgcgacccactacgacggcgtgccactcgagccggagcacggcttcccggtgcgcttcctcgtcccgcacctctacttctggaagtctgcgaagtgggttcgcggactcgagttcaccgagtccgaccgacccggcttctgggagcgcaacggctaccacaactatggtgacccgtggcgcgaacagcgctactgggacgagtagttcggaccatcgcacagagccgagcgctcgcatcgcgccgtgaggccggcacacgagggtcgaggccgcgtgattcctcaccgctctctggcgcgtgcgccccgcgagatcgtgccgtgaccgcgtactagggtgctgccatggcgggtgcggcgtcgtcgcctggtccgctggacgaccccggcgacgaggtgggtttgacgactcttgctccgggcgtcgcggtgcatccggatcatgcgagcctcctgcgcgaactcgatacggcaccgctcggtctcgagcacgtcgtctcgtggtggatcgcctcgggcgggacgctcgccgatggcttgtccgtggccatcatcggcatggcgctgccactcgccgaacatcagctgcacctcggtaccgtagaggtcgcgctgctcggagctggcctggtcgctggcgctgcggtgggggcgagcgtcggtggacatctcgccgatcgtgtggggcgaaccgcggtgatgctcgccgacatgctgctcctcatcgtggcggccgtggcgagctcggtcgcgtggagcgcgccgttgctggtcgtcgctcagtgtggggtcggtatcgccgtgggtatcgattttcccgccgggtcgagctacgtcgcagagacgatgcctcaggcttcgcgtgcgcacttcctggtggcgacgatcgcgaaccaggcggtcgggatggtgctcggtgctgcactcgtcctcggactcgtccacgaggtgcagaccccgagcgtgtggcgcttcttcttcggcgtcgaggcgctcgtggcagccttctttctgctcgcgcgcctgcacctcgtcgagagcccacgctggctgatggcccgcggtcgcaaccgggaggcgttgcgcgcgatggaggtcttcgtgccgagtcgagcacgcgcgttcgaggggatcgctgcgcggctcggcgatcggccgctgcacgtcgcacggatcccgcacgatgacaaggcggcgcggtttcgctccatcttcgcccccgcctatcgtcgtcgtacgctcctgacgaccgtgccgtggctcttgatggacatcgcgacctacggtgtcggactcttcacgccggtcctcctcgatacgctgggggtgcgatcccactcgtcgaacctgccagcgcgcacggcgagcctcgccctcgggacgggcttcgtcgacctcttcctcctcgcgggctttgccgtgggcgtcgtcgtcgtcgcccgcttcgggcgtcttcgcatgcagatcctcggcttcgtcgggatggcgatcggcatgggtgtgcttctggcgagcacgcaggtgacgatctcggttctccgggtcgcgttcgtgctcgtcggtttcgtggctttcaacttcctcatgaatgtggggccgaacagcacgacctacgtcctgcccgcggaactgttcccgacgcagctgcgcagcaccgggtcgggcttcgccgcgtcgatggccaaggtcggagcgacgatcggcgtgttcctcgtccccgtcgtgtcggctcattgggggaccgccgcggtcgtcggtgcgatggtcgtcgtcagccttctcggtgcgaccaccacggtgctctggcgagtcgacgatcgtgagcagacgctcgaggagcatcaggcgtcagagcccgtcgatacgctgtgacctcgtgggcggcgagatcgacacatcgggcgggacgctgcgcgggcgtgtgctgatgcgcgtctcgaatcagacgtcgccgagtcacgtgcgtcgtggacggcgtctggccggctgcggtggctgcgagagcaccgtcgtccctcgccagtgcttcgccgcgcgcgtgaccatcactcgatccagccacgctcgcgtgcgaccgcgacggcttcgtggcgattggcgacgccgagcgtgtggatgatcccagacaggatgttgcgcgtggtgccgggggcaaagtggacgcggagggctacctggccgatcggagcaccgtcgctcgcggcgcggagcacgcggagttcccgttcgctgagcgggccgtggccccgccgcaaatcgggggcgatgtggggatcgatgacgcagctgcctgcccacgctgcggcgagtgaggctgcgagcgcgtcgatcggcatgctcttcgagaggactccgcggacgccagcggcaaggagctcgagggtcagtgtgctcgttgcaaaggcgctcagcacgaccacgcgagagccggcttgggtgagttcgcgaatggcctcgactcctccgccgggaacgtcgaggtcaaccacccagagcgctgcggtcgtcaccgtgtcgtcgtgagggccaggcatggtgaccgaggtcgtgacaatggtgaactggccagtgccctcgaggagcgacgcgagtgcgctggtgagcagttcgtggtcgtcgatgaggatcagagggatcgtgggactatctcctcgctcgactgcgtccgctccaggcgaagccatgtaccgggcggttctgaaccgaggctccagcgtgctccgatggcggctgcgtgcgcctcgacggcgcgcaggcccgcaccaggcgcaccgtgcagccccacgccgtcgtcgtgcacggagagggtgagtcgagtgctctcggggtcgtagcggatcgagatcgccgcggtcgtggcgccggagtggcggatcacgttggcaaccgcctctcggaggatccatgcgagatgctcgtcggtggccgggtcgagggcatggatgccgtgggtgtcgaaggtcgtcgcgatcgacgccgtcgcgagccgctcgcgggctcgtgcaagctcgtcgaggaggcggctgggaggtggcggttcgtcgatccgtcgcagcgattcgagcgcatcggcgagttctcggtggacggaggtgagctggtgctgtgggtcggagtactcgagggaccgaagagcgatggcgacgtgctgtgcggcggtctcgtgcagctcgcgggcgaggcgcagccgctcgtcggctctcgcccgggcgacatcggcgtcgcggagacgctcgacggtgtgcagtgctccgaccaggtccgtcatggccgttgcgcccacaccggcgagcaggacgttcacggccaggttgatgccaaggccaggactgtgcgtccagccgatcgcgagcgtcacggcggcgagcaagccagcggcgagatagctgcgccatcggcctcggagcgtgatcgccgtggcgatcacgacgatcatcagggacgtctgtgctgcggggtcggacgcgacgcccatgagcgaagccgcactcgccacggtgagagttgtccacacgagcgtcgggcgagcggcccgaagcgtcgcgacgagcagcccgatcagggccgcgacgaggatccacgcgacggccgatgctcgtgtgcggttcagcatcgccatcgcaaaggcgaggttcgcgccctcgagaaggagccaggtgagggtgaggttccgcgttgcccgtggtgctggactggtcatcctgctcgttctcctcgagcgcgatggtagccgatgaaggtcgcgatcgcgaaggcgagctcccacgcgccaaggacgacgacagcatggccgatggccttcgcgccgtagaacggggtgagagccatcgagacgatggcggcggcaggggtgtcgacgccgatctggcgtaccagctccggcaatgtggaaagcgggacgaacactccacctgcgaactcgaggacgaaagccgcgacgctcgccagctgcgacgccgtggtcgggctcccgatcgcaccgatcgcgagcgcgccctgggcaaacacggcaccgccgagcagggcgaccccatccacgcagagccagtccgcgagcgggagctgagctccgagccagagcgcgatgccgtcgaggacgagcaggccagcggcgccaagcacgagagcgccgagggcgcgagcgagaaagtaccagcgactcggcgcgacgccaaccgtgctgagggtccggagccatccacggtggcgatcctccgcgaccgcgatcccggcgccggtcatcgcggtgatgccgacgtaggctgcgaggtgagccgtgacgagggcgacgatgttgcccgagccgacgacggtgtggcggtatgcagcgtggtcggcgaagaccacgagcagcaccacggggaccacggcgatgagcagagcactccgccgcgccagcgtctggtgccgaacgacgagttcgatggtggctcgcgcccgagcgagactcgggcgaggggagcggtggccgattgcggtcatgggtgttcctccgtcgtcggatcgcgctgtaggttcagcagtcggcggatcgcctcgtcgagtccgacgggggcgatctcgagcgcagtcgcgccgaggtggagcagttcgtgcgccagcccatcggcatccgtagctgtgaaggtggttcggtcgcgctcgatctcgagcacggcggctccgtagcgatcgagggtgtcggcatcgggttgctcccggagcgtggcgctgacccgcgcgaacccggagcgccctcggatctcgcgaggcgtggcgtcggcgatgagacgtccgtgcgagagcacgatcactcgatcggcgagtgtgctcgcctcggcaaggtcgtgcgtcgcgaggaggagcgcgccgccacggctgcgatgatcctcgaggacggtcgccagggtcgcgcgggcctcgaggtcgagtgccgtcgatggctcgtcggcgatgatcagctcgggcgtgcccgcgagcgcgatcgcgaggcgtacgcgctggcgctgtccgagtgacagcgtctcgaagcgagtgcgagcgagctgcgtgaggccgaatcgtcgtgccatcggggcggtgtcgacgccgcgcatacgtccgagcgcgtcgaggagtgcaccgaccggtgcagatggggggaaacctgcatcggcgaggaggacgccgacggcgtgcgcttggcgagtgagtcgagggggctcgccgaagaggcgcaccgatcccgcttgtggcgtggcaaggccgagcaggcactcgatcgtcgtcgtcttgcctgcgccgttcgggccgacgagcgcgaccgactcctccgactcgatgctgaaggtcacgccgtcgagtgcggtgaagctgccgtatcggcggacgacgttgtggagctcgaccgcggccgttcgggacgtcatgctgggcaacgtaggtcctgggggccgagtgtcggtgacgacggacgtcacgagatcgcgtgacaccggtcacgcgccgcgacccgctcgacctcactgatggccgacgatccgcactctctgagctcggtcgatgcgtcgtcgatcgagcggcgcctcgctggttgggtgggcctccgcctccgcgcagtcgcgcaggccacacgtcctctcacggaccaggttcgaggagtggcccggcgtcgttcgatctcgcgggagccgtgccctctggcgagagctcgaagcgcctcacagagaacgacaaccgaccgtgctccatcgagcgagccttcgttgacccactgaggacaacccaccccgggtgggtgggtcgccgtcgttgcgctgctcggcgatccatgcaagctcgctcccgccacgcggtcgtcacggtgcgagtggtctcggtgtcaggggctagccagcctgggctcgtaccgagggagcacgtggtaagaggtcgatccattgcaagaaggcgctcgcggcaggcagaggggcgctctcggcccgaggctcacttggaccgacggtccgtcgcgaggccctcaggcggtctgggcgcgctcgccgtcggccgtcacggtgcccctgctcgcgcgatggggaggggccatcatccgtacctcgcacgagcccgccgtgccgcggatcgggcgggcgtcgagtgtgccatcacccagcccatcgaggaggccgtcgaggatgcctcgctcggtcgcacagagggcggggtagtgctcggtgaggaggccgaacgggcagccgtgctggcggatcgtctccgtgccgtcggcttcggcggcgaaaccacttcggcgaagcgcggtcgcgacggcccgcatgaccccagaggcgctctcactgacggccgtcgacgcgagcgccgcgccgtgggcgcgtcccacctcgtaggcgatcctcgccgctcggtcggctgggacctcggcaagcaggcctccgacgagagcggcgaggagttcgacctggctctcgaggccctcgaacggtgctcgcgatccctccgcccgatagcgcttggatggtcgaccaacctggtggcgagcaccctggctgacgacggcgaggtagccggcctcgacgagacgatcgaggtggtgtcgtgcgacgttcggatggaggttgaagtgtgccgccactgacgacgcggtcacgtcgtgctgctcgcgcgcccagaggtagatcgcgcgtcgcgtgccgtcaccgagggctcgcgtgaggtcatcgagcgtctgggtgagccacacgcccgttccgcgctccacgacgcctcctcgcactcgctggccgagacggctgttctcgtaccgagggccaacggcgactagtttatcgctgagcgacgtggtgggagggactgtggcacgtgtgacgaccgaggaggtgctcgagcgactcggggagctcgccgacccggacctcgaccagccactcgtcgaccttggactcgtcgatgtcgacatcatcgcacgaaccccgcgcgtcaccgtgcgctacgtgccgggctcggagcaggtgacggaccagctgcgcagcagtgcaaggcagcgtctcgaaccgctcggcgtccagctgatgctcgaacctctcgatgaggagggcctgagctccctcgcggctcgtctcgagtcgacgagtgctcgcgaagcacgtgaggcgcgcaaggcgccgttcgcgagtcccgagagccccacgcgcgtgctcggcatctcgtcgggcaagggtggcgtcggcaagtcgtcggtgtcggtcaatctcgccctggcgctcagtgccttgggccaccgcactgcgatcttggacgcggacgtctacggcttctcggtgccgaagatgctcggcgaagagcgtccgccgcgggtggtggggcagctgatcgtgccgccgaggatccgtggcgtgcgagtcatctcgctcggtttcttcgtcgacgatgcgacgcccgtgatctggcgtggtccgatgctgcactcgacgttgcagcagttcctcgtcgatgtgtactggggcgagctcgactatctcgtggtggacatgccgccagggaccggcgatgtagcgctgagcctgcaggagttcttgccgagggccgagatctacgtggtgacgactccccagcccgccgcccagcgcgtggcacagcgctcggcgatcgccgcccgcaagctgaagctccccgtgcgcggcgtcgtcgagaacatgacggacttcgtggccgacgacggcacgcactacccgatcttcgggtccggcggtggtgacgcgctggcggcggccctcgaggtccccgtccttggacggatcccgttgacgatgggtctgcgtgccggtggcgacgaggggatgccggtggtcgcggtgcgtcctgatgaccccgcggcggcagccattaccgagcttgcggcgcgtatcgtgtcgctcggtgctgctcggcgctaccgcgccgatctgcgcgtgcagacgcgctgaggaagagtggccggtcggccacgatgcgaggaggatacgtgcaggtacggatcgggatcgctcagagtccgcgtgagctcgagctggagttggccgaggagagcgaccaggctgcggtggcccaggccgtcgatgccgccatcgaggccggaacgggagttctctggctcgaggatcggcggggtcgacgtatcggagtgcctgtagaacggatcgccttcgtcgagctcggaccggatcggaaccagcggtcggttggattccgggcctagccgatcatccgcatgggctttgacctgctccgccgccggctgctgatcatcgccggcaaggggggagtgggcaagacgacgctggccgcctcgctcggcctgcttgcggcgtcgcgtggtcagcgcacgctgctcgtcgaggtggatgcgaagggagatctcgcggcccaggtcggcgtcgcgaacgcggggttcgagcccgtcgaggcccggcgcaacctgttcgtcatggagatggacacgcaggctgctctcgaggagtacctgcgtatctgggtgaagctcccgttcatgggtcgactccctggactcgggcgcatcttcgacttcgtcgccacggcggcaccgggtgttcgcgagctgctcgtcgtcgggaagatctgctacgagattcgtgaggaccactacgacctcgtcatcgtcgatcctccggccagcgggcatgtggtgtcgcagctcggggtgacgaccggggtcggcgagctgatcgggcggggactggtgcaggggcagacgtcctggatgctcgagatcctctcggacccggcgcgctcgctggcggtcctcgtggccacgcccgaggagacgccggtcgaggaggccctcgagctcgccgatcgcctgcgcgacgagacgccggtgcacctcggcggagccttcctcaaccgcgtcgtgccggtgacgctcagcgaggaggagctcgaggcgctcgagcgcaccgcgggccgcggtccttcggcactcggcgcggtgctcggtgccgctcgtctctcccagggcattgctcggcagcatgctcgcaaccgcgcagtgttcgccgatgcgctcggccccgacgttccgcttcgggagctcccagagctttttgcgacggtgccaccatcgcgcctcgccgacgaactcgctgaggcgctcgaggtgctcacgtggtgagcgaggccgttcgtgcggtgacggcgttcgagcgcttgttcgtcgtcggggctggtggcgtgggcaagaccacggttggcgcgggccttgcgatcgcgaccgctgtcgagctcgacgtgagcgtcctcgtcatcaccgtggatccggccaagcgtcttcagagcgcactcggtctcgaccatctcgatttgcgtcccgtgcgggtgccgctcgagggactcggcgccaaggggcggctcgaagcggcgagcatcgacatgaagcggacgtgggatgggatcatccggcgctgggccccgactgacgaagtgcgcgatcgcctgctcgcgagccccatctacgaacacctgtcgtcgcgcttcatcgggtcctacgattacgcggcggtcgaggtcctcgccgaggtcctggagggcggttcctgggatctcgtcatcgtcgacaccccgccgtcgcgcaacgcgctcgacatcctcgatgcgcctcgccggctgatcgagttctttcgctcggcgctcctgaagctcctgacgttgccgcggcgtgcgcgagcgttctcgctcgcggcacgcccgttcttcgtggtcgccgaggcggtgctcggctcggccttcctcgaggacgtgacggagttcttcgccgattttgcgacccttgccgagccgctcaccgagcgctctcggcgactcgaacaggtcctcgtcgctcccgagaccggcttcgctatcgtgtcgacgccgctcggtccctccacgagagaggcagaccggctcgaggccgccctgctcgatcgcggactgcgtgtcgccgttcggatcgtgaatcggtgctggccgcccgaggacttctccccggcggccgagcaagccctcgggtggttgcgcagccccgagggcatcgaggtgctgggccgcgaactcggagacgacggggcggccgcacgcgtcgctgccgagctcgccggcctctatgcggagctcgagggtgcctgggctgcccgggctcccgagggagcgggcagcctcgagttgccgctgaccgatgcagcgttgacctctccagaggccctgtggtcgctcatcgcaaccgcgaggatccgaggggtcacctccgagcacgagtagcatgggcggcggtgatcgactaccacctgcacctgtggccccatggtgagcgcgatcgcgacgtcgtcatcgaggagcttgctgcgttctgtgaacgcgcacagggtcgcggtgtcgacgagatcgcgatcacggagcacttctaccgatttcgccaggctggctcggcggtcggtggcttcttccggcgctacccggattcgccggtgcgcgccgagatggagcgctactgggaggagaactcccgggcggatctcgacgcctacgtcgagacggtgcttgcggccaagcgcgagggcttgccggtcgtccttggtctggaggtcgactactacgagggcgccatggaccgtgtcgcggcgctccttgccggctaccccttcgacgtgctgctggggtcggtgcactgggtcggtgcctgggccttcgaccacctctccgaccccatcatgatggccgagtgggagcgcgtcggcgtcgagcccgcctgggcggcctacacccgaagcctcgaggagctggctgcgagcggcgcggtcgacgtgctcgctcacccggacctcatcaaggtcgccggtcaccgaccggaggtgcccgacgagtacgaggcgcgtatggccgaggcggcgcgtgcgtccggcatggttgccgaggtgtcctcggccggtgcgcgcaagcccgtcggcgagatctacccgtcgccgtcgctcctcgctcggttcgtggcggcgggcgtgccattgacgacggcgtcggatgcccatgggctcggagacgtggccgatcgatcgagccagctgcgagccacgctcgaggcggcaggcgtgagcgagctcgcagccttccgggcgcggcggcgtcagtcggcactcctctaggctcgatgaccgaactcaccgccgtgggtcggctcgaccaggccgagcggacggcgctgcgtgagatcttgcggttctggggattcctggccgacctcgcgttctcggacctgttcatcgccctgcccgacggggacgacttcgtcgtcgtggcccaggtccgtccggcgaccacccagaccattcacccgggcgacctgatcgagactcgcctcggtcccgacgaggcgcgacacctcgccgaggcgatggaggcgagggtcatggcgaccgtggatcgctccgacgggactcgcctcatccgctccgccgcgttgccgctcgccatcgaggggcatctgccctacggggtgctggtgcgagagcgcctcgtcgagcactatcgcaccaccggcgaactcgaggcaacctacaaggcgctctacgagcgcttcagccggatgatggtccagggccgttttccgtatccccagagcgacgtcgaagaggcgccgcgcgtcggcgacggtgtgctcgtgctcgatcgcgctggccgcatcacgttcttgtcgccgaacgcgacgagtgcgctccatcgcctcggcgccacggaggtgacctcgggggcggcgctcgccgacgtcggcatcgacgtgctcgcaccggcccgggctgcggcgctcggcgcgcccgtgctcgaggaggtggagcatgcgggcggtgccacggtgaccttctactgcctgccgctttacgacgcgggcgagctcaccgggcacctcgtgctcgtgcgcgacgtcaccgacattcgccagcgcgagcgggtcatcgcctcgaaggacgccacgatccgcgaggtgcaccaccgggtcaagaacaacctccagaccatctcgtcgctgctgcggctccaggcgaggcgcctcgccgaccaggaggcggtcgcggcgctcgccgaggcggagcgacgcatccgctcgatcgcactcgtccacgagttcctctcgcgggacgtgtcggaacaggtggaggtggatgaggtgctggcggccatcggtcgcttggccgaggagtccaagctgccaggacgcacgctcgagctggcgatcgagggctcggcgggcaaggtcgaggcgacctgcgtgacgccgcttgccatcgccctcgcagagctgatccagaactccctcgagcacggctacggcactgagagaacgcacctgcgcgtcgaggtggctctcgagcgacacggtcccgagctctgggtggtcgtggcggacgacggcgtcgggtacccgagcgacctggatgcgcggagcgctcgctccctggggcttgcgatcgttcgagatctcgtggcctcgcagctcggcggcactattcagcttgcgcgaacgcccggcggcggcgcgctcacgcggcttcgagtccccgtcgagcgtcacgagcgctgacgtggacggccccgagggctctggtacgctgggcccgaagcccgctgacggtggcggcatgcggaggaggcgtctcgcgtgaagatcgcggtgtgcacgaagcagatccccgaccctcaaggtcctcagcgtctcggcgacgacctgcggctcgatcgctccggcaaggtgcttctcgacgacgcggactcctacggcgtcgagctcggactccagctcgccgaggcgagcggtggcgaggtggtggtcgtgtcgatggtgcccgaccacgagaccgctggggtccgccaggcgctcgcgatgggcgcggccagcgcggtcgtcgtctctgacgatgcgctccgtggggcagatgccctcaccacggcgacggtgctcgcctcggtggctcgacgggtcggggccgacatggtgctcacagcgacggagtccacggacggctacacgggcaccgtggccgcccagatcgcgggtcttctgggatggcccgccgtgaccttcgccaagggcgtcacgctcgagggaacgcacgttcgggccaaccgtcaggccgaagacggcgtgtgggtcgtcgagtcggagcttccgtgcgtggtgagcgtgaccgcaggtgtcgtcgagccacgctacccctcgttcaagggcatcatgagcgcgaagtcgaagccggtcgagcagctttcgctcgccgatctcgggctcgaggcgcgcgcgacgcagcgcgtcgtcgcggtccaggaggcggcccagcgtgaagcgggaaccgtcatcgaggacgacggatccgccgaagcggctgtcgtcgcgttcctcgagtcgatcaaggtcttgtgaaggaggcgacgtggcaactgcttgggtgatcgcagagcagcgtgatggtgcgctggcgccggtgacggctgagctggtgaccgtcgcgcgcgacgtcgccgatgaggtgcgcgtggtggtcgcgggtgacggtgccggagcggcgtcgtcgctggctgcctacggcgtctcggagatcatcgatctcgggcccctcgacagcgtgctccctgggccggtgcttggggcaagcgttgcacggctggtgggggaggagccctcggtcgtcatcggcgcgcagacctacaccgggcgcgacgcactcgggcgtgcatcggccctgctcggcgctccggtcctgaccaacgccgtcgccgtgcggcgcgagggagaccaggtcctcacggagcaccagatcttcggcggcaccatggtggcgaccgccgcagcggagctgcgcggacacgtgctggtgggcgtgcgacccaagagcgtcgccgccgtggccgcggctgcgccgacggctccctccgtgcgggttgtcgagccggcactcgatgtgcctggggtcgtcgtcacggtggtcgatcgccagcgcgaggagcgcgaggggccgagtctcgacgaggcggccatcgtggtctccggcgggcgcgggcttggcaagcctgaggcctaccagatgatcgaggagctcgccgcactgctcggcggtgcaccgggtgcatcgcgggccatcgtggatgcgggatgggtgccctacgcctaccaggtcggccagaccggtacgacggtcaagccggacctctacatcgccgtcggcatctcgggggcgacgcagcacctcgtgggcatgaagggtgccaagcacatcgtggccatcaacaaggacaaggatgcgccgatcttccaggtcgccgatcttgggatcgtcgcggatgccagctcactgctgccgcgagtcatcgaggctgttcgcgcccgacaagccgcctcctgaccggtcatcgccggccaggtgcgaggcgcgccagtagccgcaccgggccgtgcctgtgctctgtgcgaccacgcacgatgaaagccgccaccaggaggtggcggctttcgcagcggacagtggaggactacgccttcttggtctcccagaagatgtcggcgatctcgttgatcttcgccagcagctggtcggcgatcgccacgtcgttggcacgcttggcctggctggtcagcttcttcgtcgaccagaagagctcgtggagctgcgggtacttctcgaggtgcgctggctggaagtactgataccagagcacatcgaggtgatggttgcactcctcggcgcgctgctccttgatgagcgtcgcgcgatcgcggaaataggggtcgtcggaggcgttgaacttctccatgatggccttgatcgattcggcttcaacgcgggcctgcgcgggatcgtacacaccacacggcaggtcacagtgtgccgagaccgggcgcggtgcgcggaggcgatcgagggcgttgaacatgcgtgcaagcagcatggccttcctttctcctgttggcgacggtgccaaggcacacgccgtagtgcagtccatggccgccgagcccatgatgggacgagaacgcgtgccacgctcagcttagcgagagccatgctcgtgtgtccgtcgaggcctcgggcgtgcacgatgttgggtcctcatcgagccgaggcgggcggggcgtgcgtgttgacgcgtcgtccgcccatcggcgacccaagggcatcgcacagggagtgaggccgagcaccgcgctcccaagctcctgctcgcgggtgggccagtcgggatcgcgggtcaagggaatgctgctctctgactgatgcaccacgacgaggctcatgctccggccgtggcaccgtcgcccggtcgaggtcgagcgcgatacgctgctcgccgagcagccgactgcgcgaccagcgacttcaatgcggagtactggcaatcaccgcacgctcgactgtcggtgaggagacctgcgcctgcggttggacgtactgggtcgtccgaggccagagtcgcgccagcggcggcgttcgatagctccttcaccacttgaagagaggtacacgagcgctagaggtggtgacctgtcgccgcgaggtcgacgaggatgccgacgatggcgccggccaggacgagggccacgaccacctcgacgatgcagccgagcgttcgaagaggatggaggaccacgtgggcaaccaggatcaccgccagcacgatcacgacgatctccacggcgcctcccttcggcagcgacgctagccgttcgacgtcggcaacgagccgagttctcgagcgcgagctgcggtgcgcgacagtgcttcggcgatggcgctccgtaccttcgcgtcctcgagtgcacggatgccctgggctgtcgtgcctccaggagaggtgaccgcgagacgcaacgaccgaggctccgtgccgcgcgcctccgcgagcgcgatcgtgccggcgacggtcttgagggcgaggtcgagcgcgagctgcgcggggatgccgagggcgatcgccgcctcctggagagcctcgacgacgagcaggacgaacgccggtccggagcccgacagcgccgtgcccgcatcgaggagggactcgtcgaggcgataggccgctccgagtctgctgaacagcgcgaccgcttcctccgcgagggcggcgtccgcctgtggcgacgtggcgacgagtgtcacgccgcggcgcaccgcgagcggtaggttgggcatcactctcacgacagctgcggcacgagggaggagctcgcgtaggcgagcggtcggcacgccggctgcgatggagatgaccctcgatccgggagcgaggctctcggcgacgcccgcgatggccccgggcttgacggcgaggatcgtggtcgttgcctccgccgaggcagatgcggcctcgatgcgcccgtcggagcttgtgagggcggcgatgcggtcgcggtcgacgtcggcgacgccgatgcgtgggggctcgccacgcatcgtggcctcggtgccgtcatcgaaggaggcgagcaagccctggacgatggacgaacccatcgctccagcgccaacgacgaggatatcgagcacggctggagcttaggcgcagctcgcgcaggcgtcgagaggtgtggccgacagatcggcgagcgaggtgaggaagtcgttcgcggtgtgggcccaggtgcgtccgcgcgcgcgtcgcgcgccacgctcgcccatgcgcctcgccacgaccgggtcacggagcacgagggccatgcgatcggcgaaggcgcgaggcgtacgttcgtcgaccaaggctccggtacgaccgtcatcgacgatctcggcaagtccgccggtccgcgtcgcgacgaccggcgtcgcgcacgcaagcgactcgagcgcgacgagcccgaacgtctcgctctcggaagggacgagcgtgaggttggcggcgcggtagtaggtgcccagctcgatctgggggcgtggtccgacgaggtgaagccggtcagacgcacccgcgtcctcggcgagcctacgaacctccgcgaactcgcggtctccgtcgtccccggatgggccgccaacgacgacgaggtggctccgcgggtcgtcgagttcgagccacgacgcgaccgcaagggctgtgcccttgagcgactggatgcgcccgacccacaagatgaccgatgcatcgggggggaccccgatggcacgcctcgcaggccctcgtgagagggtcggggagaagacggcaggatcgatccccggttccacgacgacgagctggccgcgaggcggaccatagagcgttcgcagccacgtcgcctcggcccggctcgaactcacgatgagatcggcgcagccgagcacgcgttgctcttgatagacgcgggcctcggtgaggtgactcggaggttggccgagacggagcttggcacgctcgagggtgtggaacgtgacggcaagcgggagcccgagctcgtgcttggcgctgtgggccacgacggctgagagccaatagttcgcgtgcaccgcgtcgatgctcgtactgcggtcgagcgcctcgagcacacgttcggcgaagtggtcgacacggcgggtgaggtcgcgctcgcggtcatcgtcgctgagtgcatgcagccagagccctggttcgatgcgatgccgaccgggcacgtcgtgtgcgccggtgaagatgtccacctcgtggccggagcgagcgagctgggtcgcgaggttgcgaacgtacacgctcatgccgccgttcgctcccgctcccggtgtggcaaacggggaggcgtgataggcgatcatggcgatgtgcaccagatggctccctcctgcggccagcgtaccgagccaacccgccgatgcggcgtcctattcctcctcgctgcctggcggcggcggaagctcgaccccttcgatgctgccaactgcgatcggttcgccgtcggcgacgattcggtcgatgagtgcggcgctcaccgcatcgagggcgctgtggaggcgccggcgaagctcggagagggtctgctctgcctggcgctgacgagcttcccaggcagggcgctcggtggcactcacttcggtcgcgacgcgtgggccggcgaggtcgttgatggcctcctcggcgagcgcgatgtcctcttctgacagcgagagctcgacgtgacgacgggcgagtggcggcgagggcaggttggagagcgcgagctgacgggcgaactcctctccgcgggctgggccgagcgcaagcgcatcgagtcgcgtctgaagctcgcgtcgcgcgaacgagacgacgttctcgagacgcaaaccacgaccacggagcgcgacgagggacgctcgatcgcgtccgtcaaggtgtgcggacgcctcgatgacctcctcgaccgcgcgttcaagctcggtcactgccaccccccttcgatgggcagcgtcagcctagctcgggcccgccggcgcggcgcgggttgtgcggggaggtgcatgtggctcgctcgcgaactcgaccacgagaccggaagagcccgtcgcctcgatcgtggtctcgcccctgcgacgctccaccgtcacggtcgtcgtgtggtcgccgatctgaagattggtgagcgtgatcctgtccagccaggcgggcagcgctgggcgaacggtgagggtgcctgccgccgcgttcggtgcgagcccgagcagcgcagcaacgatcagcgcgaaagctccggcggcccatgcctggggggcgttggcgagtcgatagggacgagggtaggcgccagcgtcgcggtcgacgccggtgaacagctcggggaggcgaccgcccgcaaagagggtgccggcatcgagcagtgccgtcgcgagcgcgtgggcatggtcggcgagcccgtaggccgcgagtcctgcgatggcgatggcgttgtcgtggggccacaccgagccgcgctggtagctcagggggttgtaggcaggatggtttgaggagagcgtcctcagcccccagcccgagaagaggtcgggtgcgaggaggcgatccgccacggcgcgagcccgctccgggctcggcacctgcgcccagaggaggtgcgaggggttcgacgccaccgagtcgatgggtcgcttggcgccgtcgagtccgagatagtaggtcgactcctcgggccaccagaagcgttcctcgatggcctcgaccagtcgactcgcctcctcgcgcaacgtcgcggcgcgctcgaggtcgccgaatgcctcctcgagtacgttggcccaggctcgcttggcggcaacgacgtaaccctgcagctcgaccagggcgatcggtccatcgacgacgctgccgtccccctggaggatgccgtcttcggcgtctcgccatccctggtgccgatacccagtcgccgagcggggcgcatactcctgcaggccatcgccatcgcgatcgccatagcggtcgatccacgcgatcgcagcctcgacgctcgggccgagccgcgcgaggagcgctcgatcgcccgtccagcgccagagctcgccggccgcgatgacgaacagcgaggtggcgtcgtgcgtcccgtagtacggagtgtgcgggatgagctggagttcggcgagttcgccttggcgcagctcgtgcgggatcttgcctggttcggcgtcgcgtgtcgggtcgtccgtggtcgcctgaacgctggcgagggcaaagagcgctgcctggaggaactgcgtcccgagcatgacggtctcgagtcccgtccagatcgagtcgcgtccgaacagcgcgacgaaccatggcaccccggccgcagggatccagggcaagatgtccgggtgcgcgccgaggccagcgccctcggcactcatgcggagcgcgagcaggtcgtcgaccgagcggcgcatgatccgctcgagcctggtgttggaggtcgtgacggtggtgaggagccgacggtcctggtggagcttctcgagcggcgcgaccagctgctcgcacgcgtaggtcgggctcctcagcgtcgtgaggcgcgcgtgcaggcgcaggcagatggacgtctcggctcgcggctcgagggcgatgcgtacgatcagccgaccgttcgcgtactcgggctgtgcgggagcctcggcgacctcgacgacgagcgcacgtgcgaacgcgccgttgcgataggtcgtctcgaggcggcgggtcccaggatcccacgtggtctggacggagccacggcgcgcacgccgaccgctgcgcacgtcgaagatgtccgcgaagtcgctctcgatgccgagctcgaggtcgacgctgatcggcgagagcgaaaagttctcgatgagcaggtcgtcgtggatgcccggaccgatgacacggtcgaggcgaatgcggagatctccttcgtcgagccggtggttcaccagggtgagggttgggttcgtgaactcgaggcgagctgcgcgaggtccgagcgctgcgccctcgacgaggatgagcggtgcggtgccgagcgtcagactccaaccggagagcaggcgggtgtccttgacgaagtagccgcgctcgcgttcacgatcgatggatccattgcgtgcggtgaccaggatctcgtcgtcgtcggcgagcgtgatggtttccgagccgagccagtcgacggtgggaaggagctctctcacgcgccggctcccgtgacgcgcacaggtgcgatcgggcgctcggcgatgatcgatcgatagagccggaggtgggcctgcaccattgcctcggccgagaagtgttcggcgacccagcgtcgaacggccctgcgatccaaggtggcggcgcgctggagccggtccgcaaggtcctcgacgcccgtcgccagaaagccggcgacgccgtccgcgacgacttccggagccgacccgatggccgttgcgacgaccggcgttcccgcagccatcgcctcgatcatgaccatgccgaacggctcgggccaggcgatcggattgaccagcgcgatcgctccgcccagcaacgccagcttgtcgctgccgccgacctcgccgacgtattcgacgtcagcaccgaggagcggtcgaacggcggtctcgaagtaggcatgctcatcgggttcgcgcatcttggctgcgatgcgcagggggatcccggcacgtcgtgcgatctcgactgctgcgacgacgcccttgtcgggactcatgcgaccgaggaacagggcgtagccaccgtcaccgcgtcccatcggtaccgcatcgatctcgatgccgtggtggatgacggcggcgatccgcacgccgagggcgagttgggcctgtgcatgggaaatggcgatgacggggacggtggcgctcacgtgccggtagtaggtcgccatggcaccgaggaacggtgcgtggttggtggtgacgatgggagcgctcgcaaggcgcggcccgacgaggggaccgacgagcgtgtggtcgtggatgatgtcgacctcgcccagctgggagtaggcctcgaggacgtggaccgactcgttgatcggcgttgcctggtcggtcccgagcgcccatggcgtggcgcgtaccgtcggcacggggcaggtggcatccccggtcgtcgcaagcacgacgtcgtgtcccgctgcgtggaggccgcgcgcgagcacgtcgagcaccgcctcggtgccgccgtagcgcggtggtgggaccggcacccaacatggggcgacgatcgcgatgcgaaggcgtctcgggacgtcgtcaggtgccggccgagcggcgagggcgctcgcgtcgtcgggcgacacggtcacgcggtgcccggcgtgactctcaggagtgatccccacgggactcgcgttcctcctcggttcatgctgcacgcacgtggaccgacggacgactacgtcggcacagcgctgtgaccgactctgtggtgtccagcctactggcgcgcggaagctgacacgagcgacggcgtgctggtcgagcggccgagggcggtgcggacgcggctgccgaggtcgccggcgcgccgcaggctcgtctcgaccgagggtgggagcagattggccatgaccgagacgaccggggccatagtggcccggttgcgcatcgcgagccagacgcccggtgccatgacgcgagggtcgctgatgaggcggacgaaccgtcggccgagggcgtagtaggtgccgtagtggccaccgagcagcgccgggtagcgcgtgagtggatggtcactgtcggtgcggcgagcctcggcgatgagggttgcggcgaggcgcccggtctcgagagcgtaggagatgccttcgccgttgaaggggttgatcgtcgcggcagtatcaccgacgaggaggtagttcgacccctggactggcttgatcgtggtgcccatcgggagcttgccgccgacgggcttggcaaggagcgggtgctcgacgtcgagcccccaacgatcgcgcacgcgatcgacgaagcgtgcgagctccgtcgtggtgttgacgtggcgccacgcaccttggttggtgagcagtccgaagccgatgttgacgctgccatctcccatggggaacacccacccatagccgggcatcacgcgaccgctctcgtcgcgcacgtcgagcgctgactcgatccacggttcgtcggatcgcgacgaggggagataggtgcggatcgcgagcccgaggggctggctggtgtcgcggatcgcgccgagcgaccgagcgaggcgcgcattggacccttcggcgagcaccacccagcgcgcacgcacgcggacgacggcgccatcgttcgtccgacgtgcgaggaccgcgctgatgccgttgccacgtcgttcgagttcgatgccctcgtggccgaagagcacggtcgcgccccgatcggccgcggcgccgacgacaagcgcatcgagctcgcgccgacgcgcgacgaagccgtaggacggcaggagcgggtggttcggccacgggatgtcgagcgttcggccgaacgcgacggctcggagcccctcgtatcgatggaagcgggcttcgagctccgctccgaggcccagcgcttcgagctgcacgaccgagcgaggggtcaggccgtcgccacagaccttgtcgcgggggaactgcttgcgctcgaggacgacgacgtcgatgccgcgcatcgcgagccaatgggcacagctcgcaccggaaggtccgccgccgacgacgacgacggtggtggagacctcttcgtcaactgcctggaccacgatctcaccctagtggcggcccaacgggttctccggggtgacgccgatcaccctgacgctcccccacgtgcgcatgggtcggggccgtatactgcccacgaagaggccggatttgcagcatgcgtcctccgtgtccatcatggaggcgcagctgcgtgagcgatatcgagttggagcgaggtgcgatggcccagtacctgccgatcgggatcttgctgatcatcggcgtgctctttggagcaggatcgtttctcgcctccgggttgcttggaccacggcgtccgcaccgagccaaggcagcgccgtacgagtgcgggatcgtgccccgtgtcgaccctcccgaacgcttcccggtgcggttctacctggttgcgatgatcttcatcatcttcgacatcgagatcgtcttcctctatccgtatgcggcagcagcgggctcgctcggcaccttcggcgtgatcgaggttgccggcttcgcggtcgtggtgttcgtcgcctttgcctacctggtctccaacggcgcgctcgactgggtgcctcggcgtcgggtgcgggcccatccgccagaagtccagcgatcgctggaggcaccggctcgcgcggggagtcggtgagatggcgctcgacgacctgagctacaacttcctgacggcgcgcctcgaggacctcgtcaactgggctcgcaagtcgagcgtgtggccggccaccttcgggcttgcctgctgcgctatcgagatgatggcggcaggggctgccgacttcgacctggctcgattcggaatggaggtctttcgtgcctcgccgcgccaggcagacctcatgatcgtcgcggggagggtgtcgcagaagatggccccagtgctccgccaggtctatgaccagatgcccgagccgaaatgggtgatctccatgggcgtgtgtgcctcctcgggtgggatgttcaacaactacgcgatcgtccagggcgtcgatgagatcgtccccgtggatgtctacgcgccgggttgtccgcctggccccgagacgctgatccgtgcgatcttgaccctgcacgagaagatccgccacacccccatcctgcggcggcgtggccaggacgagcccgtcgcggagttgctcgcccggccccgtttcggcacgggggaggcgttcgcgtgagcggcgtcgtccggcacgtcgcacgtgaggactggctcgagacggcggaaggcttgcgtgcggacgggttcgtgatgctcgccgatctgacgtgcgtcgactatctcgagggggttcgagaggacctccccgaggaggtcgtgcgggagcgtttcgaagtcgtcgccgtgctgcggcggatggacccacctgccatggtgcgccttcgggcacaggttcccgacgacgatcccgtgatcgactcgctgtggtcggtctatcccggggtcgaggcgttcgagcgcgaggtcttcgacttgttcgggatccactttcgcgggcatcccgacctgagtcggatcctgatgcccgaggactgggaaggtcatcccctgcgcaaggactatggcgtcggccgcgtggcggtgcagttcaaggaggtgcgtcgacaccgatgacgtcgtccatctacaccgtggtgcggcccgacgaggaggcagaggccctcggcttggtcgcggagacgtacgaaggctcccaggagctgacccttcgcggtgccacgtcggccgcggagctcgagcgagagcagggcgcggtgctccgggttcccgagagcgaggtcgatctcgaggggtttcgaagccgacgaccggatgatcatcaacatgggcccccagcacccgtcgacccatggggtgctgcgcatcatgctcgagatcgagggcgagacggtgctgcgttcgaagcctgtcatcggctatctccacaccgggatggagaagacggcagagacgctgacctacctccagggcacgaccaacgtgacccgtatggactatctgtcaccgctcaacaacgagctggtgtactgcctcgcggtggaggacctgctcggtctcgagctgccggagcgggcgatctggatccgcatgctaatgtccgagctcaatcgcatcgcctcgcacgtcatgtggatggcgaccaacggcatggacctcgggtcgacgtcgatgatgatcttcgggttccgtgaccgcgagatggtgctcgccttcttcgagaaggtgaccggcctgcggatgaacaacaactacatgcgacccggtggggtcgcggccgaccttcccgacgggtgggaagacgacgtctcggcgatcgttgacaccatcgagcggcgcgtggaggagtaccacgagctgttgaccggtcagccgatctttcgcaagcgcgtggtcggggtcgggatcatcaagcccgaggaggcgatcgcgctctcggctaccggtccgatcctgcgctcgactggagtcgcgtgggatctgcgtcggtcgatgccgtatctcgcctacgaccaggtggacttcgacgtggtcgtcggcacggtgggcgacacctgggatcgctacatggtgcgcatcaacgagatcttgcagtcgatccggatcgtgcgccaagtcgtcgagcgcatgccatcgggaccgtatcgagcgcaagatccgaaggtcacgccgccgccgcgtgcgcgtatcgatgagtcgatggaggcgttgatccaccacttcaagctctacacggagggcattcgggtccccgcaggcgagacgtacgcggcgatcgagtctcctcgtggagagatcggttgctatctcgtctcggacgggtcggcgcgtccctatcggatgcacatccgagggccgtcgttcgcgaacctccagagtcttccggtcatgctgcgtggcgcactgatcgccgacgcgatcgcgatcacgagttctgtcgacccggtcatgggggaggtagaccgctaagtgggacggttcgagggcgagttcgcggcacgtgccgaggaactcgtcgggttgtatcctgagcgtcgctccgcggtgctgccgctgtgtcatctggcgcaagagcaggacggttggttgacgcccgaggcgattcgtcacatcgccgagctggtcgggcagaccccggccgaagtgcaaggtgcggcgtcgttctacgacatgttgcacctcgagccggtcggtcgttacgtggtcgggatctgcaccaacatcgcgtgtctgctgcgcgatggggaccgcctgctcgaggccgccgaggagctgctcggcgtgggcgtgggcggcacaacacccgacgggctgatcacgctcgaagaggtcgagtgcgtcgcgcactgcgacaaggcgccggccgtgcaggtgaactaccgctacttcggtccggtgacgccgacgagcttcgaggagctcgtcgggcagctgcgccgtggtgaactcgatggggaggtgcccccgcacggggtcctctcgcgagtgcgccgtgcggccccgccgccgatcccactggatgagatcgacgccgagcgggcccgccaagacgcggagcgcgccgaacgcgctcggcaggcggagagcggatcatgagcgcgccgtcgatcgtgggcgcgaggctcggctacgaggactcgtacaccctcgagcgctttctggcaaccgacggcgacgccgggttgcgcagggcgctgctcgagctgactccggagcaggtgcacgccgaggtcctcgaggccaacctgctcggccgagggggcgctggattcgaagcgggccgcaagtggtccatgctgcgaaaggccccgcgtcgctacctcgtggtcaacggtgatgaatccgagccggcaaccttcaaggatcacctgctggtcgagcgtgatccacaccagctcgtcgagggggcgaccatcgccgcctatgccatcggggcctcggtcgccttcatctatctccgaggggagttcgcactcggtctcgagcgggttcagcaggccatcaacgatgcctacgcacgcggagcgctcgggcgcaacatcttcgggtcggggttctcgctcgacattgtgctccagcctggtgcgggcgcctacatctgcggcgaggagacggcgctcctcgagtcgctcgagggcaagcgaggattcccgcgcatcaagccgccgtacttcccggcggtgatcgggctctacggagcgccgaccatcgtgaacaacgtcgagacggtgtcgaacctcccgtggatcgtgcggcacggaggagccgccttccgcgccctcggtgcgggccgctcgacggggaccaggatctttgcgttgtcgggaagcgtgcgccgtccgggtgccttcgaggtcgagatgacgagcgtcacgtttcgagaactcatctacggtgacgcctacggacagggtctcgagccggatcgcgagcttcgagccttcatccctggtggggtgtcgtcgccatggctcttccccgaacacctggacctgccgctcggtcaggacgaggtggccaaggccggctcgatgctcgggtcggggtcgatcatcgtcatggacgacggcgattgcccggtgagggcggcgtggcgaatcgcacgcttcttcgcacgcgagtcctgcggtcagtgcactccctgtcgcgagggtggcacctggatcgagcaggtgctgcgtcgcctcgagctgggctacggacgcgaggaagatctcgacctgctgctggatgcgtgcgacaacatctcccctggcgttacctggccgccggcccagacgaccatctgcgtgctcggcccctccatccctccgtccgtggtcgcggcgatccgtcggttccgcgacgtcttcttgacgcatatcaaggaggagcgctgcccctatgactgagcaggccagcaccgtcaccataaccctcgacgggaagtccgtcaccgttccagctggcgtcaagctcatcgaggcactcgaggccgtcggtacctacgtgccgcggttctgctaccaccctcggatgcgtcccgtgggcgtgtgccggatgtgtctcgtcgaggtgtcgggccctcgcgggttctcgctgcaacccagctgcttcatcgacgtcgccgaccagatggaggtgcgcaccacgagcgagccggtgcgcaaggcccagcatggcgtcctcgagtttctgctcctcaaccatccactggactgcccggtctgcgacaaaggtggcgagtgccccctccaggaccaggcctttgcgcatggttcgggtgagactcgtttcatcgaggagaagcgccactatcccaaaccgataccggtgtcgccgctcatcctcctcgaccgtgaacgatgcatccagtgcgatcgctgcacccgctttgccgacgaggtggccggtgacgcgaggttggatttcgccggacggggcaacggattgcgcgtcgcgacgttcgagggcgagggcttcgagtcggtgtttgccggcaacgtcgtgcagatctgtccggtcggggcgctcacggccacgccatatcggttcaaggctcgtccgtgggacctcgccgaggcagcctcgacgtgcacgtcctgctcgatggggtgccaggtcgtgctgcagtcgtcacagaacgagttgacccgggtcctcggggtggacgcggaggcgatcaaccagggttggctctgtgatcgtggtcgcttccaggttgcggcggtgaacaatcgcgaggagcgtctgcttgctccgcgcatcggggccgatcgcgcgagttgggctgcagcgctcgatgcggtcgcaagcgcgatccaagaggccgtcagccggcagggcccggccgccgtcggcgtgatcggtggcgatcgactcagcctcgaaggccagttcgcctgggctcgcctggcccgcagttcgatcgccacgccgcgtgtggacggggtcgccggttcgttggtcgaccccaatctgtggctggatcgcctggccaccgtggacgcgatcgacgacgccgaggtcgtggtgaccattggtgtcgatcttcgcgaagagcttccggttgcctggctccgccttcgacagcgggcgctcgccggtggtgcggtcgtcgacgtggcccctggaccgacgagtcagggcgagatcgccacggcgcggatcgtcctggatcctcgtgatcccgaggcggccatccgggaggttgcacaggtcgtcggcgatcgccgtgcgctggtcatcgtcgggcagtccaatccgctgctcgactcgcggacgcgcgtggggctgtatgccgcactcctaggccggctccccgcgtcgacggtgctgccggtccatcggtccggcaacgcggccggggcactcgtggcggggctgtcgcctggctggtggcctggtctcgtggccgggccggtcgctgggtgggctgagagcgcgggccacgacgtcaccgatatcctccaggcggcgcgtgtcggcgctctgggcgtgctcatcgtgctcgaccgagacctcggcgaactcggcctctcggacgcagagatcgagacgctcgctcgcagcgtgaccctcgtcgtggcctcgagcttcgagacggcgacgacgaggcgcgctgcggtcgccctcccgatcgccgcctggggcgaggagcgaggcgtgaccatctcggccgagctgcgccttggtcgcctcgcggctcaagtggagccgatggaacaggcgtggcccgcctggtcggtggcggaggagctgcgcgcacggctcgaggtgggtccggtcgccgttgccgtcggtgaggtgttgtcggcgctgtgccatgtcggtggcgtggtgacgactcacgacgtgcatctgctcggccagcgcgccgacggtccgctgttgccgtcggcagagcgtggcgacggatcgccgccgcggctgctcgaccccatggggacgcccggcatcgcctcggtgcgtcgtcaggccccagacgtccggttgggcaacgccctcgacccggcgctcccggcaccctcagccggggtgcggcgcgcgtcgctcgccaccgctgccgccctttcgaacgacctggttggcgcgacaggctcggggttcgtgccttggatcgcgagtgcgctctatggggacacccccgacgtcgtcgcaaacccgttcctcgctccgctccggcgccaggcgcgcgcgcggctggcgccatcggatgcgtcgcgtctcgggctcgagctcgacggtgcgacggtgcagatcggcggccgcgtgagcctaccggtcgcactcgacgacgacgtcgccgaaggggtggtcgtgatcgagggcatgccgagcggttggggtgagctcgctggccccggttggagtctcgtagaggtggaggcgctgcatgggagctgacccgctcctcgtcggccacatcgggtggatcgacgtcctcatcgtcgtcatcaaggtcgtcgtggccttcgcggccatgatggtgtcggtcttgctcgcgatctgggtcgagcgcaaggtgatctccgacatgcagaaccggataggtccgaatcgtgcgggaccgttcggcctgctgcagagtctcgccgatggcatcaagctcttcttcaaggaggatctgatccccgagcggtcggatcgtttcatcttcaagcttgcgccgtacctgtcgttggtgccggccttcttgacgttcacgatcgtgccgatcggtggcgtggtcgatctgttcggtcaccggaccgaactccaggtcgccgatccgccgatcgggatcttgctccttctcgcgatgtcgtcgatctcggtctacggcgtgatgctcgcgggttggtcgtccggctcgaagtatcccctgatcggttcggtgcgtgcctcggcgcagatgatctcgtacgaggcggcgatggggctctccatcgccgcggtggtcctcgtgacgggctcgctctccacgcgcgacatggtgacgggccagctcggcacctacctcggcttcatcccgcactggaatctgatacggctcggggtgatcccgttcgtcatcttcatcgtggcgatcactgcggaggtgaaccggccaccgttcgacctcgtcgaggccgaacaggagctcgtgggtggattccacaccgagtactcctccatccgcttcgcgctcttctacttggccgagtacttgaacaccatcaccatgagtgccatcatggtgaccctgttcttcggaggcccagacggccccgatccgcacgtgttgcactggctctggccgatcgtgtggttcctcgtcaaaacgtcgatcttcttcgtgatctacgtgtggttccgtgccgcgctcccgcgcctccgctacgaccagctgatggatcttgggtggaaggtcctgatccccgtctcactgctgtggctgctcgtcgtggcgggtatgcgggcctcgcgggtgctcggtttcgtgctgctcgtgctcgggctgatcgctgcgggagtcttgctccgcgcgatcgatgtcggccgacgccgccgtggccagagcgcgcccgtgcttcccgatctcatggacgcatcgatgctggggccgagcccgatcccggccatggtcgaggaagggtcgaccacagcggaggaaggggatgacgatgggcgtgcttgacgcactcgggggcttccgcctcaccctccgacaagtgttcgagccgcgggtcaccttgcagtacccagaggagaagcgcccgaagccgccgcggttccacggacggcacgtgttgaaccggtatccggacgggatggagaagtgcatcgggtgcgagctctgtgcgggcgcctgcccggcgcgctgcatctacgtgcgcggcgccaacaacgacccggagaggccgacctcgccaggggagcgcttcggcttcgtctacgagatcaactacctgcgctgcatccactgcgacctgtgcgtcgaggcctgtccgaccgaggcgatcacagagtcgaagatgttcgagttcgccttcaccaaccgtgaggacgcgatctacaccaaggcggagctcgtcgtcgacgacgagggtcatccaaggcgccagccatgggaggactggcgcgacgaggatgaacgctggacttcggcctgggttcgggcgacggctccgggaggcgatccggccttcgagggcgtcgtcggttggtcgccagaactcggtgtcgggacgcgaccgccggagcgtggccagtccgaccttccggaagacgaggcgacgcccgtgttctcgttgcgagcgattctggcgtcgcggatcttccgtcaacacggggggagggcttggtgatcctcggtgtcgtcggggtggtgaacctcgttgtgttcgtggtcgcggtggccgtggtggccatcggtggcgttgggctggtgagcgcacgccagcccgtgcacgcggccttgttcctcgtgttgacgctcttcggcgttgcaatcctgttcattcaggagggagcgcagttcctcgcggccgtgcaggtggtcgtctatgccggcgcggtcgtcgtgctgtttctcttcgtcatcatgctgctcggtgtcgaccgtgtcgaggtgagcagcatcgtcggcagcggttggcgggtctgggcagccggcatcggcgtcgcagccgtcctcgtcgagctgggtctgctcgccatcggccatgaggtcaccggcgcctccagcctggcgggcaagctctcggcgggatcgaacctcggtgtcctcgctcggagtgtctttacgacctacgtgctgccctttgaactcacgagcgtgctgctcgtgatcgcggtgatcggcgccgtggtgctggcgcgaaggctccgccagcgatcggacgcgacgacggtgagccgaagcgaggaggtgcacccgtgattccggtgagctggtacctcatcgtcggggcgctcctgttcgggctcggggccttcggcgtcttgattcgacgcaacgtcctcgtgatgttcatgtcgatcgagctcatgttgaacgccgtcaacctcacgttcgtgtcgtatgccagggcactcaacgacgtcggcggcgaagtcgcggtgttcttcgtcctggtcgtcgccgcagccgaggtggtcgtcggcctcggcatcatcgtggcattgttccggcgacgtgcctcggtcaccatcgacgacatcgcgcggttgaagggttaggtcggcatggatctcatcaccgctgtcatcgggtttccgctccttggcttcctcgtgctccttgcgttcggcaagcgcatcggcgagccgcgcgctggttgggtcggtaccatcgcgaccacgctgtcgttcgtcgccgcgctcgcgctctggggcgtcgtgctggcacgaccggccgacgagcgggtcgcggtcgtccgcctgttcacgtggtttcgcgctggccccttggtggcgcacatctccttccgcgtcgatgaactcaccgtgttcatggtgctcttcgtgaccggtgtctcgtcactgatccacctctactcgatcggctacatgcatcgagaccccaggttccaccagttcttcgtctatctgaacctgttcgtcttctccatgaccgtgctggtgagctcgaacaacttgccactgaccttcctcgggtgggagggcgtcggcgcgtgctcctactggttgatcagcttctggttcgagcgcccctcggctgcgagcgccggcaagaaggcgttcatcgtcaatcggatcggcgatgcaggcttcatcctcggcacggcgctcatcgtggaccatctgcactcggtgagctactcggtgatcctgcccgaagcccatcggctctcgagcggcacgctcgaggcggtcgcgctgctgttcttcctggcagcggtcggcaagtctgcccagctgccgctgttcgtgtggctactggacgccatggagggcccgacaccggtgtcggcactgatccatgcggcgaccatggtgaccgcaggtgtcttcttgatggcgcgtctgtcggcgttcgtgactcccgcccatgacgccgccacggtcatcgcgtggatcggcgcgatcacggccttcgtcgcggcgatggccgcgacctcgcagcacgacatcaagaagatcgtcgcgtactcgaccgtctcgcagctcggctacatgatgctcggcatcgggaccggtgcctacgtcgcggcgctgtttctgatggtgacgcacgcgttctacaaggcgttgatcttccttgcctccggttcggtcatccactcgctcgatggcgagcaggacgtgcgtcgtatgggtgcgctccgtcgcttcatgccgatcacggccgtcaccatgatcctcgcgtggctctcgatcgcgggggtacctccgttctccggcttcttctcgaaggggtcggtcctcgaggcagcctttgcccaccagccggtgctgtgggcgatcggtgtcgtgaccgccgtgctcaccgcgtactacatgggtcgactcgtctacgtcgtgttctacaacgagccgcgctaccaggaggtcctcggcgagcggagcccacacgagtcgccccgagtcatgacggtgccactggtggtcctggcggtggccgcagtgctcggagggctcatcaacctgcccttcgggagcttggacttcctcgatcgattcctggcgccggtcttcggcccttcgctcgttgccgtgcatctgtcgggcgtcgctcgggcggcgctgcttgcgaccgatgcggtcgccggcctcctcggcgtcgggttggcgtggcagctctggggccatcggtggcgtcggcccgagctcgagccgatggtgctccagcgcggttggtacgtggatgcaacctacgaccgcgtcatcgcgcgtccgatgaccgagctcgcgctcgaggcggacgaggtcgtcgatccgaaggtgatcgatggcgcggtgatgagcgtcgcgtgggcagctcggcgaatcggtggcctgggccgacgggtacagaccgggctcgtgcgcagctacctgttgctgatggtggccgggatcgtcgtggtgatgggctacgtgctcgcagtggcgacacgttagagaggcggaagaggcatgacgctgctcgactggttggtcgctgtccccgtgatcggggcgctgatcgtaccgatgatggcgttgccgcgggagcaggcctggttggtccgtgccttcgggatcgccatgtcgatcgtggagctcggcatcgccgtcctgctcgcggtgcggttccacatcggtgctccaggcttccaagacacccaggacctgcgctggatgggtgcgctcggcgtgcactggtatctcggcgctgacggcatctcgttggtgctcgtcatcatgacggcggtgctcttcgtcatcgcgatggcggcgatcaagggcgtcaccgacgttcgggcctacgtcgggtggatgctcctgctcgaggcggcgtgcatgggctcgttcgtctcgctcgacctcctgctcttcttcgtgttcttcgaactgtcgttggtaccggcctacttcctcatcgcggacttcggcttcctcgggtcggggcgtgcggccatcaagttcttcgtctacacgttcgcggggagcgcgctgctgctcgtcgggatcattgcgctcgtcgtcatccatgaccaccagacggggaacctgacgttcgcgttgcccgccctcgagcacacgcggctggctgcgagcacgtcgctgctcctcttcttggccttcacggcagcctttgccgtgaagaccccgatctttccgttccatacctggtcaccggacacctacgcgaaggctccgatccctgccgtggtgatcgtcgctggcgtcatggccaagctcggcagctacggcatcgtgcgtttcgacctcgggttgttccccggcacgtcgagacagctcgcgtggctcatgctcaccctggcggtcgcgggcatcctctggggcgcgatcgtggcggcgggcgagcgacacctgggtcggctggtggggtactcgtcgctctcgcacatggggttcatcgtcctcgggatctttgcgttctcgaccgagggtctcgcaggttcggtcctgcagatggtcaaccacgggatctacaccgcggcgatgttcctcctactcggcatgatctacgaccgctccggcacgctcgatgcctcgcggctcggcggactccagcggcacgcgccggtgctcgcgggagccttcaccgtggtggtcatggcgcaagccggcttgcctggcctgaacggcttcgtcggcgagttcctcatcttggtcggtacgttcgtgacccatcgctggtgggcggtggtggcggtggccggcgtcgtcggttcggcggcctatctcctctgggcctaccagcgggtcttccaccgcgcaccgtccgaggaccgggtcgtacacgacctgcagtggcgcgaggtcgccctcatcgcgccgctcctggcgatcatcgtgttcctcggggtctacccgaggccggtgctgtcggccattgacccagcgacctcggcgatcgtggcacgcgcgaatcgggcgccactgccggtggcatcctccacgccgaccgctgtggtttcgacgctcaccccgggggtgcggccatgaacgtcctgttggcgagcatcgtgtcccagacgccgatcgtgctgcctcgcatcagctacctcaccatcggtccagcgctcgtgctctttggcggagctctcgtggtcctgctggtgtcggcgctcctggtgcgcgcacggcggcccgagctctatcgttggctggcgctcgtcgcggtcgcgggcgagatcgtggtggccacggcaggcctgctccacgtcgacgcacacggcgcctccctcgcggtggcgggtgcgttggcctccgatggcttcgggttcgtcgtcgccatcatcgtcggtgcagcgaccctggtcgcgctgctcatcgggccgagtttcgtgcagcgcgagcacggcggcccggagtacgctgcactcagcctgatcgcggcgagcggtgccgtggtgatgggacaggcgaacgatctgctcgtcgtcttcctcgggctcgagatcctctcgatctcgctgtacgttctcgtcggcttccgtgtgggtgacggggtggcgcgcgaggcggcgctcaagtacttcctcatgggcggctttgcctccgcggtgctgctctacggcatcgccttgatctatggtgcgacgggatcgacgaatctcgtccgcatcgaagggttcttggccgccgaccacctgatccacaacggcgtgctgctggggggcatcgcactcgtgctcgtcgggctgggcttcaaggtggccgctgcgccgttccacgcctggagccctgacgtctatcaaggggcgccgacctcggtgaccgggttcatggcagcactggccaagatcggcgcgttcgccgcgttggtgcgcgtgttcgatggcgcgctggcctcccaggcctcgctctggggcccactcgtggcggcgttggcagtggcctcactggcggtcggcgccttcttcgccctgcgccagcgcgacgtcaagcggatgttggcgtactcgtcgatcaaccatgccggcttcatcctcctcggtgtctatgccgcgagcgcggtggggattcgcgcggcgctcctctacgtgggcacctatggcatcctcgtcgtcgggagcttcggcgcgctctcgttggcgcagtgggttcgaggcctcgacgaggggctgtgctcgctcgatgatctccgtggccttgcgcgtgagcatcctgcgatcgcggtgacgctcgccatcacgctcgtggcgcaagccggagcgcccttcacgaccggcttcttggcgaagttcgccgtcgtggaggcggtgatcgctgccggggagacctggatcgcgatcgtcgccatgttgagtgccgcggtcgctgcagcgttctacctgcgtgtcgtcctcgccctctacggcagggacagggagtcgagcgtcgtaccggcgatcgccggggcgcaggtcgaggacgggcgatctgccgtgacgcagcgcccgagcccgagcgagcgcgtcgccgtggcgacggcctggggcggtgtggtgctctcggtgggcgccaccatcgtgcttggcgtggtgccgaccctcgtcctcagcctcgtcgggagagcacacatcctgtgagactcagtcggtgaggttcagtcgggttggggccagcgtcggtcctccatcacgctgttcgcaccatcgacgacgatgaccgaacccgagacgtagctcgctgctggtaggcagaggaaggcgacgacgtcggcaacctctgtcggaaggccggatcgcccgagcgggctggcgagaccggcagctcgttcgtcgggcgtctgtgaccccgtggcgatccagcctggcgcgacgacgttgatggtggctggggcgaggtcgagcgcgagtgagcgcgcgagaccgacgaggccggccttggcggcagcgtacagggcgctgtgcacggtggcgttgacgtggccagtcgtagagccgacgaggaccacccgtccgcgcgcgccgtgggtgagcagtgtcggtgcgaaggctcggacggtgagcacggcgctgaggaggttgcgatcgagttcgtgcgtgatggtgtcctctggcaggctccacagggcgccttggcgctccgggtccccgacggcggtcatgccggcgttggcgacgacgatcgcgggaggaccgaggcgcgcggtgatggagtgggcagcctctgcgacctcggccgcgacggtgaggtcggcggtggatgcgaccgcgtcgatccctcgttcgatgagttcgtcgcgtcgagtgaagatcctcggtgagcgactgatcaggccgaggcgagcaccgagctcgccgagcgtggtggcgatcgcaaacccgatgcccgttggagacccggccccggtcacgaccgcgaccgatccgtcgagtcgccagcgctcatgcatgggggtccgccaggaagcgtccgacgagcggcaggtcccagagtgactcggcgcgtgctgcggcgatcgcgatcgcggcgaggtgctcgtaggcgtcgacgacgaggtagcggggttcccagcggggctcgaacttcgcgttgaagcgccagagcgactcgatctgcatgctcgacgagagccgatcgagcacccagcgctcgactcgggcgctcaggagttcgccgccgcgttcaccggcgagcacgccccgcattgcagcgaagttgaggctgatcgccttgacgtggcgggcttggagctgcgtcatggtctcgacgatgagcaggtcgaacatgccgttcggatggttgccgaggtcgcgacgcatcaggtcgagcgagtagccctcgatgctcggcgcggggacccactgcacgaacccgacgatccggccgtcgggtcctgtgcacacgctcatgaggacgtcggtgtcgcgggggtcgaagacgcgccccagcgtcatcgagaacccgcgttctcggccgccgcggcgtgactcgctcatgacgcgaagcacgtcgcgccgctcctcttcggtgagctcgagcggagcgacgacccgcacgcggtagccgtaacggcgcatccgattgactgcctggcgcagactcttgtggcgcttgccggcaaggtcgagttgaccgagcgtgacgatcgcctcgtcaccgaggtagaggggatgcaagccgacctcgcggtaccactcgctccaggtctcgctcgccccgaggacgcacagtgccttcccggcgcgagacgtggcctcgaagagctcgaggaaggcgaggcgtgccgaggcggtcgctccgatggggtctggggagacgatgacgacggagccgaactcgccgtaggccacgaggccgccatgacgcacgaggtgctccttgtcggagcgcagcgcgaagtagtccagtgtgctctgtgggtgggctcgcaggatctgtgcgggattgcggggcgctctgagggaggcgagctgcgcgctgaggcgatcgcgcacgggtgccacgaggcgccacacgatgaggacgaggagtgcgacgccgaccagcgtgagtgcgtcttgcaactcaccgaccgcgaatggcggcggtgcttgaaccggaagaccgagcacggtgccgatgatccctccgagggccgcgaggggacggagaggtgcatggtgtacgagggcatcgccgatcgcgacgacttcggcgacgaggacgaccaagacgccggcgcccacgaccgagagtgccctccacactcgtcggcccctgggggcgggttgtcgaaaggcgcttcgccagatggccagcgcgacgagcgcgaggctgaggaggccggtcgtgatgaggtcgctgcggcggaccaggttggaggcgaccgctgctgcgaggaccaccatggcgatccgccacgcccgtcgttgaccggctcggagcccttgggcgatgccgagcagcagcgtgccggcggccgccgagatcgcgtcggcgtagcgagggatcggtccgagggtagggaagagtgtggtgacgatcgacaggtgtcgtgccaatgggggtgcgaacgccgagatcacctccacgagaccggcgacgctgaccgcaagtcccccgacacggcgcaccgtgagcgaggtctcggaggcgagcctgggcgcggggggccacgaaccgccgtcaggggcgcccgcgagcgtcacctgatgatcgaggagggcctgatcgggccagagcaggcgcgagagcgcgttcggcgggcgaacgcgacggcgcgtccggcgcaggtaggcgcgcacgaccgcgccgacctcgagctcgatccacgtcgtgtggtacatgggctcgtagcgggtggggagcagacctctgccggcaacgggcgtgagcacggccgtggtcggtcctggcgaggcgaggaaggcgtcgtcgtcgtgttggagttcggcgagctcggcctgggcggcgatgagcgaggtgtgcggtgggaggctctcgaacagatcacgcgcggcttggttggtggccagtgcgctcaccatcgactccatcggctcctcgatgaggtgggtcaccgaccgcgaagcgaggacgctggcaaggagcacgatgagggcatcgaggacgaggaaactcgcgacgagggcgatgtggcgcgatgcctggtggtggaggtgtgcgacgagcggtgcggccctgagcacgaacggcagccgggccagctcgagcaggacgagcgggacgaagacccacaacgcgagcatgcgtgcacgccgtgcgaacgaacgcgccacgacgaagtgggtcacggaggcggccggatcgagccaggcagcgccacggaagcctgggagtcgttcgagcgcttcgagcgtgcgccgtcgtgcgagatccgtgccgaccggcttcatgcggacgcgatggccgcggggccctggcccgaggaggatcagctcggcggtgtgttctacctcggcccccattgccagaggctcgtcgcgcacggaggtgatgcgtacggtgcgtgcgcgggcgctcgtgagcaggtcgacgacgtcgtggtggtgcccgagtgcggagcgtgggtcgagactcggctcgggtgcggtgacgcgcccagcgaggacgagcaggtcatcgggctcgagctccccgatgatgcgtgcgagctcgtcacgatcggggcctgggcgccgatcgtggaggtcgagattgccgaggacgacgacgcgcgcgccgggcgcgaggcgcacctcgaggggcgccgactccacctcagtctcggaagttcgtgaactgtaccgggaagtccgtgatgtgctcgcggaggtgggcgatcacgctctggaggtcgtcacgcttcttcgaggtgactcggacttgctcgccctgtatctgcgcctggacgcccttgatcccagcggccttgatcgcggccgtgacggctcgtgctcgatcttgattcaggcctgcgacgaggcggatcacctggcgctgcgtacctcgcgcggcctcttcgatcgggcctcgatcgagcgccttgagcgagacaccgcgcttgacgagccgctcctcgaggacggtcgcgagtgcccgcagccggtcgggggtctccgagttcagcgtgatggtgagctctcgatcgttgaggttgatcgacgagccggtgttcttgaagtcgaagcgagtcgtcacctcgcgcgacgcctgatcgaccgcattgcgcacctcttgcaggtcgatctccgagacgacgtcaaaggacggcatgtgctcagactactcttgtgaccgtccagggtcggtgcccgagcggccaaagggagcagactgtaaatctgccggcgtacgcctacgggggttcgaatccctcccggcccactggagtccagcgcgcctggttcgatggtgcgcggcgacgtcgtgtcgcttccgaccgctcacgaggcggctaagctggcgccagcgcgaccaacgtggaggaagctgctgtcgtgaagtcctcgctcactcgtcgggctcagctctcggctcctggtgcggtgcgtcaggcacggatcctcggggcgcggatctccgagttcgtcgactcagtggagccagtcgagaccggcttgctcggctccatcttggtcttcctcgggtcgctgcagccgaattcgccgttcacctcgaaggtcccggggtcatggtttctcggtgtctcgtcggtgccgcaccccggttcggtcctcgtcgaggtgctcgcgaaggcagcggtttacctcggcctgatcctgagcggtgtggcctgggtgcggttggtgaggcttgcccgcgccgggtcgctgccgcgcgcctggtgggtcatcttcgcgctgtgggtcgttcccctcatgatcgctggccccttgttctcacgagacgtctactcgtacgctgcccagggccagatggtcacccaagggatcagcccgtaccatggtggccccaatctgctcgggacgagccccttcctcgcgaccgtggacccgctctggggcaacgctccggcgccgtatgggccactgtttctcgcggtcgatgccggtctcgtgaccatcgccgggcattcaccgctcatctcggtggtgctgttgcggctcttggcgctggcatcggtcgcggtgtccggggtcgccgtcagccgtatcgcacgtcggctcggtgcgaacgaggcgctcgccctcgcgctgacggcgctcaatccggtctttctctacacgctggcctccgcgggccacaacgacgcgttcatggtcgcgctcatgctgctcggtattgaccagttcctcgctggccggcgcttcgtgggcatcgtgatcgtcgcgctcggggcggcggtgaagatcccggcgatcatcgccgtgggtttcctcggctatcactggagcagcgaacgtacgtcgatcggggagcgcattcgcacgacgatcgtcgcgctcgtgatcgcggcggcgctgttgtgggcactcggcgtcgtgaccgggctcggcatggggtggctcccggcactgagcacgccgggttccgtctacagcttcgaggatccgatcgtcgccgttggctacggcgtcggttggttggcgcacgccgtcgggctcggcatcggtccttcgggtgtgatcagcgtgttgcgcgatctcggcgacgccgtgttgctggcggtcgctgcgatcgtgttgctcggttcgcgtcgcgagaccctgctgcggggtctggggatcgtgctcctcgcgaccgtcgcgctcggtccggtgatctggccgtggtatctcacgtgggccatcgtcgtgctcgcgatcggtgcgggagagctgacctcgggctttctggtgctcgtcacggtctcggcgctgccgatcgatctgctcggcctaccgaccgtgctggcgtgggtcggctacatcggcctcggggtggtcgtgcgtcgacactggggccatgtgatgggcttctggagcgagaccctggatggcgccaaggctcgggtcgaggagctcgtcgggcggacgccgctggctcgtctgctcccgtggagctgacgagcctcgtcgacgcggcccaccgcctgagcgaacgcgacccgctgatggcgcgcttcctcgaggcctacggcgtaccggtcgtggggcgccggggcttcgatccggggcgtctcgaggcgccgggtgaggttggcctcttcgggttcgtcgtcgaggtcgtgacctatcagcagatcagcgccgctgcggcgaggcgcctcgtggctcggctggaggcgatgggggcgctcgatgccgatgtgatggtcgcgctgaccgatgccgaggtggccgcgaccgggttgtcgggatcgaagcggcggtggctccgagcgctcgcgcgcgacgtggtgacgggcaccatcgacctcgagggactccgggcactctcgccggacgaggcacatcgtgcgctacgcgcgatccgcgggatcggcccgtggagcgccgacatggtggcgatcttcgcgctcggtcacctggatgtgtggccgatcggcgaccttgcgttgcgccgggcgctcgcgcgacgtcatcccggtgccgaggatcggggcgtcgccgagcggctcgccgagccctgggcgccgtggcgctcggtcgctgcgctgtggtggtggcaggatgacgcgtgcggggccgcgtcggtactagagcagccgctgcatgaccgcgaggtcaatccagcgagagaacttgcggccgatctcgcgttggatgccgacgagctcgaaccccgctctcgcatgcaacgaccgtgagacgtggtgatcggccacgatatgggcgatgcaggcgtggaagccgaggtcggcggccgtgtcgacgagtgaggtgaggagccgtgtgccgatgccacgcccctgggccgtggggtcgaggtagatcgagtcctcgaccgtcgaggcgtagcctgcgcgcggtcggtagggcgagatcgaggcgaagccgaccacgtccccgttgagctcggcgaccaagcagacgtagatgccgaggtggtcgtcgacccagcgctcgtgttcgctgggtgtgcgcggctcgatgtcgagggtggcggtcgtggtcaggacggcatggttgtagatgcgacgagtcgcctcggcgtcacttggaacgagaggacgaaggatcagcgcatcgtcgggcacgggtctacggtagaggctgtccggccccgaggctcgctcgctatcatggttggaactcgcccccttagctcagtcggcagagcacagccatggtaaggctggtgtcgtcggttcgattccgacagggggctccgtggcggcgtagctcagttggttagagcacacggctcataatcgtggggtcgtcggttcgagtccgaccgccgctactacggaccgtccagcgctggtaggaggatcgatggcgaagaacgaacggcgggtgcaggtgacgctggcgtgcgaggagtgcaagcgtcgcaactacatcacgtcgaagaacaagcagaacgaccgcgaccggatcgagatgcgcaagtactgccggtgggatcgccgccacacgctccatcgcgagaccaggtaggtcccgcgctgactcgggttcgtgctcgggccgctgagctccgtccgggcctcgaagagtccctcgccaaggtccgtgcgcgggctggggacctacgcccgtcgttcgacgaggtcgtgcatcgcacccttgcgatgagcacccgtgtcgcgtcccgcatcgtcggcgatgccgaggcggtgtcggacgtgctccaggacgcgtacctgaacgtgtaccggtcgctcgagcgctttcgcggcgcctcgcgctacgagacgtgggtctaccggatcgtcgtcaacgcggccaggtcgcacctgcgtcggatgcgacggatgcgggcgcgcgagacggtgctggacgaagcggagatcgtcccggctcgttcgggcgaggttctcgaggccgccgatctcgtggcacagcacatcgacgtcgtggcgctccttgcccgactcggggaggccgatcgcgagttgctcacgttgcgctacctcgctggcctgagtgtggcgcaggtggccgccgagctcggtgcgagcgagaatgcgatcaaggtccgcctccaccgagcacggcgtcgcctgttggcccttctggctgccgatgaggagttcgacgacgagggagccgtcagagcctcggtggggtctcccaagcgcggggactggtaagctcgttcggcggcgaagggtagtagctcaattggtagagcaccggtctccaaaaccggcggttgggggttcgagtccctcctgccctgcacgtgctgggtggtggttcacgcggcgcgagacggatcgttgagggtggagctgtgaatcgggagacgaggcgcctcatggcgcgccagcagggcgccacgcgcgaccgccaggagctggctcgacggatggcgcagggctccggggagccacgcaagggccgtatccggcggtacctgcagggggtgcggacggagcttcgtgccgtcgagtggcccactcggcgccaactgcggagctatgcaaccgtggtcttcgtgaccctcgtcctcgtggtagcgctcatcttcttgctgaacgtcgtgttcgccaagggtgtgtcgctgctctacggctagcgcaggtcgcgatcccgtgacgatcgacaacgatggaggcaaggtgagccccgaggagatggaatcgacgcaccagcccgcgctggtccacgatgacgaccgagctgcggagagccgcgaggtcgcatccgctgacgcgccagctgtgcagagccgcgacgatggtgaggcgacggaccccaagggcagcggtgatgacgacgtgagcgctgccgaggattctccgtacgatcgtccgggcgagtggtacgtcgtccactgctactccggctacgagaaccgggttcgccagaacctcgcgacgaggatccgctcgctcggcctcgaggatcgcatcttcgaggtggagatcccgatggaggacgtcaccgagctcaagaacgggcgacgagtgaaggtgcagcgcaaggtctttcctgggtatgtgctcgtacgggccgagatggacgacgaggtctggtccgccatacgcaacacccccggcatcacctcgttcgtcggatcgggatcgaagccggtgccgctgagccgcaaggaagtcgaggcgatgttctcgttcgccacgccggaggagctgcgcccgcagccacaacggcgctcgacgcaagagttcgagatcggcgaaacggtgcgcgtcaaggagggcccgctcgcggacttcgtcggcgaggtggccgaggtgaacgccgatcagctcaagctgaaggtgctcttcaacatcttcggtcgagagacgccggtggaactcgacttcacgcaggtgtcgaaggcctaggcccggtcgagtggcaggggccgactggtagagttgtcggttcgtgtcccgtgtggggcgtcatgggttcgtgacgccaggtgcgcggcggttgtgacgaaacggtagtgacgaaggagtcgttcggtggcgagaaagcgcgtaaccgcggtggtgaagatcaacctgccggccggtgctgcgacgccagcgccgcctgtgggtacggcgctcggcccgcacgggatccagacgatggagttcgtcaagcagtacaacgctgccacggaggcccagcggggacaggtgatcccggtcgaggtgaccatctacgaggatcgctcgttcagcttcgtgctcaagacacccccgaccaccgagctgctcaagcaggctgccggcgtcgacaagggatcaccccagaatcgccgtcaaggtgtcggtacggtgacgcgtgctcaggtcgccgagatcgcgcaggtcaagatgccagacctgaacgcctacgacctcgaggccgcgatgcgccaggtcgagggcacagcgcgatccatggggatcgccgtggtcgagggctagcgagagaagaggacgaggtcgcgagatgaagcactcgaagacgtaccgtgagcaggcagcactgctcgatcgcaatcggctgtactcgcccgtcgaggcgctcgcgctcgtgcgccagctggctcgcgctcgtttcgacgagaccgtcgagctcgccgttcgcctcggcgtcgatccgcgcagggcggaccagatcgtcaggggcaccgtcgccctgccccacggcactgggcgtcgcgtccgcgtcgccgtgttcgcggcgggcgaggccgcccaggaggcgcgtgaggccggagccgacatcgtcggcgccgacgatctcgtcgagcgggttcaaggcggcgcgttggacttcgacgtggccatcgcgacgccggatctcatgggacaggtcggccgtctcggccggatcctcggtccacggggtctgatgccgaacccgaggaccggaaccgtgacccacgacgtggggcgcgcggttcgcgagttcaaggcgggtcgcgtggagttccgcaccgaccgcgtgggcaacgtgcacgtcccgatcggcaaggtgagcttctccaccgtcgcgctgctcgagaacttccgagcggtgatcgacgagctccagcgcgccaagccggcagcggccaaggggcgctacttccgctctgtgcacgtgtcgacgacgatgtcgccgtcggtagcgatcgatccgaatcgactgcgcatcgccgacgaggaactcgaggaactcggagccgcgtaggcggctgcgccaggtaggattgtcccgccatcacctcggtccgctgtagaggtccggtgcccgcaagggctcaaatcccacggtgcgtgggagcctgatgaggcggtctctccggatcgagcaggcactgccaaggagagtgagatcgatggagcatcccaggccgagcaaggtcgccctcgtcgaggcgattcgcgagcggctcgcgacggcagacgcggtgttcgtaaccgagtaccgcggcctgaaggtcgctgagctcgcgtcgctccgacaggagcttcgcgccgtggacgcggagttcaaggttgcgaagaacacgctcgcacgcatcgcggcgcgcgaggcttcgctcgaggcactcgaggcgttcctcgagggccccagcgggctggtgttcgcccgtggtgacgctgcggcgacggccaagcgactgcgcgacttcggccgagcgaatccggcactcatcatcaagggtgggctgctcggtcgcgccgcgatcgacgcagcatcggtgctgcggcttgcggatctcccaagtcgtgaggtgctccttgcgcagttggcaggggcgttcaccgcacccatggcgaacctcgccggggtgctgtcggcgctgcctcgcaacctcgcctacggcctcaaggcactcgccgaccagcgagcggcgtaggcgcgagtcgaccacggagaacaggaggagacagtggcggacatccaggggattttggaccagatctcggagctgacggtcgtcgagctctcggagctggtgaaggcgttcgaggagcgcttcggtgtcacggccgcggcgccggtcgcggtggcggcggtcgccggtgccgctggtggcggcgaggctgcccccgccgaggaggagcagcaggagttcgacgttgtgctcgtctccgcgggtgacaagaagatccaggtcatcaaggaggtgcgcgcactgacgaacctcggcctcaaggaggcgaaggatctcgtcgacgcggcgccgaagccggtgctcgagaaggtctcgaaggaagacgccgagaaggcgaaggctcagctcgagggcgccggcgcgacggtcgagctcaagtagcgagccgtcgacgcaggcggtcgtgcggtctccctgtatgcttaggggagccgtgcgtcgtcccgcaaccacttcgtcttgacgctcacgggcctttgcgcgcccgtgagcgtcttcgtgtctgccgccaccgtgcacgctcggacacgagtggtgcgagcgtcggtcgggcacctgctgtgggtgtgtgcagtccgtcgagtgcaagtcaaccgagtgcatagtcaactgagtgcaaggagtctcccttgatcacgaggcaccgtccgcctgagcgcttcagcttcgcgtccgcgcgcaatgttctgccgctgcccgatctgatcgctgtgcagcgcgactcgttccgctggttcttgaatgaggggctcgcggaggcctttcgagacatctccccgatcgaggactactccggccagctcgcactcgaactcgagtacgaccccagcgatcctgatctcgcgccggtcccgaagttctcggcggaggagtgtcgcgagaaggacatgacctatgccggcccgatcttcgtgcgggctcggttcttgaaccgccagacctacgagatcaagcagcagatcgtgttcatgggcgacttcccgctcatgaccgaccgaggtacgttcatcatcaacgggaccgagcgtgtcgtggtgagccagctcgtccgctcgcccggcgtcttgttccagcccggtcgcgatcagcacaccgtcgtgacggccaccatcaacccctaccgaggggagtggctcgagttcgacgtcgaggcccggccgggtcgcgatatcaatgcggggggccgcgtcgcgcgtaagcgccggctgagcctgttcacggtcctgcgggcggctgggcttgacgaccctgccgatcttgagcgcctggtcgcacacttcgacttcctcgaacctcagtgggccaaggaggaccactcccagacccgcgacgacgccctgatggaggtgttccgtcgggtacgcccgggcgagccgatcaacgtcgaggcggcccgcctctacttcgagaccgcgttcttccagagccggcgctatgacctcacccgcgtgggtcgctacaagatcgacaagcgactcagcgcggagatcgagcgcgtcgaggagatcctcggtcacccgctggatcgaacctcggagtcgccgctcgtgctcagccgtgcggacatcatcgcgaccgcgagctacatgctgcacctggtcgctggcgagcccgggtatcgcttcgacgatcaggaccacttctccaaccggcgggtccgcagcgtcggcgagctgatccagaaccagctcaagatcgggctctcccgcctcgagcgcctcgtccgtgagcgcatgacgacccaggacgtcgaggcgatcacgccgcagagcctcatcaacatccgtccggtggtcgctgcgatcaaggaattcttctccaccagccagctgagccagttcatggaccagaacaacccgctctctggccttgcccacaagcgccgcctgtcggcacttggtccaggtggtctgtcgagggagcgagcgggtttcgaagtacgcgacgtccactcgtcgcactacggacgcatgtgcccgatcgagacaccggaggggccgaacatcggtctcatcggggcgctcgcgagctatgcccgcctgaatcgatacgggttcatcgagaccccatatcggcgtgtggtggacggcaaggtcaccgatgaggtggtctacctgaccgccgacgaggaagaagactacgtcatcgcgcaggcgaacgcgaagctcgacgccgagggtcgcttcgtcgagccgaaggtcctggtgaggcgcggcccgcagggcgcggtcgtgcgggtcggtgccatggcggtctcctacggcgccaccagtgaggtcgagctcgccaccccggacgaggtggacctcatggacgtgagtccggcgcaggtggtctcggtgtcgacgtcgctcatcccgttcgtggagcacgacgacgccaatcgtgcgctcatgggtgccaacatgcagaagcaggcggtgccgctgctcgtccctgaagcgcccttcgtcggtaccggtgtggaagcccgagccggactggacgctggcgacgttcttgtcgccgagggcccaggtgtcgtgtcagaggtgaccggcgcctcgatcgcggtgacctacgacgattccgtgaccgacgatgccggtcggccactcggaacacgtcgctactggctgacgaagttccagcgatccaaccagaacacctgctggaaccagcgtccgacggtggccaccggggaccgggtcgagctcggtgacgtgctcgccgacggtcccgccaccatgcacggtgagctcgcgctggggaagaacctcctcgtggccttcatgccgtgggagggctacaacttcgaggacgccatcatcatctcggagcgcctcgtgcgagacgacgtgctgtcctcgctgcacatcgaggagttcgagaccgatgcgcgcgacaccaagctcggtgccgaggagatcacccgcgacatcccgaacctgtcggaggaggccctcgccgatctcgacgagcgcggcatcgtccgtatcggagccgaggtcggccccggtgacatcctcgtcggcaaggtgacgccgaagggcgagaccgagctcacgccggaggagcgactgctgcgtgcgatcttcggcgagaagtcccgcgaggtccgcgacacctcgctgcgcgtgccccacggtgagtacggcaaggtgatcgacgtcaaggtgtttacccgcgaggacgcgaccgagctgccgcccggcgtgaacgagctggttcgggtgtacgttgcgcagcaccgcaagattcaggtcggtgacaagctcgccggtcggcacgggaacaagggtgtgatctcgcggatcctccccatcgaggacatgcctcgactggaggacggtacgccggtcgacatcatcttgaacccgctcggcgttccgagccgcatgaacatcggccaggtgctcgaggcgcacctcggctatgccgcccggtgggggtgggagcccatcggcgagggcgcacgggagcatcgcaagacgcgtccggtgacggtcccggcccggtgggtggcgagtcccgccttcgacggcgcgcactgggacgagtcggaagaggccggggacctgccgaccatcaaggaactgctcgagcggctgaacccgcagagccgcgacggcgagcgcctcgtccagcccgacggcaaggcggtgctctacaacgggcgcaccggcgagcgctacgacaaccccgtcatggtgggctacgtctacatgctcaagctggcgcacatggtcgatgacaagatccatgctcgctcgacgggcccgtactcgatgatcacgcagcagcccctcggcggcaaggcccagttcggtgggcagcgcttcggtgagatggaggtgtgggccctcgaggcctacggcgccgcgtacgcgctgcaggagctgttgaccatcaagtccgacgacgtcgtaggccgtgtgaaggtctacgaggccatcgtcaagggtgacaacatcccagaaccggggattccggagagcttcaaggtgctcatcaaggagatgcagtcgctgtgtctgaacgtggaggtgctcgctccgaacggagagcgggtgcagctgcgcgagttcgaggatgaggcgtactcggcggcggaggagctcggtatcaacctgagccgccctgagcgcaacacggactacggcgacgacgagcgacgcgaggagaggggtcagtagtgctcgacctgggtcgattcgaccagatccgcatcgggcttgccacgacggaagccatccgcgcctggtcacacggcgaggtgaagaagccggagacgatcaattaccgtacgttgcgtccggaacgcgatgggctcttctgcgagcgcatcttcggccctacgcgcgactgggagtgccagtgcggcaagtacaagcgcgtgcgctttcgcgggatcgtctgcgagcgctgtggcgtcgaggtcacccgctccaaggtccgacgggagcggatgggccacatcgagctcgcagcaccggtggtgcacatttggtacctgcgcgggacgcgttcgtggctggcctacctgctcatggggacctcccccaaggaggagctcaaggccaagcagctggagaaggtgatctacttcgccgccaacttggtgacctgggtcgacgaggagcgtcggcaccaggacctgccgaacctcgaggtcgaggtgctcgaggaggttcgggcgatcgagtcggagcgtgacgtcgagctcgagcgccggtaccaggcgatggaggcggagctcgccgagctcgaggagcagggtgctcgcgaagccgaggtgcgccagcgccagcgcgcgctcgagcgggagatcacgcagctccgcgagcgctacgcggcgcgcatcgacctcgcgcgtaggaccttcgacgagttccgcgagctctacccgcgccagatcatcgaggacgagctgctgtggcgcgagctgcggtcgcggtatggctcctacttcgacggcggcatgggggccgaggcgatcgccgacctcatccgtcgtatcgacttcgatgccgagctggccaagctccgcgagctcatcgaccccgccgagggtcgccgcccgttgtcggcacagcgtcgccagaaagccatccgacgcctgcgcatcctcgccgcgttcaaccagcgcgacgaggagggtcgtcgtatcaacgacccgatggcgatgatcctcgaggtcgtcccggtgatccccccggacctgcgtccgatggtgcagctcgacggcgggcggttcgcgacgtcggacctcaacgatctgtatcggcgcgtgatcaatcgcaacaaccggctcaagcgtttgttggatctcggcgcgccggagatcatcgtcaacaacgagaagcgcatgctccaggaggcggtcgacgccctcttcgacaacggtcgccgtgggcggccggtggtcggcccgggcaaccgtcctctgaagagcctctccgacatgctcaagggcaagcagggtcgcttccgccagaacctgctcggcaagcgcgtggactactccggccggtccgtcatcgtcggcggcccgacgctgcagctccatcagtgtgggctcccgaagatcatggcgctcgagctgttcaagccgttcgtcatgcgtcgcctggtggagttgggctatgcccagaacatcaagtcggccaagcgcatggtcgagcgtcggcgtccccaagtgtgggaagtgctcgagacggtgatcaaggagcatccggtgctcctgaaccgtgcaccgaccctgcaccgactcggcatccaggcgttcgagccggtgctggtcgagggtaaggcgatccagatccatcctctggtgacgaccgcgttcaacgccgacttcgacggcgaccagatggcggtgcatctgcctctgtcgcctgaggcgcaggccgaagcccgcgtgctcatgctctcggcgaacaacacggtgtcgccagcgaccggacggccgatcacggtccccgggctcgacatggtgttcggtctcttctatctcaccatcgtgcgcgaagaggagccaggtgccggcaaggtgttccgccacgactatgaagtggtccgggcctgggaaaccggcaatctcggcttgcacgcgccgatcaccctccgtcgtcgcgatggcgatggcaacgtcgaagagctgcggacgacagccgggcgtgtgatgttcaaccaggcgctgccggccgacttccccttcgtcaacgaggtcgtcgggaagaaggcgcttcccatcggctcgatcgtcgagcgggtggtgacccagtacccccgcaacgtcatcgaggagacgctcgatcgcatcaagtcggttgggttcaccttcgcgacgcgcgctgggctcaccatctcgaccgacgacgtcacaaccccggccgccaaggccgagatcctcgatcgctacgagcgcgaggcggacaaggccgaggcgcagtaccggcgaggcatcatcaccgacgacgagcgcaagcagaaggagatcgagatctggacggcggcgaccgcggagatcggtcgggccatcgacgagatgctcgcctccaacccgctcaatccgctcgcgatgatggtcgagtcgggagcgcgaggcaaccctcagcagatccgccagatctccggcctcaagggcctcgtcgccaatccgcgcggtgagatgattccgcgcccgatcaagtcgtcgttccgtgagggcctcgaggtgctcgagtacttcttgtcgacgcacggtgcgcgcaagggcctcgccgacacggcgctgcgcaccgccgactctgggtatctcacccgtcgcctcgtcgacgtcgcccaggagctgatcgtgcgcgaagaagattgtggcacgtcgcgggggatttggatcgacgacgtcgccgaggactcggcccagcgtcgcagctacctcgagacgcgggcgttcggacgggtcctcgcagaggcggtcgatcttggcgacgggtcgcagctcccggccgggacgttgctcaccgacgagctcgtcaagcagctggcagccgatccggcagtcgagcggatccgtgtgcgcaccccgctcacctgcgagacgccccacggcgtgtgtgcgacctgttacggccaaggttttggggggagggggctcatcgagctcggcgaggccgtcggcgtcgtcgcggcccagtccatcggcgagcctgggacgcagctcaccatgcgaaccttccaccagggcggcgtcgcgggcgccgacatcacgcacggcttgccgcgcgtggtggagctgttcgaggcgcgttcgcctcgtggagccgcggtgctggcgcatgcgtccggtgtcgtgcacatcgaggaggaagagaacggtcggcgggtcaccatcacccacgacgacggctccgacgaggtctacgtgctcccgctcagggcccatctcgaggtggccgagggcgaagtgatcgaggccggcgaggccatcgtgagcggtccgaaggaccccaagcagctcctcgagatcaagggcattcgcgagacccagcgttacctggtcgaggaggtccagaaggtctatcgcgaccagggtgtgtccatccacgacaagcacatcgagctcatcgtccgtcagatgctgcgccgagtgctcgtggccgagcctggcgattcccccttcttgccgggagaacgcgtggacacccagcgctttgccgaggtgaaccgcgaactgttcgccgaggggaagcgccctgccgagggtcggccggagctcatgggtatcaccaaggcgtcgctcgcgacggagtcgtggctctcggcggcctccttccaagagaccactcgggtgctcaccgaggccgcgatcgaggggcgttcggatcacctgctcggcctcaaggagaacatcatcctcggcaagctgatcccggcaggtacgggtgcgccgcgttaccggtcggtcgcggtcaaggctccccactatcgccgactcgcgtactggtcgagcgaggaagacctcggtgggttcgacggggggcctggctatgaggcgcatggcggccctgtagactgagccatacgcgggtggtgcgtgtcgcgtgccaccactgcgaatcgggccggacgcggaggttctcggcgagccggcagaggaaccaggaatgttggagaccggcccgccccgtgtgggcgggccggtccaccgagagcggcgcgcctgcgtcgcaagaaggagtgcaaaccgtgccgacgatcgcgcagctcgtgcgcaagggccgcgaggccaagcgcacgaagaccaagaccccggcgctcaagggatcgccgcagcgccgcggggtgtgcacccgcgtgtacaccaccacaccgaagaagccgaactccgcgttgcgcaaggtcgcgcgcgtccggctcacgagtggcgtcgaggtcactgcctacatccccggtatcggtcacaacctccaggagcactcgatcgtgctcgtgcgtggcggccgcgtcaaggacctccctggtgttcgttacaagatcgtgcgcgggacgctcgatgcggcgggcgtgaagaaccgcaagcaggcgcgcagccgctacggcgcgaagagggagaagtagccgatgccacgcaagggtccagcccaggttcgtccgatcgctcctgaccaggtctaccactcggtgctggtgtcgcagctgaccaacaaggtcctgcgtaacggcaagaaggcgctcgccgagcgtaccgtctacggcgcgctcgaccagatcgctgccaaggtgaacggtgacccggtcgccgtcttggagcgtgcgatctcgaacgtacgccccatgaccgaggtgcggtcacggcgcgtcggcggtgcgacctatcaggtacccgtcgtcgtccgtgatcggcggtcgtactcgctcgccatccgctgggtcgtgaattcggcgcgcgcgcgccgtgagaagaccatggccgagcggctcgccaacgagctgctggatgcgtccaacgggctcggcacgtcggtcaagcggcgggacgacacccacaagatggccgaatccaaccgcgcgttcatgcactatcgctggtaagcaaggagctttccacatgccccccacccgtcaggtcccgctcgagcgcttgcgcaacatcggcatcatggcccacatcgatgccggcaagaccaccacgaccgagcgcattctctactacaccggcaagaactacaagatcggcgaggtccacgagggcgcggcgacgatggactggatgccgcaggagcaagagcgcggcatcaccatcacctcggctgcgacgacggcgttctggcgggatcaccgcatcaacatcatcgacacgcccggtcacgtggacttcacggtcgaggtcgagcggagcctgcgggtgctcgacggggcggtggcggtgttcgacgccgtcgctggtgtcgagccgcagaccgagacggtgtggcgccaagggaacaagtacggcgtgccgcggatctgcttcgtcaacaagatggaccgtgtcggggccaacttcgatcgctgcgtccagatgatccgggatcgcctcgacgccgtcccggcggtgatccagctcccgctcggtgtcgagagctccttccgtggtgtcatcgacgtcgtcggcaagcgcgcgatcgtgtgggacgagggcctcggggagacgttccacgacgagcccatccctgccgagctcgtcgacgctgcagagcaggcgcaccacgatctcatcgacgtgctcgccaatcacgacgaagagctgatggaacgctacctctccgacgaggagatctcggaggagatgctgcgggcctccatccgcgaggcgaccatcaacaatcacgtcgtcccggtgctctgtggctcggcgttcaagaacaagggcgtccagccgctgctcgatgcggtggtggactacctcccgagcccgttggacatcccggccgcgaccgggacgtcgccgaacggcatggacatcatcacacgcgagccgtccgacgatgcgccgtttgcggccctcgcgttcaagatcatgaccgacccttacgtcggcaagctgacgtacttccggatctactcgggcgtcttggagaagggatcgacggtcctcaactccaccaaggacaagcgcgagcggatcggtcgactgctgctcatgcacgccaaccatcgcgaggacatcgaggtcgcccacgctggtgacatcgtcgcggccgtcggcctcaagtcgacgagcaccggcgacacgctgtgcgatccccaggcgcccgtcgtcctcgagagcctcgagttccccgatccggtcattcacgtggcggtggagcccaagaccaagtcggatcaggagaagatgagtcgggcgctctacgcgctcgccgaggaagatccgacgttccgcgttcgctccgaccaggagaccggtcagacggtcatctcggggatgggcgagctgcatctcgaggtcatcgtcgatcggctgctgcgcgagttcaaggtcgaggcgaacgtcggcaagccgcaggtcgcctatcgggaggcgatccgcaagccggtgtcgaaggtcgaggagcgctacgtgcgccagaccggcggccgtggccagtacggtcacgtcgtcatcgacgtcgagccgctcgggcgcggcgaggggtacgagttcgtcgacaagatcaccggtggcgtcatccccaaggagtacatcccagcggtggacgccgggatccaagacgcgctctcgtcggggatcctcgcgggcttcccggtcgtggatctgcgcgtcacgctggtcttcgggtcgtaccacgaggtcgactcctcggagatggcgttccgtatcgccggctcactcgccatcaagaaggcggtgcgcatggcgagtccgtgcctcctcgaaccgatcatggcggtggaggtcgtcacgcccgaggagtacctcggtgacgtgatcggcgatctctcggccaggcgaggcaaggtcgagggcatggagcaggtcggcgtgaaccaggtggtgcgtgcgctcgtgccactcgcggagatgttcggctacgctactgacctgcgttcgcgtacgcaggggcgtgcgagctactcgatggtgttccgggcctaccaagaggttccggattccatcgcgcaggagatcgtcaagcggatcaagggcgagtagacttcagcactcggttatccgtcggcgggttgcgtcatccgggcgcagagggacaacaacggagcaggacaggccatgggcaagcaaaagttcgagcggacgaagccccacatcaacattgggacgatggggcacatcgaccacgggaagaccacgctcaccgcagcgatcacgaaggtcctctcggagaagaaccccaacgtcaagttcaagcccttcgatcagatcgacaatgcgccggaggagaaggctcgcggcatcaccatctcgatctcgcacgtcgagtacgagacggagaagcggcactatgcgcacgtcgacatgccggggcacgctgactacatcaagaacatgatcacgggcgctgcccaggtcgatggtgcgatcctggtggtcgccgcgaccgacggtccgatgccccagacgcgcgagcacgtgctgctcgcccggcaggtgggggtgccctacatcgtggtggcgctcaacaaggcggacatggtcgacgacgaggagctcctcgatctcgtcgagctcgaggtccgagagctgctgaaccagtacgagttcccgggtgacgacaccccgatcgtgcgggtctcggcgctcaaggcgctcgagggcgatccggtctgggaggagaagatcgtcgagctgatgaacgcggtcgacgagtacatcccagagccacagcgtccggtggatcgtccgttcctcatgccgatcgaggacgtgttcacgatctccggccggggtacggtcgtcacgggcaaggtcgagacgggcaaggtccacgtcggcgacgaggtcgagatcgtcggcctgcggcccacgcagaagacggtcgccacgggcgtcgagatgttcaacaagctgctcgacgagggccaggcaggcgacaacatcggtgtcctgctgcgcggcacgaagaagaccgacgtcgagcgcggccaggtgctctgcaagccgggctcgatcaccccgcacacgaccttcgaggccaatgtgtacgtcctgacgaaggacgaaggcggccggcacaagccgttcttcaacaactatcggccgcagttctacttccgtacgaccgacgtcacggggaccatcaccctgccggaaggtacggagatggtgatgcccggcgacaacatcgtcatgaccgtcgagctgctcaagccggtggccatggacgagggtcttcgcttcgccattcgcgagggcggccgtacggtcggcgcgggtcgcgtcgtcaagatcatcaagtagcacgtcagtgcgtcgacgagggccccggcacgtccggggcccttcggcgtcgacggacgaccggagcaccaaggagagccatgagcgacagcagtaagcagcgcatcagggtgcgtttgaagggtttcgaccacgagatcctcgaggcgtcgacccggcgcatcgtcgatacggtgacgaggacccaaggcaaggtggtcgggccggtgcccttgccgaccgacatccaccgctacaccgtcattcgctcgccccataagtacaaggattcgcgcgagcacttcgagatgcgcgtccacaagcggctgctcgacatcgtcgatcactcggccaagaccgtcgacgcgttgaagcggttggagctgccggccggcgtcgatatcgaaatcaagatccagaacgcatagcgagagatcgcagcatgatcggcccgcgcccgagtgcgcgggcagtatgctgcaagagttgtcttgcgtccggtcgtgcctcctctggagggaccttccggcggtttgagcggcgctacccgctcgtacgaggtcagctgcggcgtcgggtggacgctgcgtgaggcgaaggaaccatggcgaggaagacgtttgtcggtgagaaggtcggtatgacccaggtctggaccgagggtgaccgtgccgtcccggtgacggtgatcaaggtcgtcccgacgtgggtcgtgcggacgaagacgccggagcgagatgggtacgaagcggtgcaggtcgcggtgggtcgcgtcaagccgcagcggctgagtcgtccggttgcgggtcagttcgaggcccgaggtgtcgaggccggcgcccgcatcatggagctgcggctcgatggggcgtcgtcgttcgagcccggcgatcagatcgggatcgaggggatcgagccggggatgcgtctcgacgtcgtcggcgtgtcgaagggccacgggttctccggcggtatgaagcgccacaacttccgtgggcagggagcggcccacggtaaccacaagaagcatcgtgctccgggctcgatcggggcgtgcgccacgcccgcacgcgtgttcaaggggacgcgtatggcgggtcagtacggtaccgagcgggtcaccatccataacctcgaggtcgtgcgggctgagcccgagcgccagctcgtgctggtgaagggctcgatccctggtccgcggggcgccatcgtcgtggttcgtgattcggtgaaggggcggaagtagatggcgagcgccaaggtcatcgacgccacgggtcgtacgctgcgcgaagaggaactgccgggcgaggtcttcgcgcacgctcccaacatcgcgctgttgcatcaggttgtcgttgcggagcaggccggtgcgcgccggggaacgcattcgacgaagacgcgggcagaggtcgccggaggcggcgcgaagccctatcgccagaaggggaccggcaacgctcgccagggttcgatccgggcccctcagtacaagggtggcggtatcgttcacggccccaagccgcgcgactactcccagcgcaccccccgcaagatgctgcgcgcggcgctggcacaggcgttgtccgatcgggccagcgccggcgtgatctacgtgctcgaggacgacgtcatcacggcgccgtcgaccaaggcggcgcttgcctgtctgcgcggggctggtctcgaggatcgcaaggtgctcgcgctggtggccggtgcaaccgacgaggccgtcttcaagagcgtgcgcaacctccccacggttcgtgtccatcgggcgggcttggtgctggtaagtgcggttctcgcttccgacgccgtgctgttcacgcgcgcagcgctggcagagctcctcgggcgcgtgggagtggaggttgccaagtgagcggtcgggatccctacgcaaccgtcgtggcccccatcatttcggagaagagctacgggctccgcgaggagggcgtctacgtcttcgaggtggcgcctcgagcgaccaaggtggacgtgcgcgccgcggtcgagcggctcttcggggtgcacgtggtcaaggtcaacacgctcaaccgcaagggcaaggcccgtcggagccgccgaaccggtcgagtcagcgtggagcccacccgcaagctggcctacgtcaccttgcgcgagggcgagcgcatcgagctgttggagagctgagccatggggattcgtaagcgcaagcccacgagtgcgggtcgacggttccagtcgagttcggacttcgcggagatcacgaagcagcgtcccgagcgatcgctggttcgaccgctgtcgggctcgggaggacgcaacgccgacggtcacaagaccgcgcgccatcggggtggcggacacaagcggcagtatcgggtcgtcgacttccgtcgcaagaaggacggtgtgccggcgacggtcgcagcgatcgagtacgaccccaaccgcaatgcgcgcatcgcgctcttgcactatcacgacggcgagaagcgctacatcctcgcgcccaaggggctcacggtggggatgaaggtgagttccgggccggacgccgacatcacggtggggtcggccctcccgctgcgcaacatccccgtcggcaccaccgtccacaacgtggagctccgtcccgggcaaggcggcaagctcgccaggagcgccggtatgggcatccagctcgtcggcaaggacgaggtctacgcgacgctccggctgccctcgaccgagatgcgccgcgtcccgatcgattgtcgtgcgaccgtcggcgaggtcgggaacgccgaggccgagctgatctcgatcggcaaggcgggtcggaaccgctggcgtggcgttcggccgcagacgcgaggcgtcgcgatgaacccggtcgaccacccgctcggtggtggcgaaggcaagacgtcgggtggtcgccatccggtgtctccgtggggcaagccggagggccgcaccaggcggcgtcacctcccgagcgacaagctcatcatccgccgtcgtcgagcccgtggggcgaggaggtagtacgtgccacgcagcgtcagcaagggtccgttcgtcgatgcgcatctgttgaagaaggtcgacgagctcaacgcgtcgggtgacaagcgcgtgatcaagacctggtcgcgtcgttccaccatcattcctgacatggtgggccacaccatcgccgtgcacgacgggcgcaagcacgtgccgatctacgtcacggagtccatggtcggccacaagctcggggagttcgcgccgacgcggacgttccggttccatgccgggcaagagaagacggcgaggaggcggtagtggcagtcacagtgaccgagcgcccgcgctcgcgagcggtgctccggaactacggcgcgtctgcgtcgaaggtgcgagaggttcttggcatcattcgaggcaagccggtcgagcaggccattcgcgaactgtcgctcgtgagccgtggtccggctgaggcggtcggcaagctcctcgcgagtgccgtggccaacgcgacggtccagcacgggctgggcgtgtccgacatggtggtgcggctggcctatgcggacgaagggacgacgctgaagcggtttcggccgcgtgcgcgcggtcgtgcgacgcgcatccgcaagcggacgtgtcacatcacggttgtggtcgaggagatgacgctcgaggagcgccagcgcgccgtggcgcagaccggccgtcgtgccgtgagccgccagcggcgcgtgcagtcctctcgtcgcggacgccagcaggcgcaggcgacctcggcagaggcgacctcggcagaggtggccacttcgcagcccgagatcacgagcgaggcggcagcgtcggagcagacggtcgaggtcacggctgccgaggagcaggttgcagctctcgttgccaccggcgaggagaccggggccgagacgccgagcgccgcctcggaagaggccgccgagggcggggaggagtaggtcgtgggccagaaggtgcatccgtacggcttccgtctcggagtcacgacggactggaagtccaggtggtacgccgataaggactaccagcgttggctgatcgaggacgagcagattcgccagtggctccagcgcgagctgcgcacggcgtcggtgtctcgggtcgacatcgagcgcacccgtgaccgggtgcgcgtggacatccacacggcacgtccgggcatcgtgatcggcaagaagggtgtcgaggtcgagcggttgcggcgggagctggagcggcgctgcgcgccggctcgtgtgcagctgaacgtcgaggagatccgccaaccggatctcgacgcgaccatcgtcgcccagagcatcgccgaccagatcagccggcgcgtgagctttcgccgagcgatgaagcgtgcgatccaggtggcgatgaaggaaggcgcgcgtggcatcactgcccagtgctctggtcggctcggtggcgcggagatggctcgccgagagacccatcgcgagggtcgggtgccgcgtcacacgttgcgtgccgacatcgattttggcctgcgtgaggcgcgaacgacctacgggcagatcggcgtgaaggtctggatctacaagggtgacgtcgtcccctaccagacgctgacctcccagccgcagcggccgccggtcgcgggtggtcgtccgaccggaccgatccgcgcccagactggatcgcggcgtcggcccgtggccgaggcaccgaagccggccgcggtgggtgcggagagtcaggacgagttcgagcgcttgctcgccgaagaggaggagatcgagcgacgtacccgtgaggagggtcgcgaggctccacacttcaagaaggaggtggactagcgatgctcatgccacgcaaggtgaagcaccgcaaagtccagcggggacggctcggcggagaggccaagggtggtaccgagatcaccttcggtcgctacggtatccaggccctcgagccagcgtgggtgacggctcgccagatcgaggccgcgcgtatcgcgatgacgcggcacgtgcgtcgcggtggcaaggtctggattcgcatcttcccggacaagcccatcaccaagaagccggctgagactcggatgggttcgggcaagggcaacccggagttctgggtcgcggtggtcaagcctgggcgcattctcttcgagctcgacggcgtgggcgaggagctcgcccgtgccgccatggagcgcgcgatccagaagctgccgatgaaggcacgcttcgtggtgcgcgaggacgtggaagcgttggcgggaggcgccagatgacgagggcacgagagctgcgcgacctgagcccggaggcgctcgaggagcgactcggttcgctcaagcgagagctgctcgagttgcggttcgcgatcgcgaccggccagggaacccagacggcgcggttggggcagctccgcagagagattgcccgtgtggagacggtgcgacgcgaggcggcgtcggcgaccgagacgacccgagtgacgcgggcgaggagcaggagacggtgagcgaggagcagcagcaagagcgaccccggcgcaaggtccgcgaagggatcgtggcaagcgccaagatggacaagaccatcgtggtggagatccatcagcgggttcgtcacccgcgctaccagcgcacgatcgcgcgtcggcgtcggctgtacgcgcacgacccggcgaacgaggctcgcgagggcgaccgtgtcgagatcgccgagacgcggccgctgtcgcggctgaagcgctggcgtctcgttcgaatcgtggagcgtgcacggtgatccagcaggagactcgactgaaggtggcggacaactcgggcgcgcgcgaagtgctctgcatccgcgtgctcggtggttcgcgtcgtcgctacgcgagcattggtgacgtgttcgtcgcgacggtcaaggacgcactccccggcgcggccgtcaagaagggcgacgtggtcaagtgcgtcgtcgtgcgtactcgcaaggaggtacgtcggccggatgggtcctacatccgcttcgacgacaacgctgcagtgctgatcaacgaccagctgcagccccgtgggacgcgcatcttcgggccggtcgggcgcgagctgcgtgacaagcggttcatgcgcatcgtgtcgttggcaccggaggtgatctgagtgcgcattcgtaagggagatcgggtccgcgtgatcgcggggaagtggcgcggggccgagggcgaggtgcttcgggcgcttccggcgcgccatcgcgtggtcgtcgacggggtggcggtcgccaagcgccacaccaaggcgcgcgatgcgtcgagcccgagcgggatcctcgagaagaccctgccgatcgacgtctcgaacgtgatgatcatctgccgcgcatgtgggccgacgcgcatcgcgatgaaggtcgacgacgccggccgtcgccagcgggtctgtcgacgctgtggaggagcgctgtgatggttcagaccgatacggcccccaggccgcggctacgggtgcgcttcgacgaggaagtgcgccccgcattgttccgagatctcggtctcgagaacgtcaaccaggtgcccaggctcgccaagatcgtggtcaacatgggcgtagggcgggccagcgcacagccgagtctgctcgagggagcggtccgcgacctggagacgatcacgggccagcgcccgtcgatccgcagggctcgcaagtccatcgcgggcttcaagctgcgcgagggcatggcgatcggggcgacggtgaccctgcgcggcgaccgcatgtgggagttctacgatcggctggtcgcggtcgcgattccccgcatccgtgacttccgcgggctcaatccccggtcgttcgacgggcacggcaactacacctttggcgtcacggagcagctgatctttccggagatcgactacgactcggtcgacaccacgcgtggtatggacatcaccatcgtcacgaccgcaacgacggacgcgcatgggcgtgctctgctcgaagcgctcggttttccgtttcggagggaagggtaatggcgacgaaggcgctgatcgcgaaggcgaaccgcgtgccaaagttccgtgtgcgggcctacacccgctgcaagcggtgcgggcggccgcacgcggtctaccgcaagttcgggctgtgccgtatctgcctgcgcgagatggcgcacctcggcgaggtgcccggcgtgaccaaggccagctggtaagggggtaggcgaatggcaatgaccgaccctatcgccgacatgctcacgcggatccgcaatgcgtcccgcgcgcgccacgcctcggtgacgatgccgagctccaagctcaaggtggagatcgcgcgcatcctcaagcgcgagggtttcatccaggactatgcggagcgcgagagcgccgtggggccgcgcaaggatctcgtgatcgagctgcgctacgtcggtgatcgacgtgcgtcgtcggcgatccacggcatcgagcgcatctcgaagcccgggctgcgcgtctatcgacaggccgggtcgctcgagcgggtgctcggaggcatggggatcgcggtggtgtccacctcgcacgggctcatgacggaccgtgaggcccgagcccgacgcgttggtggcgaagtgatctgtcacgtctggtaggaggaacgatgtcgcggattgggaggcaacccatcgcggtgcctggcggcgtcgaggtggcggtggatggccagcacgtgtcggtgcgcgggccgaggggttcgctcgctcgcgacctgccgccggaggtcacggtgagcgtggtcgacagcgtggtgcacgtcgaacggagcgatgactcgaggcgcgctcgggccatgcacgggctctcacggacgctggtcgcgaacatggtgcgcggtgtggccgagggctacgagaagacactggagatcatcggaacgggctatcgcgcccaggcgcgtggcaccggcgaactcgagctcgcgctcggcttctcgcacccagtcgtggtcgaggcgcccgatggcatcgcgtttgcgacgccgacgccccagcgcgtcgtggtctcgggcatcgacaaggaactcgttggacaggtggcggccaatatccgccgcatccgcaagccagagccctacaagggcaagggtgtgcgctacctcggcgagcgggttgtccgtaaggccggcaaggccgggaagtaggtaggagacgatggcaacgctgtcacgggaggatcgtcggcgccgtcggcacgcgcgtgtgcgccgcagggtcgtcggtacgagcgaacggccccggctggcggtcttccgatcgaatcggcatatcttcgctcagatcatcgacgacacggctgggcgtacggtggccgctgcctcgacggtcgagccagagctgcgcgatgggcgcaccggctcgacggagggtgcggcgtcggtcgggcggctcgtcgcgagtcgtgcgttggcgctcggggttcgccgcgtcgtgttcgatcgaggtgggttccagtaccacggtcggatcgcggcgttggccgacgcggctcgcgaagcgggattggagttctaggtggcgacaaacgagttcgaagaccgcaccatcaaggtcaatcgggtatcgaaggtcgtcaagggcggtcgtcgattctccttcacggcgctcatggtcgtcggtgatcacgcgggccaggtggggctcggctacggcaaggccaaggaggcgagcctcgccgtgcagaagggggtcgacgaggccaagcgcaagctggtgcgcgtgccgctcgtccacgggaccatcccgcacgcggtggtcggcgtcgcgggagcggggagggtcttgctcaagcctgccgcacccggtacgggtgtgatcgccggcggtgctgcgcgcgcgatcttggagcttgccggcgtcaccgacgtgctggcgaagtccctcggttcctcgaacggcattaacgtggcctatgccacactcgcaggactcgaggcgttgctctcgccgcagcgcatcgccgaggctcgtggtcgttacgtggatcaagtcgctcctcgatggctcatcgaggagagtccggcgcgtgtcgatggagaagtcgtggaggttggggccgatggctaggcagctgcgcatcgtgcaggtccgctcggcgatcggtgccaagcccgagcaccggggcacgctgcgcgcgctcgggctcggacgcatcgggcgggagcgtgcgctcccggatcgtcccgagatccgcgggatgctggctcgcgtcgcccatctcgtcgtcgtccgtgaggaggaacaggcatgatttacctccatgatctcaagcccgccgagggttcgcaccatcgcaagcggcgcgtcggtcgtggcatcgcgggcaagggcggcaagaccgccggccgcggcacgaagggtcaaggcgctcgcgatacggttcccgtcggcttcgagggcggccagctgcccttgacgcagcgcacgccgaagctgcggggctttcgcaacccgttccgggttgcctatacggtcgtcaacctcgaccagcttgctcggcttggcgaggagggcatggccgaggtcgatccgacgtcgctggtcgcgcgcggggtggttcgtcgcggcgcgctcgtgaaggtctgtgctcgcggagagctgcatgcacccctcgtcgtgcgcgcccatgggttctcgcaggcggcgaaggcggcgatcgaggctgctggcggccgtgtcgagacggtcgcggtccccttcaagggtcctcggcctcgcgctgccggcagcgcgttgtccaaccgctgagcacgatcggcggggaggcaccgtgatcgagaatttcctgaacatcgtccgggtgagggacctgcgcaacaaggtcctgttcacgttggcgatgatcggcctgtaccagttgggttcgaacatcccggtgcccgggatcagctaccacgcgatccaacaggtcttctcggaggcctcgggccagggtgtcctcggcttcctcgacctcttctctggcggtgcgctgtcgcgcgcggcactgttcgggttgggtgtgatgccctacatcacctcgtcgatcatcatccagctgctcaccggcgtcattccgaagctctatcagtggcgggacgagggatcgtctggcgagcgcaagatcacccagacgacgcgctatctcaccatcgggctcgcgctcgtacaggccactggcctcgtgttcgtgttccactcggggctcggcctgttccttgcgaacggtcagagcgtggacctgatcccgcagttcacggtgttgcgggtgctgttcatcattctgaccctgaccgccggtacggcgctcgtgatgtggatgggcgagctgatcaccgagcgcggggtcggccaagggatgagcatcctcatcttcgccaacgtcgtgagcgtgatcccgaccgcggggcgcctgatctatgaccaggcgggcgcgctcaagctcatcgtgatcgtggtcgtggtggtcgcgctcctcgttgcgatcgtcttcgtggagctcgggcagcggcgtatccccgtcgtgttcgcgaggcgcgtcgtcgggcgtcgcatgtacgagggcgggcggacgtacatcccgctcaaggtgaaccaagctggggtggtgccgatcatcttcgccgcctccatcttgtacttcccggtgctgctctcgaacatcgtgcgctggaagccgctcgtcaccttcgtcaacgatcacctgctcaacgccacgagtggcttctacatcgtgacctacgggctcttgatcttggtcttcacgttcttctacgtgacggtgtcgttcgacccgtaccagcaagccgacatcatccgacagcaaaacggctacatcccgggcgtgcggccgggcgaggagaccaggcggtacctgtctcggatcttgaaccgcatcaccctcccgggcgccgtgttcctcgctgccgtcgccgtgatcccatcgattctgctcgctgcgtggcacgtgacgtcgttcccgtacgcgggtacgaccatcctgatcgccgtcggtgtcggtctcgagaccgtgaagcaggtgaactcacaactcaccatgcgcaactacgagggattcttgcgctagatgggggacgcggcacttcggcttgcgctgctcggtcgacagggcgcgggcaaaggcacgcaggcggtgcggatctcgcaccactttgcgatcgcgcacatcgccactggggacatcttgcgagctgcggtgcgcgccggtacgccgttcggggagaaggccaaggcctacctcgatcggggcgaactggttcccgacgcggtgatcatcggtgtcgtcgccgagcgcctctccgaggccgatgcgacgcgacggggcttcgtcctcgacggctttccacggaccgtcgagcaggcggaggcgctcgagggtctgctcgctccgcatggactcgacgtcgtgatcgatctcgaggtgcctgagtggctcgtgctggagcggctggcgtctcgccgggtgtgttcggtgtgcggtgccaactactccacgtccatgccgcctcgggtggactggacgtgtgacctgtgcggtggtgaggtggtccagcgtgcggacgataccgaggaggccatccgacgccgcctggacgcctacgagcgccagacgaccccactcatcgagtactaccgggagcgggagctcctcgaggtcgtcgacggtgtcgggggcccagaggaggtcatggagcgcatcctcgaggcacttgcccgacacggtgtggtggaggagggtcgatgaggcgttcggcgacagagcttgcgtcgatgcgcaaggcggggcgcgtcaccgcagcgatgctggaggcgacccgtgaggcggtcaagcccggcatctcgaccgcagccctggatgcgatcgcgcgctcggtgctcgagcgcgagggtgcgcggtcgaacttcctcggttacggcgggttcccggccgtgatctgcacctcgcgcaacgaggtcatcgtgcacggtatccctcgagaggacgagatcctcgaggagggggacgtgctgtcgatcgacgccggcgcgatcgtcgacggctaccacggagacgccgccatcacggtgcccgttggcgaggtctcgaaggctgcggcccgcctcatcgaggtgacccgtgaggcactgtgggcgggcatcgagaccatgcggccggggtcacatctccacgagatcggccgagccgtggaacgcgtggcgaagcggcaccactacggcgtgatccgcgactacgtggggcacgggatcggcaccgagatgcacgaagccccgaacgtgcccaactactggcccggtacgcccggccccacgctcctcgccggggaggtgttcgccgtggagcccatgttcacgctcggcacggaacgcacgagggttctgcgcgatggctggagcgtggtcaccgccgacgggacgtgggcggctcacttcgagcacaccatcgcggtgacggaggacggacccgaggtcttcaccctgggcccggatggccgttgaggcgagcgcactatactgcgtaggcaccggttttgcgcccgtcgccacgtcgtggcgtgtccgggcacgaacgatcgagagtaggaggacccactggcaaagggcaaggaggacacgatcgtcctcgagggcacggtggtcgagccgctgccgaacgcgatgttccgtgtcgagctcgagaacgggcacaaggtactcgcgcactcctcgggcaagatgcgcatgcatcgtatccgcattcttcccggagatcgtgtccaggtggagttcaccccctacgacctcacgagggggcggatcacctaccgctacaagtaggtccggagccagcgggtgcaaggtcgacggatcggttccggccagatccgtgtactgacagagaggaagccgacgtgaaggttcgtccgagcgtcaagccgatgtgtgagaagtgcaaggtgattcggcgcgagggtcgcgtgctcgtgatttgcgagaacccgcgccacaagcagaggcaggggtagacgatggcccgtatcgcaggtgtcgacatcccgcgtgagaagcgggtcgaggtcgcgctgacctacatctacggaatcggcccgacgctcgcgcgtcaggtgctcgaggccaccggggtcaatcccgatacgcgcgtgcgcaacctcaccgacgaggaggtcctcgcgctccgcagctggatcgatcagaacctgaaggtcgagggcgatctgcggcgcgaggtcgaccagaacatcaagcgcaagatccagatcgggtgctaccagggtatccgccatcgtcgcgggctgccggtccgcggacagcgaacccacaccaacgctcgtacccgcaaggggccgcgcaagacggtggcgggcaagaagaaggcacgccgctaggcgctcatgcgggcacgcgagcgtgctcgcggtgggcgaacgagtggagccagagtctctggctccgagggatgaacgagggaggttccccgtcggcgtggccggcacgggggaaccgaagaggacgcgagctgagcctcgccgagcaaggagcacacagagcgcatggcacgaccgaaggtaggagggcggcggccccggcggcgcgaacgcaagagcatcgcgcgtggggtcgctcacatccactcgtcgttcaacaacacgatcgtcaccatcaccgacccggctgggaacgtgatcgcgtgggcgagttctggcaacgtcggcttcaagggatcgcgcaagtcgaccccgttcgccgctcaggtcgcgggtgagacctgcgccaagcgagcgatggagcacggtgtgcgcgaggtggatgtctacctgaaggggccgggatcgggccgcgagacggcccacaaggcgctcgctggtgcggggatcgagattcgttcgatccgagacgtgacacccgtgccgcacaacggctgccgtccgaagaagaggagaagggtctagatggcgcgctacaccggaccggtgtgccggctgtgccggcgtgagcggacgaagttgttcctcaaggggccgaagtgcatgagcgcgaagtgccccattacccaaggccgggttcctccaggccagcatggtcgggatcggcagcgtcaaccgtccgagtacgcgatccagctgcgcgagaagcagcgcgcgcgccgaacctatggcgtcatgggcaagcagttccagcgcttctatcgtgacgcggcgcggcggtcggggatcacaggcgagaacttgctcgccttgctcgagcttcggctcgacaatgtggtcttccgtgccctgtggggctcctcacgggcgcaggcgcgtcagctcgtccgccatggccacgtcctcgtcgacggtcagcgggtggatatcccgagctatcgcctccggccggggcaggtcgtgacgctgaatcccaaggcgcgtgacctcgacatcattgcgttcaaccgagagcacctgacccgtgaggtcccggcgtggctcgaggtcaccgacggggggtctggagtacgcgtgctcagcgtgccgctgcgcgaccagatcgacaccgaggtccgcgagcagctcatcgtcgagctcttctccaagtagcacgcttctcgaagtagcgaggcagcaaccatcagtcagaaggaaccaaccatgcttgtcatgcaacgccccacggtcgagtcgctcggtgacgaggtcgacaatcgtcaacggttcgccatcggaccactcgagccagggttcggccactcgatcgggaacgcgctgcggcgtgtgctcatctcgtcggtcccgggcgcggccatcacgcaggtccgtttcgatgatgcgctgcacgagttcacgacgatccccggggtgaaggaagatgtgatcgacatcatcttgaacctcaaggacatcgtgtggcgttcgtggagtgaagagccggtcacggtgaggctcgacgttcgtggccccaaggaggtcacggcgggagacttcatgctcccctccgacgtggaggtcatcaaccgcgatctccatatcgcttcggtgtcggagcacggtcggttgggtctcgatgcggtggtcgagcaggggcgcggctacgtgtcggcggagggcaacaagcgcaccaccaccatcggcatcatcgcgatcgacgcgatcttctcccctgtgcgtcacgtcaactaccgcgtcgagccggttcgtgtcggtcagtcgacggacttcgaccaggtggtgctggaggtcgagaccgatggctccgtgacgccacgggaggccgtcgcctctgcggcccggacgctcaccagcttgttcggcctcgtcgccgagctcgcgaccgacgtcaatgcgctcgaggtcgccgcgaccgccgacgacagcgtgcgaccggccgagtacgacctccccatcgaggaactcgagctcacggagcggccgcggaactgcttgaagcgggcgagcatcaacaccatcggtgatctggtcgagcgcacccctgaggatctgttgtcgatcacgaacttcggccagaagtcgctcgacgaggtcgtcgagcgcttgacccagcgcggacttgagttgaggaagagggactgacgtggttccaggtcgaccgaagaagggtaaccgactgggcaaggacgctgcccaccagcgagccatgctggcgaaccttgcggcgtcgctcatcgaggccgagtccatccagaccaccgaggccaaggcgcgagccctgcgcccggtcgtggagaagctcgtcaccaaggcgaaggcgggcgatctgcaccgtcggcggcaggtgttggcgttcctgcgcgacgaggatgcgaccaccaagctgttctcgaccgtggggccgcgctatcagaatcgacagggtggctacgtgcgcgtcttgaagctcggcccgcgtcgtggcgatggcgcccccatggtggtcgtcgagttcgtctgaccggcgctcctcgcgcgaggcggcccctgcgtggtggtcggtctccgggaggtgtcgacgggtaggagcccaggtgggagcagtggagaccctcctgctcgtcgttggctacgacgggcgggagttcgcgggcgctgccccgcagccgggagtgcggaccgtcgtcggtgcgctgcgctccgcgctcgagctcgtgttgcaacgaccaacgtcgcttgcgatcgcaggtcggacggacgccggtgtccacgcgcgtgcgcagctcgtgagcgtacccctccagcccggggagcgggcgcggctcggggatgtggagcgtctgtgtgggcgactcggtcgactcgccggtcgggggctctgggtcaggagcgcaggcgtgctccctgggtccgtcgacgcacgcagggtcgcccgctggcgacactacctctaccggctcgatctcggccatggggaccgtcggggtcgggtgatactcgagccgacggcctgggcgtgtgggccgctcgagctcgacgtgctcgctggcgcgctcgcgacgttgcgaggcgacctcgatgcgaccggactgtgtcgtgccggcgccgcgggaggctatcgtcgcagggtgctctcgacgcgggtctgggcgcgcgcacgagatcgtgtcgacgtctccgtcatcggggtgtcgttctgccacgagttcgttcgtcgagcagtcgggaacgcggtcgcggtggcgcagggccggctcgacggggagcgctggcgcgagggtgtcgaccgaggcgagcgggcgctgctcgcgacggtggcgccaccgtggggcttgtcgctgtggcgcgtcgggctcgaggacggctgggagtggtcggaggagcgactcgcgcgcctggggtcggatgccgactggcgtacgctcgatccgcgcgaagagcccgcggtgtggggcgcagcacgaggcgcagaccggtagactgtcgcggtgcgctcacgcgggcgtctcgctgtgggccgcgcgtgagtgcggcgctcgaggctgaacgcagtgacgagcgtcgatggcgcgggcaccgacggcatggtcggtcgaggcagtggtcggtcgagcccagcggcgtctcgtggttggcgggcccggagcgggttggcgtggaaaggacttcggcggtgaggacgtacagtcccaaggcggctgagatcagccgcacctggtgggtggtggacgcggaagacgtcgtcctcggacggctcgcaaccgaggtggctcgggtgttgcgcgggaagcacaagccgacgttcacgccgcatctcgacatgggcgatcacgtcatcgtcgtgaacgcggacaagatccgggtcacctccgacaagggtgccacgaagcgctactggcgtcactcgggttatcccggcggcattcgctccgagacgctggcggaacggctcgcacgccaccccgagcgggtcgtggaggccgcggtgcggggcatgctcccgaagaatcgcctcggcagggcgatgtatcgcaagttgaaggtctacgccggccccgagcatccgcaccaggcgcagcagcctcgagtcctgtcgctcggtcagccgagcctcgtcacccaaggggagcacgcatgagccagacgctcgttcaggccacgggccgccggaagacggcggttgctcgagtccgtctcgtgccagggtcgggttctgtcatggtcaacggcaaggagctcgcatcgctcccggtgacgctggcccagcgtgcgttcatcaccgaaccgctgcgactcgccgaactcaccgagacctacgacgtcgtggcgcgcgtggacggtggtggcgtcgccggtcaggtcgcggcgctgcgccacggccttgcgcgagcgatcgcggaactccaccccgagctgcgcgtgcgcttgaagcgcgagggcatgctcacgcgcgatgctcgtgagaaggagtcgaagaagtacgggctcaagaaggctcgcaaggctccgcagtactccaagcgctaatgctgaccttcggcacggatggtatccgcggccgagccaaccaggagctcaccatggaggtgggcctctggatcggggtcgcgatcgccgaggtgctcggtggcaccacggtcgcgatcggtcgggacacccgtgcgtccggtcgctggctgtccgaggccgtgggtctggggctcgccgcttcgggcgtggatgtggtcgatgttggggtggccccgaccggggcgctctcgttcgttgcgcgcaccgagcagctcccgaccgtcgtcgtctcggcgtcgcacaatccgttctacgacaacgggatcaaggtgttcgctcccacgggagccaagatcgagcccgccgtcgaacgtgccatcgaggagcgtctcgcgacgcatcttggtggcgatcggccgacgttcggacctctcggccgctaccggtcgtcgtcgttcctggacgcctacgtcgcttggctcgccggtgccgtgtcgatcgagggtgcgccacgcgtgtgcatcgatgcggccaacggtgccgcggcggtcgtcgcctcgcgtgtgctcgaggccgctggtgccagggtcatcggtgccatcggggtcgagccggacggtgagaacatcaacgcgggcctcggagccctgcaccccgagaggcttggccatctggtgctcgcgacgggcgccgatcttgggctcgccttcgacggtgatgctgatcggctgatcgccgtcgcgccgagcggagcggtggtcgacggtgacgacgtcttggtgatcgtcgccgaggcgctggcggccgatggtcggctcgcgggccctggcgtggtcgcgaccgtcatgagccatctggggctcgagcgcaccctcggaccgcagggcatcgcggtggaacggaccggtgtgggcgatcgcgaggtcgctggagggctcgtcgagaccggctacgggctcgggggtgagcagagcgggcacatcatcttccccgcgctcgccccgaccggtgatgggctcctcacggcgctcatgctgctccaggcgctcggtaggctcggcgtccatgccgacgaggccttggcggcccgcgtgcgctacccacagatccaccgcaaggtccaggcacggcacggccgagccgtgctcgactcggagctggtggtcgaggcgctgcgcaaggccgaggagcggctcggcgaggaaggccgcttcgtcgtgcgacccagcggtaccgagccgatcgttcgcatcatggtcgaggcgacgacggagccggtcgcgatcgaggtcgccgagtcgatcgaggcagcggtgcgcctcgcgacctcgacccttggcgactgagcgcggctacgctcggtcaacgaccaggtccgcgcgtggcgcgggcagaaggaggccggtgtgtgcgggatcgtgggagcagtcggcaccggggatatcgcgggtgcggtcttcgaaggcctgcgacgactcgagtatcggggctatgactctgcgggcctcgccatcgtcgacgacgctgggatcatcgaggtcgccaaggccgcgcacgcgcgcacctcgctcgccgagctgaaggacagcgtggatgcgttcgatggtcggggggcgcgtgtcggtgtcggtcatacgcgctgggcgacccatggtgccccggtgctcgtgaacgcccatccccacctcgattgcacccatcgcgtcgcggtggtccacaacgggatcgtcgagaacttccggagcttgcgtgaggagctcctggagcggggccatcgtctcgtctccgacaccgacacggaggtgatcgcgcacctgctcgaagagcagctcgtcgatgaggcgcccgacgtggcgctcgcgtcggtgttcgcgaggctcgtcggccacatggcgatcgcggttgcgctcgccgaccatccggggctggtactggcgatccggcgaaccagtccgctcatgggtgcgcgcagcgtcgatgccgagttcgttgcgtccgacgtccccggggtcttgcaccgtgccacggagttcttcgaggtgcccgaggacgaggtggtcgccatcggtccggaggcggcgggcctgtcacgggctcggcgcctcgaggaactggtccgaccccagatcagctggacgagccaagacgtggaactcggcgggtacgcgagcttctacgagatggagctcgccgcaggcgccgaagcgctgtcacagacggtcgcgtcgttggtcgacgtggacgggtcggcgatcatggacgccctcgacgtcgatcccttcgagctcaagcgcatccgcaaggtcgtcgtcgtcggggccggcacgagctaccacgcgggcctcgtcggccgtttcgccatcgagcactacgcgcgcgtgccggtcgaggtggacgtcgcgagcgagtaccgctatcgcgatccgatcgtcgacgacgggaccttggtcatcgccgtgtcgcagtcgggggagtcgctcgacaccatcgtcgcggtccgtgaggcgatggctgcgggtgcgcgcgcgatcgccatcacgaacgtggtcggctcgcagctcgctcgggtcgctgacggcgtcctctacacgagggcagggcccgaggtctcggtcgcggcaacgaagacccacctcgcccagctcgccgccctcgagctgctcgcgctctggctcggggagctccgcggcgtcttgttccccgaggaggccatcgagcggcggcgggcactcggcgaggtggcacaggcggtcggatccgtcctcgagcagaccgaagcgctcggagcgacgttccgcgagctcgcatccagccaacggttcttcttcatcggccgcaacgtcgccctcccggtcgcgatggaaggggcgctcaagctgaaggagttgagctaccttcctgccgaggcgtacgcggccggcgaactcaagcatggaccgatcgcgatgctcgatcgggaggcggtggtggtcgccctcgttcccgccgaccgactgcggccgaaggccctcgccaacctcgaggaggtcaaggcgcgcggtgccaccctcgtcgcggtggtcgcgggtgaggacgcgcgcgtcacggagttgtccgacgtcgtggtcgaggtgccggcgacgccgccactgctgttcccgttcgtcggcgtcgtgccgctccaggtcttcgccggcacgatcgcgcgcgaacgcggactcgatctcgaccgccctcggaacctcgccaagacggtgaccgtcgagtagggcacctccccgggtccgcgaccgccgtggaccaccagcgggtggcgcctcgcgaatcggctcgactcgaacgtcggggttgcatgctccacacgacgcagcaccgctcttcggagcggtgctgcgtcgtgtgggaggctgcgtgcgtgcgcgctgcgctcagtcggcgagggcgaggccggtcactgatcggcggcgatcggcgatcgcagcgtgcagggtgcggagcgccaccatcgtccacagggcgaccagtgcgacggcgagcccgaccgcgaggtcgtggatcggggagacgtgggtcgcgatcgcgatctcgccaaccccagtcgtgaggacgccgagcgggaaggtgaagccccaccagccgatcgtgaagggataggtgccgcgccgtaggtactcgagggagagggcgccggcgacgaggagccaccagaggccgtagccagcgaggatgagcgcgccgacgacaccggcaccagcgagcgtggtcgagagcgcggacggcgtgagcacggtgagatcgtgaccgagggcggcgatggcggcggccccggtaccgagcgggccgaggatgagccaggtcgatgtggcgaggtgcggtgcggggaggtgatgggtgacgaggcgaagcgtgatgagggcgatcagcgacaacgcaagaggcaccgagaaggcccagaggagatagccgccccagacggcgtcgaccgcgagtgcgtggtcgaaccggggcgcgacgagcgcgagctgaaaggccgtgacctcggcggggacgatcgggaggagccaggttgcgttgacgtcttcgagcgtggcgagatggtgcgcgaagaggcggtagggcacgtagaggacggagacgagggtcatgacgagcgtgaggacgagccacacgcccagcccttcggtcgtcgcggcgtgggagcccagcacgttgggttcgagcttgtcgatgccgttcgagaccgacgacatcgccatcggcacacatccaaggaacagcacccgtgcagggttgtcgaggagctggcggaggcggaggcggtgccgggcaaaggtgatcacggtgatgagcgcgagtatgaggaggccgatcgcgttggcgacgacgatgatccggccgatggtcgtcagggcgggcgagatcgtcgggagcaggacaccgacgatgccggtgcccatgatgagcgagtagtactcgaagccgagtgagggcaaccgtcgagcggtgggccgagatgcggtgtggttcatcgatgctcctaccgtgggttggaagtggtttcgtgctgtgaactatcatggcggtagcgaaacgaaggtatgctaaaagtaatgaaacttactgattccatcactgagcgaatgattacggtcgacgagcgccggatcgatccgacgtacctcgtgacgctcgccgtggtggccgagacgcacaacctctcggacgcagcgaagatcctcggcatctcgcagcccggcgtttcgcagcagctcaagcacctctccgaagccgtgggccagcgcctccacgtccgctcgggtcacggggtcgagctgacggtcgcgggtctcgatcttgcgcggcgggctcgtgacgtgctgcgctcctggcgaggcgtgctcgactacgtcgagagcgtccgccagggcaacgacggcatgctgctcttggccgcgtccaacaccgtgtctgcctacgtcgtgccccgctggctggttcggttccgccagcgctatcccggcgtcgacctgcggagccgttcgctgaactcggccgaagtcgtcgagcgcgtcatcgacggcgaggccgaggtgggcgtgatcgagtcaccggtcgagtcgttgccccctgagctggtcgagatcgtggtgggcggcgatcgcctcgtctacgtggtcagtccggcagtggtcagcttcgcgaacaaccaggtcgtcggttggggcgaagtggcgaggatcccgctcgtgctgcgggaagtgggttcgggtgttcgacgcgccagtgagcaggcactgcgcgctcgtggactggccccccggctcgagctcgagctcgctggcggtgaggcggtcaaggaggcgatcctccagggggtcggcggtggcttcttgtcgtcgctcgcggtcgcgcgcgagctcgcgaccggtgagctggtcacgctcgtcattcgcgagctcgataccatcgctcgactgtttcgcatcatctgtcggcccaaggacgacctctccctgccggcgcagcgctttctcgagatcgccgaggcggtcggcgttgcggagccggtctagatgcaggtcgtgaccgggatcgacgtggtcgaggtcgaacgcttccggacggtgctgctgcgaacaccgaccctcgccgagcgcgtcttcaccgaggccgagcgcgacagcgcgaagggtcgaccggcccagctcgcggggcgcttcgccgtgaaggaggctgcgttgaaggcgctcggcgtcgggatcggtgcggtccccttgcgcgaactcgaggtggtgtccgatccgtcgggggcgccgcgactcgagctcggccccggggcgcgagccttggccgatcgacgaggctggtcgtcggtgagctgttcgatctcgcacgagcgttcggtcgcggtggcggtggtggtcgccttggtggtctgatcggaccgatgccctaggcttggcgctcggcccggaggaggccgccactgggcgatcactgggccgccactggggaggtgtgcgtgcaaccgatcgtccgacgtgctggcgtccgagccctcgacgagcgactggcccgcgagggcctcgtggacgcgacgatcgaacgggtcggccgcgccgtcgcgcgtgagctgcgtcgatccaggggagggctctacggtacccgcgtcgtcgtgatcgccggtcccggtaacaacggtcgcgacggcgtcgccaccgcgcgagcgctcgcgggctggggagcgagtgtgcgggtggagtcccttcgcgacgtggtggcgggcgcggcgaccagcgccattggcacctgcgacctcgtcgtcgacgccgcactcgggaccggtccggcgcggccgctctcgccgctcggcctcgagggcgtccccgaggtggtcgccatcgacattccgtcgggtatcgatgccgacacgggcgaggtgacgggggcggacctcggaggcgtggccgtcgtcgcccaccgcacgatcaccgtcggggcgctgaagcccggcctcctcgtgggggaggggccggagcacgccggtgccatcgtccgcgtcctcgacgacctcgtgcccgaggacgtggatgcctggctcgtcgagcgcgacgacgtcggccaggtgctgccgaggcccggacgcgatgcgcacaagtggcgcagtggcctcttcgtgctcggtggctcaccgggcatgcgcggcgccccggccttcgtcgcgcgcggggcgcgagccgtcggtgccggcatcgtgcacgtgctcaccaggagtgagcccatggagtccgtggcgctcgagatcgcgcccgaggtcgtcgcgagacgtctggtgaccggccacgtggatctcgcggtcgccgaggctgagcgcttcggcgcggcggtgatcggacctgggctcggtgacaccttggcgagcgcgaacctcgtgcgtcgcgtcgtttccggtctcggggtgcccttcgtgctcgacgccgatggcctcacgtcgctcgcgggcgagggtcgtctggcatcggtgctggcccagcgccgcgcacccggcgtcatcacgccgcacgacggggagctcgcccgggtggccccgcaccttggtggtacccgtatcgagcgcgcgaagggcgcggcggccgagttcggcgtcgtcgtcgtcgccaagggcaacccgaccgtcgtcgccgctcccagcggcgagaccatggtggtcgctgccgggacggcacggctcgcgagcgcgggcaccggcgacgtcctcgcaggcgtgatcggcggtctccttgctcaggggctcgatcccctgcgtgcggcgtgggcgggtgcgtggctccatggcaccgcgggcgcgcagcttgccatgcgcctggccgcaccgacggcgctcgcggatgcgatcggcaggctcgtcgcccagatggtgccgatccccgcccatccgggggcctccgtggaggcgcgcccgtgatcggccatcgaccgacggaggcgcggatcgatctcgagcggctgcgtgcgaatgcgcgtctgctcgccgagcgtgcagctccggctgcgctcagcgccgtcgtcaaggccgatgcgtacgggcacggcgcgagcacggtcgctcgcgccctcggcgatctcgtcgacgccttctgcgtcgccaccgtcgaggagggcctcgcgctgcgtgccgcgggggtcacggggcgcgtgctcgtcttgtccgagcctcccgagtcggccgtgtcggcgtgtgctgcgagttcgctcgagcccttcgtcgagcacgagcgcttcgtggaggcgttggcgggggcggcctcggcgctcggccgcgaagcctcggtccacatcgacgtcgacacgggcatgcatcgaagcggtgtgcacccggcccaggcggccacgctcgccgccagtgctcgtcgccacggcgtgcgcgtcgtcggggtcgcctcgcacctggttcgtgcggacgaagcgcccacgcatccgacgacgctcgaacagctctcgaggttccgcgaggtcgcggctcgtatcggggcgcctgagcgacacctgctcgcgaccgggggactgctcgcactgcccgaggggcgcttcgagcgggtgcgcgtcgggatcggcctgtacggctatggacctcgacgcgacgatgtggcgggactgcgtccggtgctgcggctcgtgagccacgtcgttcgcttggaggcccttggcgccggtgaggcggtgtcctacgggcatcgaaggccactcgacgtgcccgccgaggtggcgacgctgcccattgggtacgccgatggcgtgcctcgcgccgccttcgacgcgggcctcgccttctgggccaagggtgtccgactgccgatcgcaggcacggtgaccatggaccagaccatggtggcagcgccacgggggctgctcgccctcggcgatgaggtctcgctcatcggggacgaggtggatgcctgggagtgggcggacgtgctcggcacgatcccctatgaggtgctcgcgcggctcgggccgcggattccgagggtggtggagcatgggactgcctgagctcgaggcgctcgaggccgaggttcgcgcgtgccacgcctgtcgcttgtccgcgggtcgtcatcaggcggtgcccggcgagggcgccgcgcccgcaccactgctcgtcgtcggcgagggtccgggggcgcgcgaggacgaactcgggcgccccttcgtcgggcgctcggggcagctgctcgatgccctgttggctgatgagaccggcctcgatcggagcggcctctacatcgccaacaccgtcaagtgtcgccccccgggcaatcgcacgccgaggccggacgaggtcgaggcgtgcaggggcttccttgcgcgccagatccacctggtcgatccggtcgtgatcgtcgcgctgggccagagcgcagcggcgtggttcctcggacccggcgcccgcgtcggcgcgctccgtggccaggtgctcgagtgggaaggacgagcgctcgtcgtcacctatcacccatcggcggcgctgcgcggcggtgcggccatcgtcgccgcactgcgcagcgatctcgcccgcgccagcgtggcactcgcggagcgacgtcgatgagcgtgccagggccagcccctcgtcgcgaggagatgctcgtcgacgccgaggcgaccgagcggttgggggagcgcctcggtgtcgagatgccgcccggtgcgatcctcggtctctcgggcccgctcggagccggcaagaccacccttgcccgtggtgcgctgcgagcgctcggcgtgcgagaggcggtggtctcgccgacgttcctcggcttgcggcgctacagcacggccgattcgggcatcgtgtaccacatcgacctctaccgcagcgaggatgcgacctggctctggggcgagggcgtcgacgacgacctcgacgacggcgcgcgtgcggtcgtcgagtggatcgatcgtgaccggcggctcgcggccgacgcatgggccatcgtcgagctggacgtcgtcgagctcgacgatggccagacgggccggcgcgcgcggattcggaggcaccggtgagcgccgacgaggtgacgctgctcgcgctcgatctcgcgacgaggccgagcatcatcgcagctcgggtcgctggagtgacgcaggcggtgcgtggtgtctccacgcacccgctcgccgacctcggcgcccgcgtgcgcgacgtgctcggccaggcgaccccggaggtggtgggcgtggtgaccgggcctggttcggtgctcgggctgcgcgcaggcgccgcgttcgtgcggacctacgcgagcgcgaccggtgccacactcgtcccgttgcacaccggtgaggccgtcgcggccagtgtgcccgacgagccggtgctctgggtggtcgcgcccgtgggtcgtgggcgcgtgagcctggtggcgaccgagcgtggtcaagtcgtatcggaagcgatcgtcggtgtcgaggagctgcggatcccgcgtggcgagccggtcgcggggccgggtcttgctcgcggactgatcggggaggggcgatcgaccggcgtcgtcgagccgaccggcaatggtctcctcgccgccctggtgcggcggtggcgagcgggcgagtcggcagatccccattcgctcgcggtgcgctactcggtggacgcgggggttcgcttgccgcgacgcttcgcagagggcgggggtcggccatgatgacggtgcggccgatgcggcccgaggacctcgacgcggtgctcgcgatcgaggagtccgtgtcgcgcgtgccctggagccgacggtccttcgtggacgagctcggtgccgagggacgcctctggcgcgtcgccgacgagggcggcgtcgtgcgtgggtacgtcggcgcgctcatcgtcgtcgacgaggcacacgtcctcaacgtcgcggtggcgcgagaggcgtggggtcggctcatcgcgacgcggttgctgctcgacgcgctcgatggcctcgatgcgctcggggtgcgtgactgcacgctcgaggtgcgcgtctcgaacgcgcgtgcccaggcgctctatcggcgtctcggtttcgctccggtggggctcagacgggcctactaccccgacaatgacgaagacgccatcgtgatgtggctgcgcgatctcgccgcaccggcatccaaggagcggttggccgcggtccgcctcgacctcgaggggggtgctcgatgacgagtgcacgcagcctggaccggctcgagctcgtcgacgcgggcgtcgtgctcgcgatcgagaccagctgtgacgacaccgcggtggcggtcgtggccggtggtcgggtcgcggccaacgtggtgcgctcccaggccgcgctgcacgctccgttcggcggggtggtgcccgaggtcgcggcccgggctcacgacgccgccatggtcgaggtcgtcgaggaggcgctcgccgagtccggcatcgacgcgcacgaggtggaggccatcgcggtgaccaagggtccggggttgccgggatccctggtcgtcggcgtgggcgccgcgctcggccttgcggtggggctcgatcgaccgctcatcggtgtcgatcacatggagggccatctctacgcagccaccatcgaagggcccgtcgccctgccggcgctgagtctgctcgtctcgggcggacactccgagctcgtcgtcatcgaggcgccgtttcgctatcgcctcctcggccgcactcgcgacgacgccgcgggcgaggccttcgacaaggtcgcgcgcatcctggggctcggctttccgggaggccctgccatcgaggccgcggcgcgcgatgggcgtcccgacgcgattcgctttgcccgggcgcttcgcaaccaggggttcgatctgtcgttctcggggatcaagacggaggtcgctcgctatctcgaaggggctcgggcggccgaggtcgccgacgtggcggcctcgttccaggaggccgtcgtggacgtgctcgtggccaagctcgagcgtgcgctcgagagcgagcgggtcgagaccgtcgtgatcggcggcggggtcgcggcgaacgggccgctgcgcgagcgggtagccgagctcgcgcgagcaaggggtgtcggcgcgcacatcccggccaggagcctctgtgccgacaacgcggccatgatcgccgctgcgggtgcggcacgcctcgtcgccggcgagcacgcggtcgatggtctcgacatcgagccgacacgaagcctcgtcggaggtgacgaccattagcactcggcatgctagagtgctaatggtcgctgacccacatgccagtccactcaccgatcaaggaggcatgagcatgaacctgcagccaatggaggaccggatcgtcgttcgtccggccgagtctgaggagcggaccgcgtccggcctcgtgatccccgacaccgccaaggagaagccgcagcagggcaccgtgctcgcggtcggccccggcaagcgggccgagcagagcggcgagctgatcccgctcgacatcgccgtgggtgacacggtggtctactccaagtacggcggcaccgagatcacggtcgacggtgaggatctcctcatcctctcgagccgtgacgtcctcgccaaggtggtgaagtagcgatgccgaagatcttggagttcgacgagtccgctcgtcgtgcgctcgaggcgggcgtcaacaagctcgccgacaccgtcaaggtgacgctcggcccgaagggccgcaacgtcgtgctcgccaagagcttcggcgcgcccacgatcaccaacgacggcgtctccatcgctcgcgagatcgagctcgaggaccccttcgagaacatgggtgcccagctcgtcaaggaggtcgccaccaagaccaacgacgtggctggtgacggcaccacgaccgcgaccgtcctcgcgcaggcgatgatccgcgaggggcttcgcaacgtcgcggctggtgcgaacccgatggccctcaagcgcggcatcgagcaggcggtcgcggccgccgtcgagtccatcgccgagcaggccaagccggtcgagggccgcagtgacttcgcccaggtcgctgccatctcggcagccgatcaggcggtcggcgaggtcctcgccgaggccatcgacaaggtcggcaaggacggcacggtcaccgtcgaggagtcgaacaccttcgggctcgagctcgagttcaccgagggcatgcagttcgacaagggctacctgtcgccgtacttcgtgaccaaccaggatcgccaagaggcggtgctcgagaacccgtacatcctcttctacgcgacgaagatctcctcgatccacgagctgctgcccgtgctcgagaaggtcatgcaggccggtcggtcgttgctcatcgtcgcagaggacgtcgagggtgaggcgctcgcgacgttggtcgtgaacaagatccgcggcaccttcacctcggtggcggtcaaggcccccggcttcggcgagcgccgcaaggcgatgctgcaggacatggcgatcctcacgggtggccaggtcatctcggaagaggtcggcctcaagctcgagaacgtcacgctggatctgctgggccaggctcggcgcatcgaggtgacgaaggacgagacgaagatcatcggcggcgccggtcagaaggcggacgtcgatggtcggatcgcccagatccgtcgtgagatcgaggagaccgactccgactgggaccgtgagaagctccaggagcgcctcgccaagctcgccggtggtgtcgcggtcgtcaaggtcggcgccgcgaccgaggtcgagctcaaggagaagaagcaccgcatcgaggatgcgctctccgcgactcgtgcagccatcgaggaggggatcgttgccggcggtggcacggcgctcattcgcgctcgggcgcgcgtgaacgacgtggtcgccaagctcgagggtgacgaggcgacgggcgcgaccatcgtggctcgttcgctcgaggagccgctcaagtggatcgcctacaacgcgggcatggaaggcccggtggtggtccagacggtcgagcacgagtcgggcaacgttggcctgaacgctcgtaccggtgtgtacgaggacctcgtgaaggccggcgtgatcgacccggcgaaggtgacgcgctctgcgctgcagaacgcagcgtccatcgcggccctgctgctcacgaccgaggcactcgtggccgacaagcccgaggagccgggtcaggcggcggccggcgctggcgcagccggcggcatgggcggcatgatgtaaggcgagccacgctcgtcgcacgaggggagggtccgcaaggatcctcccctcgctgcgttcgtggcagcgtgcgatggtctcgagggcggagaccaagccgttggggcgcgcacgggcgccgccacgatgggaaccagtcgatctcggtcagccgatcgtggccgaacgatcccgggagtaccagcacgacgacgctcccgaggtggttgtgccctctggagcatgtgccgaccatgaccccaggtcgccgggcgaggtgacgaagacggcagctgcaaggtgccggtcgggcatgccggtcaggagcgcttgccggtgagggcttcttggagctcggcctctgccttcgagtccaggctcgagcgcaagacggtgccgccgtagcggctgagtgcggcgatcaccttgtcgctcggtacgtgctcgaccatcaggaagagcgcggaggtgcccggttggacgaggtcgcgtacccgttcggcgaactctcgattgacgagtgagcggtcgatcagaccggtgagcccgccgagagccgcgccgaacgcgacgccgagcaccgggacgaagaacaggaagccgaacaggagcccccacagcatgccccaggtggtcgcggcgccgacgacgtggtgattcgtctggacgcggaaccgaccgtcgctctcgcgcacgatcaccgccacggcgtccggttggatgaggagctcatcggtgagctcctcgatcgtctgagcggcttgggtggccgtgtcctcgtcggggtagccaatgaccaacagatcggacatcgcgtcctcctcgtgagggtcgttcctgtgaggaccttagccctttggaagccttctggaccattcccgccgagggcaggggtgtgcccgcggtgcggtgcgatgacccgtgcaagctcgcacgggtgcttgcgcgagcgcctctgcctcgagggcagtgacagcagaagatcatcaaagcgtgatgcggtcgggaggctcgccgtctccaagggttgaccgaggggactcaatcctcgcccgactcgagccgatatggctaccacgatccagatcgcacggattgtaacgttgcaaacacactgcgcgagcaaatggtcgctggttactgcggtatggtcaggtggcgttcgggtaggtcgcagcttccgggcattcgtggctgggcccgtcgatcgggctggtggcgggtgcggagatgctgctcagggggtagctgtgaggttgcgcgggcggttcgaggatgcagacgcatggagctggtctccgttggctgtcgtcgagagccgacgagaaggagtgaggtctgtgaggagcgtcgacatgtcgtccgccggcggtggcgacgacgaggcgagaaggagtgaggtctgtgaggagcgttgacatgggcaggagcgtgcagctgggatcggctcgggcgggcgcggtgcgagtcggactcatcgtccttgtgtcgggtgcgatggcggccctcggcggcggcgttgcgctggcgagcggcagctcgacgccgtctgagccgccccagattccgttgacacgtcgtaagtcacacgtaccatggcagagggaaggggaggtcgatggggacgtcgagaaggaagttcaccctggagtaccggaccgaggcggcccaccgggtcatcgacagcggccggagcgtcccagaggtggcccgtgagctcgcgatcggggagcacaacctctatcgatgggtgcgggaggagcgcaggcggatcgaagcagcaaacgccactggcagcccgcccctcacggcgcaggagcgcaccgagctcatcaggctgcgcagggagctcgaggagctgcgcaaggacaacgagttcctgggaaaagcagccgcgtacttcgccgcgaagccaccaagcaagagagattcgcgctgatggaggcggagtacgctcgcttcgagatcaaacggatggcacgcttactcgaggtctcccgggctggctactaccgatggcgacgcacccaggtagcaccgtcgcgtcgggcatgtgcaagacgcgacctcgagaaccgagtggtcgcggtccaccaggcatcctctggcacctacggcgcacgacggatcacggcggcactcctcgccgctggcgtggtgacgagccacaacacggtggcagcagcgatggccaggcgcggcatcgccggtatcagccccaggaggttccgcccagcgaccacccacgccgatccgaaggcgatctacccaccagacctcgttgccaggaagttcgacccggggcgcctgcacgccctctggacctcggacatcacctacctcgctctcgccggcgcgatggcatacctgtgtgtggtgcgcgacgagcactcgcggcgggtgctcggatggagcgtcgcggagcgcatggagaccacgctcgtgctcgaggccctcggccaggccgtcgcggtgcgtgggtcccacgcgcagggggtcatctggcacaccgaccgagggagtcagttcagcgaccatcgagttgtggccttctgtgcccgacacgggatcacgcgctccatggggcgaaccggcacctgctacgaccacgcgagcgcggagtccttctggtcgatcttcaaacacgagttcttctaccgccacgcctttggcgacctcgccgagctgcgccgcggcatacagagctacatccagttctacaaccaccagcgcagctgctcgaagatcggctaccttgccccagtcgtcttcgagcacctcgtcgcggaggaggctcgcgtgaagtaacctgggtgtctacgaaatctggggcacctcagtcgtccccgagtgcaccgacgccagcggcgggtttccaaacgactgtgctgtcgcaggtcgtcgcgccgtcgtcgtccacgcagacggtgacggcgacggctgatggcgccaatgtgtcagtggtcgttcccgcaggtgccttcggcaacacgacggtcaatctcgtcgtgaccgagcccacactgtcggatctcacctcgacgctgtctgcgctcggcctcggcggatccaccttggcgaccggtgtcggggtcgaggtggtcgacgctgcgactggccagccgctgaccggtacctttgcgcagccgctgaccgtgacgattacctcgagcggcatcacgagtgcttccaaggtcatcgagttcccgacgagtggttcgcccttcgtcgatagttctgctgaagtggtctcgggcaaggcggtggtccaggtgtcgagtgaccctggcttcgcagtcgcgacgcccacctctgcttcggtgccggcggccacgtctccggtgaccggtaaggacttcttgccggtcggcatcgctggtggcgtcctcgtcgtcggcggtgcggccctgatcgtcgcttcggagcgacgtcggcacgcatgagtggtgtgagaacccctcgggggttcctgcgccccgcggcaggtctggttgtcctcgcgggcgtcctcgcggcctgtgggtccaccgcgtcgtcgtcctctgccccagcgagtggttcgtcgacggcacatcgcgggtcgatcccggtcgcgatcgtgccggtgagcgcgggagcgctctcgctggggccactgcaggcgaatggcgagttctccgtcctggcagggacgccgtcatcgaagggcgtcttcacctaccagctcagcactcggcgcgaggtggccagtttctcggtgtcgaatcaggcaaccgcgatcacccagttgccaaacggcgtcatcgcggtcgggcttggtacggggtctgtgggcgccgtcgatctcgagagcagcagtggccaacaactcgcctcgatccccgtcgctgctccggtgcggggcctcgccctcggaacggacgggtccacgatctacgtgttggagggcaccggatcgacacgggcggttgccgtcctcgacaccgcgacgaggagcgcagcgacgaccctgcccgtcaatgctgacaccgtggcgatcgcatcgtcgccgacccagcaggagctctacggtttggagagtactggtgcactggacgtgtactcgacggcgacaggccaacggatcggtaccttccccgtaggtcactcgggcgtcgccgtcacgccgtctcccgacgggactgccctgttcgtgttgaagggcgtcggcggggtgcgcaacgtcgcggtggtgaatctctcgacggagggggacgtgcgagccatcggcgcgccggctggcggcatcgcgatcgcccccaccctgaccggtgccgatgtcctggtgctcgcggtggggccggcgtccgcgaacgttcaggagttgcccacgtcgtgaggacctctccgctccaggcgacggccgacgatccgacgtcgccacgacacggtgtccgagtggaggctgcgacgggcacctcgacgatggcctggttgttggcgggagcggtgctgatcctgtggggccttcgtttcggggttggggtcgccgagtcggctgggttctcgctcgccgatgtggtcatgatcggggcgggggtcgccatcattgccggctcgccagccatcgcgacgcgccctcgcctgcactgggctgtgctcgcgctcgtggttgcggcgtttctggcatgggcgacacagcaagtcctgatcgcgcccgcctacgcgacggacgagctcgcgttcgaccagtacgccgcccacctcgtactccagggggtcgatccctaccgagtctcgatggcggcggcatttgcgcgctaccaggtctcgccgaatgcgtttaccctgcgcttcagcggacagccggtgacggccctctcgtaccccgcacttgcattcctcgcttacgtgccgctcctggtcgccggcatccacgcccaagccggcacgatcgtcgacgcccttgcgtgggcggtgacgatcgtcgtcacgttcgctgcggtgcctcggagctggcgaccgttggtgctcgcattgctcagcctttctgcgggcgtcgcgtatgccgtcggcggagtcacggacgctctcttcctgccgttccttgtcgcgagtgcagcgttgctgggacgcttcgtccgcggcgattcgtggggctggctcgcacccgtcgcgctcggtctggcgatggcggtcaagcagacgccgtggctcgtggcgccggcactcgcggtggtggtcgtgcggtgggcgcgcagcagtcggtcgacgtcgtgggcgctgggtcgcctcgcgtggttcgtcggcttggcgactctcgcctttctcgtgccgaacgtgccgttcatcctccaggatcctggtgcctggctccgtggggtgctcaccccgctcgatgcgtcggtcgtacctgcgggccaagggctcgtcgcgctctcgacagcctttggtatcggggccgggggcttcgtctggctctcgcttgcatccgtggtgcttctcgcgggcggcacggcactcgtgtggctgggatggccgcgttgtgcgtggtgtgcctggctcgtgccggtggtcgcgctcttcttcgcgacgcggtcgttcggctcctactacgtcaacctcgtgccgcccgcgctcgtggcgcttgcacgttggccgcgcggagccgcgcccctgccacgtgtgtggtatcgctgggcactcgtgacgggtggggtcacggtcgtgtgcgctttggcctgggtgcgaagcgcatcgccgctctccatcgagatcaccggtgtccacacctctggccagctcgcgaccgtcgcgcgcgtcacgctgcgcgtcacgaaccgctcggatgcgacgctcgcgcccgcctacgtctcctaccttgcgggctcgtactcgctcccatggcagctcgaggcaggccctcgggtggtggcgccgcacgcgagtgtcgacgtgacggtgggtgcgccgaacttcccggcccaaccctcggtggccggtgggttccagatggtggcactcgcgggccatgccatcgccccgagcgcactgtacgagcccgggctccttcacgtggcgctggtaccggacgcggtgaacatccccgtcgcgctgggtcagcaggtggtgctccacgcggagctgctcgatcgcttcgatcagccagtgcgcgaggcgggtgtgccgatcttcctcggtcagatcatctatgcgcagcgtggcctgctctactcgagcgcttcgatcaacggtgccgctccgggcgcaactccggtcgaagagctcactggtccgaatggggtcgcgacgttcgtcatcgtcgaccgagctgcagagcccgatccggtgagctttgaggcaaacctggtctcgacgagcgggtactacccctatggctactcgcagatcgtcccgatccggttcgagaggagctgagatggcgaccggggtcggggcgccagatgacgctcgtgtgcaggggcgcgggcgatccatcgcgcgggtgatgggatgcgcgactcggctgctcggctggtggcgtgacgggggtccggcgctttgggtggcctggggattcggactcgcccaattggtcgtggtgatcgtcctcgcggatcgcctcgtccgcgccggggcgctctcgatcgactacgcgatcgaaggcggcgggttctctcagatcgccgctggccacctcgacccgaccgtgtggcttttccagtacgtcaagcccttcatcgacaaccacgaggtcttcctcgactggcccctcgcgctcgtgatcgggctcgtgcacctgccggtggtttggacgctgctcattggactccaggcactcccgatcgctgcaatcggcccgctcgtcgcgtcgtatgccaacctgcgtggacgtgagctcggattctcggctcggacgcgcgcgctcgtcacgctggtgccagctgcactcgcggcactcgatgtctggcagtactggtcgacgacgttcgactaccacggcaaggcgctccaaggtctcgttctcgttgcggcgctgatcgtgctggagcgccgacggcgggcgtggtccattgtgctcgtcgcgacgctcgcactcatgggcgatactgcgtcgtacgtgctcgccgtcgtcgcagtggtgcttctcctcgagcgtcggtggcgcggcggcttggccgtgctggcgacggcggttgccgtgctcaccgtgccctctctgctcgggttccacattttgtcgctaaccgggggtctctatagcccgctgacacccctccaggcgccgacctatgacgtcgtcgttggcgtcctcaagcatccgggcttcgcgctcggccgcctcgggcgccgcctcccagacatgtgggccctcctcggtggggcggggatcctcggcgtggcctccgccatggggatcgcggcaatggccgtcatcgggccggtcgtctggctcggcattgcgcccctcgggtacgcgggcgtcttccaactcgtgccgctcaccgacgtcctgctcctcggcgcagcggtgacgctccttcgtgtcgctcgtcgtcggccgcgccgtgccctcgccatcggcgggttcgccgtggcgtgggcgtttggctggttcgtggtgttcgtcccccatctcgtggcatccatccgcgcgatcgcgcctgccgacgtacgcaccgggagcacgctcgaggcgctcgcgacctcgatcccgccgggccatgaagtggttgctccgatctcgatggtggggctcgttgcccaggaccatccgctcgtgtggagctatcggtgtcggacggggccgatctcgatcccgaccttcggagtcccgctcgacatcgtcgtggctccgggggttggcgtcgacacctgcagccccggaacgctgatggctgagctggctcgggtcgcggcgttgcccagtgcgtccctccgcgtgctgcctggtgatgtctacgtcgtggagtatgatccaggcccgggtcgagggagcctcgtcctgtccgatgcggcgccgatgacaggccgagagctcgctcccacctttaccaagggctcgacccagctgctcccgggcggagcggtcgcgctctcgcctggtccgctcgcgctccacggtgtgaccgcagagctcgccccgggtgctgctggagaggctctcgtgcgcctcgaggccgagggatccgtgagcgtgcaggtgtgggatgacgcgtcgggtcagttgctcgcccgtgaggagctgggcaccacgaccggggccgagacgctcgcgatccccttcgtcgtgccccaccggttcatccccccggctgcgttcagcgacggcgtgtggccgttcgtcacacgcttcctccccccgacgcgctcggacgccgtcgagctccgtgtgagcgtcgggccgggttcgcaggtggcggtcgccgatgcctggatcggccccgcctctcaggcatcgaccgtgttgtccttcccaggtctcgttggtcagccggcactgccgtagggtggacacatgagggggaagggccggggagcgcacagccgacagcgaggtcggggaatcgcgatcgtaggggtcgtggcgatgctcgctggtctcggcctcatcggctcgatcgtcgccttctacgtgcgctcctcccttgtgggtggcggactcatccagcaagcgcagaaggcccggacggtcgcggcgtggccgcgatcgctgctcgcgatcgtgcgtatcccctcgatcgggctcgtcgcgccggtggagcagggcaccggccagtcggtgctcgctgtggcggtgggtcatctcacgacgagcgcgctccctgggaaaccaggcacgtcggtgctcgcggcgcacaacgtcagctggttctcgggcctcggtggtctcggctcgggatctctcattgaggtcgatacaccgtacgggcagcaggtctatcgtgtggcctggcatcgcgtcgtgcacgtcggtgcgcccgtggccaacaccgccgcaccgactctggtgctcgaagcgtgctggccgctcaatgcgctctacttgacgcccgagcgctacctcgttggtgccaccttggtggcgacgacgaagatcgcggtcacgccggtcacgccgtcgtcggacagctaccagccgctcgggcttgcgccgacgctcgcgcacgagaacctctcgctcgcggccaacgacctaccgatgggggtgctcgccaccgttggctcgcctgctgcagcatggacgagttcacagcgaccctacaacttcgctggagcggaagtgacgtggaccattgcgttgttgcatgcgctcgaagctcacgacctcgtgctcgtcgaatcggtgacccacgagccagcaagcgtggtcgcaccattgctcagctgggacggaggcttcgcgagcctcgacgacctcaccgaggtcgtcgatggtgtcacggcgtcggctggctcctcgcgagtgtcgctccagaccgatcacgggccgctcgtcgttaccttgcgttttcgggtcatcgggcatggggtcgaggtagctggcgctgcggtcgggacgtcgcagggctcgtagcccgccgcagtgaccgcggcgggttcgtgcccccgggctggtggctcggttggcgagatcctcgggcgcgcgaacggcggtgtcgtcgcgctctgatggtggcgctcgttgttccagattgctcgacgggcaccgagcgcccggcgacgacctcgatggtcggtgggtcgtcgatcgcttcggacccggtcgaggcagctcgtggccggacggatcgccgtgatcagctcgggcgttcgtcgtcgaggttccgtgcgcacaccggccgacgaaggtcgggtcggctcacgtagcctgggggtcatgggtgaggtggcgtcgggcgggctgtgggatctgcaccggtttcgccagcgcatcgatgagccggagcgccgacttcgccttgtgtggccgtctcgtgcggtggacttcggaagcctcgacgaggcgagcgtacgacgagcccttgcgccggccccggcgagccgcggcggcgtcagtgcagcggtcttgattccgatcgccttcgacggcccctccggcccggaggttctcgtgacgcggcgtgcgcgttcgttgcgtcaccacgctggtgagatcgcgttcccgggaggacgggcacgcgcgggagagacgctcgtcgagactgcacgcagagaggccgaggaggaggtgggcctcgaggcgagtgctgctcgcgtgctggggtcggtcggggttggctacacccgctcgagtgcttacgcgttcgaggctctggtcgcggcggtgccgcgtgagacgatgctcacgctccaacccgatgaagtggagatggcggcgtgggtcccactggcgacactgttcgggccggagcgagctgcgagcgaactgtggtacgacgaccgagcgggttggctccgagtctggctcttcgacctcggtgatgacctcctgtggggagcgagcgctcgcgtcgtcgcggcgctggctcagtgtctcggcgcgacgtagagcgcctggagcaccgcgccgatcacaccgtcgtcatcgagcaacgtcgcgcgcgtgaggccaacaccatcggcgtcgatgaagctccgtgccgaaacggcgacgcgcgtcgtcgcgggctcgcgaacgaagtcgatgtggaggctcggcgggatgaagagccactcgtcgaaggcgaggtgggtcgagatcccgttcgcaacgtcagcaatgagcgcggcggcctcgagcggtgtcatcggctcgcctgcgacgaggtggatgcgcggcgtggcccagacggtcgcgggacctggttgggcgaaggagccgtcgacgaagcgccagtcgatcgcggcaccgtacgggaaactgtccatgatcggatcgcgatggccggcctcgggagccggcagcttgggtgttggtacgtgcgttggcgctcggccccgctcggtggcgaagaaccagcctcgtgcttcgaacgccacgcggtcgccgacgcgcgcacgcatgcgtgcgaggcggacgcgtcgtccgtcgcgagtgagttcgcgttcgatgcgcagtggggcgatcggtacggggccgatcagatccacgtcgagtgaggagagccgccagctggcctctggaacgatgcgccgcagttcgtggaccgcgagggcagccgggggtccgccgtgggtggcgttcgggtcccacggtccgacggcgtggttggtcggttcgatgaggtcgtcgtcgatcctgcgaaagaagctctcgtcgctcacgagcctcgagcctacgtcgcatcccacgccgctcttgcgggggctagtgagggtgctcagccacccagaggccgatccaggcgagtagggagcccgcgaccaccgtgccgagcatgttggcgagtgaacgcgtgagctggcggcgtctggccagggccagcgactcgaccgcgagcgtcgagaaggtcgtgtaggcgccgatgaatcccccgtcgatcaccgtcgcgaggttggctgggaggaggccgccgagcgcgagaccggtgacgagaccgagtgcgagtgagcccgacaggttgatcgtgagcgttccccatgggaaggtcgcttggggcagcacccgacccatcagtactcggtcgacggcccagcggacgatcgcgcccgcggcgccggcgatggcgacgagaacccaggtcacgagcgatgggcgatcccaaggcgccgcaacgtgctcgggaactcgatcgcgagcgcccgcacgccgtcgccgtcgagccgctcaagcagtgcctcgatgcgatcggcctggtcggcgatgacgatcgcgatgccttcgtcgtcgtcgagggacagcagcgtggagcgtcggagccgcaggtgctcgccgaagctctcgacggcccgaaaggcggttgcacccgcgaggccgagatcgagggctcggcgcatgacgtggtcgacgacggcctcgtggccgatccgatcgccctcgttcacgaacacgatgacacagcgcgcctcgtcggacgtcatagacaacctccctctatcccaggggctcgacggcgctgtgagcgggcgtcgagcagcgcggtcgtcgctgcgcggcctgcgacgaccgcgaggaggccagctgcgatcgtgagtgcaccatagagcacggcggacccccacgcaccgcgatcggcggtctgggcgatggcgagcgcgagcgacgacagcgtggtcaaaccgccgcacaggcccgtcgccacgagcagccgaagacgccgtccagaggtcggcgcgaggcgctccgcgagcgcgaggaccccgccgatcacgaaggcgccgaggacgtttgcggcgaggatcccgagtggaaacgacggggtggtgtcgaggacctgctcgagccagacccgcgtgagcgcacccacggcgcctccgatccccacgagcgccgcgcgccgcgctcgtcgcgcatggtcgccggtcatgggatcgatgcctcgaggctcgcgatgcgcgcgtcgaggcgggtcagctcctgggcgcgctgggcaggcggttcggggccgtcgagcaccagggcgcgcgcgagcgccgtcgctgcgagctcgagcctgggcgccgacggggccggcgcgatgaaggcggtggcggccgagctcaaggggtaggcggactcggtcggcgtgcgcgccgtctgggtcgcatccagaatgctcgcggcctccggcgaggtcgagttctcgaggaacgcgaggcatccgaccgtaccggcgcaggtggtcgagacccgcgctcggatctggctcgcggtgacgcccagcgtttgctggagccagatcgcgaccgtgctccctgcctcgatcggggcgatggtcaccggtaccggcgggagcgagagggacgggttgaggtgcgcgatcgtggcgtcgtcccagacgctgatgcgtccggtcacgaggtcggcgagcgcggcctcgctcagcacgagtccggtcgtcgccccgaggttgaccgaaacggtgagctcttcgggagcgtacggccagggcgcgagcccactctgggccacgatgctcgccgccggggcgaggctcgcgacgaccatctcgtcgtgcgtggtgacgagggagctagcgatctgggcgagcggcaccgtctggatgctcaccgacagggccgggtcgtcgcggcgcacggcgcgcacggcactctcgagggccgggagcgcacccggatcggcgagcaccgtgaggtgggtcgcgccgaggacgctcgcgagccgctgcgtcgccgtcgtcgaactcgacgacgggctcgtggtgccgcacgcggcgagcacgaccgctccgacgcaaggcgccaggcgcgccgccaccgttggtcgcatcaccctgtcgacgcctcccaccgcgtagactgcgagtcgcagtctacgagcgcccctgggggaaagcgtgagagacgcaatcgcacgacgtcccagcgaggagggtggttaccgtggcggagatcgagatcggactcgggaagtcgggccgacgggcctatgggttcgacgacatcgcgatcgtgccttcgaggcgaacccgcgaccctgaggacgtcgacatctcctgggagatcgacgcgttccgcttcgagctccccatgatggcctcggcgatggatggcgtcgtctcgcccgccaccgcgatcgagatcggccgcctcggcggtctcgcggtgctcaacctcgaggggctctggacgcgctacgaggatccggatgcggtctatgccgagatcgctcagctcccctccgacaaggcgaccgcgcggatgcaggagatctacgccgagccgatcaagccgtcgctcatcaccgagcgcatccgcgagatcaaggctgcgggggtcgtcgcggcggcgtcggtgacgccgcaacgcaccgaggagttcatcggtgcgatcttgaagggcgaactcgacatcctcgtcatccaggggacggtggtctcggccgagcacgtgtcgaagacccaggagccgctgaacctcaagcgtttcatccgagagctcgagatcccggtcatcgtgggaggcaccgcgtcctaccaggcgaccttgcacctcatgcggacgggtgcggtcggggtgttggtcggggtgggtcccgggcatgcgtgcaccacgcgtgcggtccttgggctcggggtgccgcaggcgacggcgatcgccgatgccgcggcggcgaggatgcgccacctggacgagacgggcgtctacgtgcacgtgatcgcggacggtgggatgtccaagggcggtgacatcgccaaggccatcgcggtcggcgcggatgcggtgatgatcggctctccgctcgcagcggcctacgaggcaccgggtcgcgggttccactggggcatggcgaccttccacccgacgctccctcgaggcacccgggtgcgtaccgagcagcgcggttcgctccaggagatcctggtcggaccggcccgggagaacgatggtcgcctgaatctcttcggggccctgcgtacctccatggccacctgcggctacgagtccatcaaggagttccagaaggccgaggtgatggtcgcgccagcgctccagaccgagggtaagtccctccagcgcgagcagcacgtcggccaggggcgctagtgcgccacgccgacgagcaggtcgtccttgtcgtcgacttcggcgcgcagtacgcgcagctgatcgcacggcgggtgcgcgaactccacgtgtactcggaggtcgtcccggctcgggacgcactggcgttcgtccgctcgcggcggccggcggcggtgatcctctcgggtggtccggcgtccgtatacgcccccggtgcgccggggctcgcgcccgaggtgctcgaggcgaacgtgcccatcctcgggatctgctacggcgctcagctgatggcccagcagcttggcggcgtcgtcgagcacggaggttcgggtgagtacggcagaacggtgatcgagcgcaccgacgagcgtgcgcacctgctcccgccgctccgtggcgaggcgcctgagacggtgtggatgagtcacgccgacgcgatcgttgccccgcccgagggcgcgcgggtggtcgcgagctcggccggggcaccggtcgcggccttcgaggatcccgcgaggcggcgcttcggtgtgcagtggcatcccgaggtctcgcacaccccaggtggcatggagctcctcggacggttcctgttcgacgtggtggggctcgagccgcgctggacgagtttttcgatcatcgagcaggcgatcgcagaggtccggagcacggtcggcgatggtcgggcgatctgtgcgctctcgggtggggtggattcgaccgtggccgcggcgctcaccgccgaggcgatcggcgaccggctcacctgcgtcttcgtcgacacgggcctcctgcgctcgggcgaggcggagcaggtcgaacatctgttccgttcccagttcgacatcgagctgatcgtggtggacgcggccgatcgcttcttcgacgccttggcgggcgtgaccgaccccgaggccaagcgcaagatcatcggcgaactcttcatccgcatcttcgaagaaacggcggcctcgaagaccaacgcgacccacctcgtccagggcacgctctatccggacatcgtcgagtccggtagcgatggctcggcgaccatcaagtcgcaccacaacgtcggcggcctcccggacgacgtcgcgttcacgatcgtcgagccactgcgacgcctgttcaaggacgaggtccgtcgcatcggcgtcgagctcggtatccccgagtcgttcgtgtggcgccaaccattccccggtccggggatcgcggttcgagtgctcggcgaggtgaccgcagagcgggtcgagacggttcgccgtgcggatcgcatcgtccaagacgagctcgacgaggctgggctctcgcgctcgctatggcaggccttcgcggtcctggcccctgggctccggtcggtcggcgtctcgggggacgcgcgtacctacgacgccccggtcatcgtgagggcggtcgagtccgaggacgccatgaccgcagattgggcacggctgccatgggaggtgctcgatcgcatctcgcggcggatcgtcaacgaggtcccgggcgtcaatcgcgtcgtctatgacgtgacctccaagccgccaggcaccatcgagtgggagtgacgaggtgctcgaggagctcctcgaggatctgaacccctcgcagcgagaggcggtcagcgctccgatcggaccggtgctcgtgctcgcaggggccggctcgggcaagacgagggtgctgacgcgccgcgtcgcctggctgctcgccgctggcgagcggccgtcgtcgatcctcgcgatcaccttcaccaacaaggcagccggggagatggccgagcgcgtccgcagtcttgttggacccaacgcggatggcttgtgggtctcgacgttccacgccgcgtgcgcgcggatgctccggctgcaccccgaactcgggggtttgcgctctggctggagcatctatgaccaagacgatgcgaggcggttgctcgagcggaccattcgacgcttggacctcgacaccaagcggttcccaccgcgggcgatcgcccagcaggtgtcgctcgccaaggctcggctcgtcgacccggagcgtttcaccgacgaggcggaggggctctacgagcgccaggtcgccatggtctatcggtcctaccaggccgcgcttgccgaggcgaacgcggccgacttcgacgatctgatcggactcgtcgtcgagggtctcgcgacgcgaccggagctcgccgagcattggcgacgtcggttccgccacgtcctcatcgacgagtaccaggatgcgaacccggcccagcacgccttcgtcgccgagctcgtcggtcgtagcgggagcgtgttcgccgtcggcgacgtcgatcagtcgatctacgccttccgcggtgcggatccctctggtgtcctcacgttcgaggagcgcttcgacggcgcgaaggtcgtcacgctcgagcagaactatcgctcgaccaacgccatcttggggctcgccaacgcggtgatcgccaagaaccgtcgtcgctacgccaagcacctgttctccgagctcggcgagggcacgccggcgcgacgctatcaggccaccgacgagcgggacgaggcccgttgggtggccgcgaccgtacgagagttcctccaacgtggcggcgtcgatcccagcgagattgcggtcatctttcgcaccaatgcgcagagtcgtccgctcgaagaagccttctcggaggcgggcatcccgttccgcgtggtcggaggcgtccgtttctacgagcgccgcgaggtgcgtgatctgctcgcctacctgagagtcctcgccaacccggacgacgacgtcgcgctggcgcggattctgaacgtgccacggcgcgggatcggccggggcaccgaggaggcgctccaggcggctgcggcactgcgcggtcggagcatgctgtcgctgctgcgtgcagagggcgtcgaggtgctcggtctgacgagccgccaggagcgggccctgcgagggttcgtcgagctcatcgatcgcctgggagcgcttgcgtcgctccatcgaccgagcgagctgatcgacgcggtcgtcgccgagacgagctacctcgagcacctcaacgaggaggatccgatcaccctcgagggtcgcctcgagaacatcgccgaactgcgtgcctcggcggcggaggctgacgatctcgagagcttcctggagcgcgccgcgctcgtgtcggcggtcgacgaggtgatgggtgcctcgggcgtcaccctcttgacggcgcacgccgccaagggtctggagttcgacgtcgtggtggtcgtgggactcgaggagggggtctttccccacgtgcgtgccatcgtcgatgccgaggcggtcgaggaggagcgtcgactgttctacgtcgccatgacccgagcacgcacgacgctcgttctcacgagcgcgaggcgccgggcgagctggggcgagccgctctacaacccacccagtcgctttctcgacgagctgccggctgatctcgtggcgacgaccgcggcgcccgtcgctgtcgggacggcgtgtgcggagtcgatccaacgtgcgagtgcggtcgtcgaagcccgtgcagcccggagcgagtgggtggtaggcgatcgagtcttccacgctcgctacggcgagggaaccatcagacgggtcgtgccgcggggcgtcgacgacgagctcgtgatcgcgttccacggcgctggcgagcgtcgcttcttcgcctcgatggtcaagctacgacgcgcgtgagctgagcccggctggggccgcgagagcccctgccgcgtccctggcggcgcatgtgcgccctcgtcggtcgtgtcggggcgcgcgtgtctcggctggctggccggatgggatgacgctgtcgagaagccggacgaccacagagcgtgggaatgcggagagtggtcacgcaacttcctgtggggagaaagtggcaacacagtgcgaacatgtcgatcaggtgtagtgaacagtgcgttacggggacaaatacctggagaactcgtgctggttggcccctcatggtgcggctacagttaccacagcgagagctgaaggtgtcgaattcgagtaaatgtgttggcacggatcgtcgtgcgtcgacactgatccgctcgacaaggaaggagaaccaccaccatgcgcatcatcgtctacggcgcggacggctacatcgggtggccgatggcgctgcacctcgcggcccaaggtcacgacgtgctcgccatcgacaacggtgcccgtcgccgttgggacgcagaaggcggtacccgtcccctgaacgagatcgcctcgttcaccgagcgcgtcgagacctggaacgccctcggcaagggtgcccccatccgcatcgccgaaggcgacatctgcgactacgacttcgtcctcgagaccatgcgcgcccacgacccagaggccctcgtgcacttcggcgagcagcgcagcgccccctactcgatgatctcgcgcgaccacgcggtgcgcactcaggtcaacaacatcgtgggcaacctcaacatcctctttgccatgcgcgaggtcaaccccgagatccacctcgtcaagctcggctccatgggcgagtacggaaccccgaacatcgacatcgaagagggttacctcaccatcacccacaacggccgtagcgacaccttgccctacccgaagctgccccacagcttctaccacctctccaaggtggccgactcctacaacatccacttcacgacgagggtgtggaacttccgcgccaccgacttgaaccagggcgtcgtctacggcgtcgccaccgacgagacggtgctcgatccgcgccttgcgacccgcttcgactacgactcggtctggggcaccgccctcaaccgcttcgtgatccaagggtccctcggctaccccatcaccgtctacggccgtggcggccagacccgtggctacctcgacatccgcgacaccatggcctgcatcaccctggcgctcgagaacccggccgcccccggtgagttccgtgtcttcaaccagttcaccgagcagttcaccctgaacgagctcgccgagaccgtggcaggtgtcctgggacgccgaggcctcacccccaccatcgcccacctcgacaacccacgcgtcgagaaggaagagcactactacaacgcccgtcactcggccctgctcgacctcggtctgcaaccccactacctcgccgacaccctcatcgactcgttggtggacttcgtccaggcgaacgccgccaacgtcgaccccgagctcctcgagaccccgacggtgacctggcgcgagggtgcgaacgaggtctggtatcgccacgcggacctcaccgtggcggccgagaaccgagcacgcgaggccacggacaccattcgggaggcgctggcgtaggtgccggcgcgagcagaggcgtgagggagggttgcgatggtcaagagccaggagtcgtcggaccgaccgtggtcaggcgatgacgaggagcagcgtggggctgaaaccatctggccgctcgtcgatcccgaatcgctcgagggcatcgatgtgacctcgtcggaggcggtcatcgacctgcgtgaggcgccgagtgcccctccggtgagcacgccggcggcgagtcctccagcgatggagctcccggtggtcgcagccccggtgcggccgtcgcgccgcggttggctcgttgccatcatcgtggcggtcgtcatcgtcgtggtcggctacgtggtcgtgagcggcctggctggctcaccactctcgtcgctgtcgtcggaggtggtcgacccgggtgaagtgagtctctcgttcccggctgcgggaacgatttcgcagctggccgttcacccaggcgagcgggtcgcgagcggccaggtactcgcgaccgaggtggtcccgggcctcagcgagacccgtcatgccgatcaggccgcgatcgcagcggacacgagcgaagtcagtgcgctgcaagcgctcatcgcgcagatgtcgagcgtgacctcggcgaacgctggggtcgtcgcccaggcggcccaggctgaggtcgcggcggcgcgccaagcactcacgagcgacgagagccagctggcatcggtccaagctcaaggggcggccacggtcgccgccgcacagtccctgctgggcgccgatcaggctgccgctgtggcggcatgctccggcgtcggcccgacggcttcgccgccaaccgcggcacaggtggcgtgtgctgatgcccagcatcgtgtcgctgccgatgagctcgccctcgcccaggccaaggcgagctcacagagcgccgtcgacggtgtccagagcctgattgctgcggatcaacgtgcgttgagcgacgcggaagcacaggcgagcgagagtgatggcgtgtcgtcgacgcagctcgcagcgctcaaggtctcgctggtagcagcccaggctcagcttgcgcgggatcaaggcgaactcaatgctgccgcccagaccgctgcgacacagaccctgcgagcgccgatcgctgggacggtcgtgagcgtcgacggcgcggtgggtgagacggtgagcgcgagtggggtcggcgatgcggtaccgagcggctcgagcgtggccgtgacccctgggttcacactgttcccgtcgacccagacggagtcgagccagccggtggcctcgaccccggtcgtggtcatcaagggtcacgcccccacgtacctcgagacgctcgtccccgagagcgtcatcggcaaggtgcacctcggtgatcaggtgacgttcacaccgagcagccaaggcatcggtgtcgtccacggggtcgtcgaacagatctttccccgcccggtcgttgcggccggcgtcgtgagctatgaggtccagtcggaactgagcggccgtcttccagccggtttgctgaccgggctcacggggaatgccagcatctcaagctctggtcgacgatgaccccacacggcgtcgtcgtcgtcctcggagccgtggccctgttggcggcgggcagttgggccgtgctccacggcgggcgtggtgaccatggcgacgggttgcgtcacgtgcgcctgccgtcaccgcagcgctcgatcccacgtctcgtagtgttcatcgtcgccatcgtggcgtggtcgatcctcgtagctcgcgactgggccgaggccgcaggcgcgttgaaggccgttcttgcgctgatcctcgagcgagccggactcggtgcctcgacggccagctcgtatctcgtccacaccaacccgctcttgctgctgctcgaggacgggagcctcagttctttcgtgatcgcacgtcgtcacagcgtgcgctcgctcgtcgtcagcgttggcgtcctcgctgtcgtcctcatcgggggaccgctcgtcgtcggggccgccgaggtgatggcatcgtggttcggggccccgtcggtggtggtcttctacctcgcagagctcgcgagtttggcggccggcttcgtcggcctgttggcattgatcttcctctcgagtgccttgccgcggcgctacgcggcaagggttgggctgcgcccgctcgccagcgcgctgctgctcatcggcgtcttcgtcctcattctcatcggcgccggcgcgctcgcccgcggcatcggtgggagcttgagcgctgtgtcgccgccggacggactgctcgtgttcttggccctgcccgcgctgatcatggccgtctcggtcgtgctgctgctcgtgcgcccgaaggatcgacctggggtcggggatcccacggagccgatcgacgtgatcatgccggccttcaacgaagaagctggcatcggtgccgcactcgccgcgctcgatgcggcggcggctgcctatcccggccgagtccgagtcctcgtcgcggacgacggttctcacgaccgcaccctcgaggtcatcgagatggcggcccagactgctcgggcggccgagatcgtcgctgtgggcgggccgcacggtggcaaggcggtcgcgctcaaccgggcgctcgaagccgcctccacgcgcatcgtcgtgcgtgtcgacgccgatatcctcgtggatgcgaactgcttgcggccgctcccagactggttcgccaacccggcgatcggctgcatcggtgccttcgaccttccgaacatggcgctccctgcgtggtacacgcgtggccgactcttcgagtgtctcatgaccttcgggttctctcggctggcgttcgagcgcgtggacgcgaacaacgttcccgggacctacatggccttccgcagagcggaggctctcgcgctcggtggctttgtcgaggggatgaacggtgaggactccgacctcaccttcaacctcggcaagctcggtctgcgttcggtgatcgacccgcgcatcgtgatctacgaggacgtcccccagacccttggggctttcttggagcagcgcactcggtggtcgcgcgcgtcgttccacatcggcgcgcgtcatcttccctggcgcgcgcgagagctccatccgcggctcatcatccaactccgcttcctcttcaacaagctcacctcgatgatccggccgatcacctacatctcgagtgccgtcttcttcttgctcatcccgcgggtcgctggctcgccgctgcgtaccctcgtgttgcttgctttcacccttgcgccgcaacttctcttgctgatcggcgtcgcgctctactggggattctggcgggaactacgccatctctgggtgtgggtgccctttaccatggtccgcaaactcggtttgctctcgggtatcctgtcgctgccgccgttgggcgcagccgtcgatccagaacgtcgggtcgaggccatggcagatgcgaacgctcgctaggcggctcatcctcggcgcgctcgcgctggcgctcgctggctgtggcgaggtgcaagcaccgcaccatcgcccgacgagtgagcgcgcggcgcacgagatcgccccgtcgctcgtcggggtgcattggtggctcgcggcctcggcgctgcgtcgcctcgatgcagcggcaggttcgagctggacgaatgcggtgttccgtccggcgaataccaccctgatcgtcgggccgtcgcaagcggccagctatgcggggtgggcggggcaccgcgccctcgatgcgacgagcctcgccggcgttcgcgaggcgctgcgcgtggcgacgtccggggatgtcgtattgctcgatctcgagcactggccgcgctcgccactggccgagcagcttcaggcgggtgcgacgttcacacaggctggcacgttggccagggcggcaggcgtcgatctcgtcgcggctcccgccaccgacctcgctctcgtcctcaccccgggccagcgtgttcggaccggttttctcgccagcggcgtggtgcaagcagcgtcgcgcgccgcgcagatcctcgagatccaggcacaaggtctcgaggcgacgccgtcgcggtatgcgagcttcgtcgatcaggtcgaggtgcttgctcggagtgcgaacccgacgattcgcttcgtgctcggactgtcgacgaacccgagtgggcaacgggtcagcgcgacaaccttggcccaggacatcgcgctgaccaaggctacggcgagcggctactggctgaacatcccccaggccggggtctcgtgtccgcggtgtggcatcgcgcagccgcaggtcgcggtggcgttgctgcggggtgagtcctgaggcgcaagctgctcctggcgggttcgctcgcgttggtggtggccgcggtcgtcgcggtcgcggcgccacgaggggcgaagcaccatcatcacacgcagcacctcttcatgccgagcccgacgggaggccaaccgatcgaggcaccaacgagcaggcacacgatctggctgctggccgaggcgcacttcgatcaagtcgtctccgtcgcccccgtccgtgctctctttgcccgtggcgtcgtgtacgaaccgatcacgccgcggcagcatccgagcaccctggtcccggtcattccgacggctgactttcacgccgagtcacagctcgcccaggcgatcgccgaccatgagcttgcgacgggagtgcgcgctgtgatctacgacaacgagcgctttgcgaacacccccaccgtcgagcaagacaacatccggctctccaccgagcgcgcagccgctgttgctcgcgccgcgggtctccagagcatctgtgactttatcgagtcggaccgacttccatcaggggagcgtacggcccagaacgaggtgccaccgtgcagcatcgtcgggctcaacacggtgcaacagtcggaacgatcgaccgcccggtaccgggctgtggtggcacgtgacgttgcggtgatccgctcggtcgatccgtcagtgccgatcatcgcaggcttgtcgtcgaatccgcgcggaacgccggtcactgcagcggagctcacggccgacatggaagcgacggcagggttggtgaacgggtactggctgaacgtgccggcgccaggcgtcggttgcccggcgtgccacgcgcccgaccccggactcatggcggaagcgctcgcggcgttgccagctgggttcgcgacgaccgggtgagtcggcacacacgacgaggacagtgacaaccagggggaaccacgacacgaggcgtgcgacggcagtggcggtggctgggtggcagtggctgggcgttgcgctggcgccaacgatctgctcgctcggcatcgtcgccgcgtcgtcggacacagctccagcggcgagcgaggtgccgggctggtcctttgccacggatctcgtcggcgcgacgacccaaggctcgctcgtggtgagtttcccgacaggcgcgagcgccggaacgcagctggtcgtcaacctgccgtgggcccacttctcgagtgccgtcacggtggcgctcgatggtcagtcctgccagggggtctcggctcgcgacgctggcgcgatcggcgcgagcctcgcgtgcacggttccggcggaactcgctgctggggagcacgtcatcgacgttgggggtgtgatgctcccgaacctcgtgctcgaggagtgagcgcccctgtggtggtcggtgctgaccggatctgcgcgaccgagtcggtggcgccacgttcggatgcagcggttggcgtgcgcatcgtggttcgcgacgcgagccgaagcgccgctggcgacagtgccctcgtcatcgcccagctcgtggatcggggcggtcttgcgaccacgaacggagccacgagcgttgcgctcgcgttcgacccggggaccggcgccagcgtcgcgccgccgtcgacatcgacgacacccgacggtgtcgtcggcgtgcggggatgtgctggccctggcaccgccggcatgacagcgaccgctgcgagctcgggcgaggtgctctgcgtcgtgatgcgccagacatcgtcggcgcccttgcgggtcgtcgacgcggcgagcgccttcgagtcgcctcagccgatggtcggtatcgctccgggctcggtcgtgggcctgggatcggcagcctgcgacgcctctgtcgtgacgaactcgggtggggtgctcgccgtcggcgagaacccactcggcgagctcggcaacggctcgaccacggtggcaagttcgacgccggtctcggtgacgttccctgctgggacccagatcgcgcaggtggccggcggtggctacttcacgctggcgcgctcgtcgaacggcacggtctctgccaggggcaggacgaccaggggcaggtcggcaacggcaccaccgaaaccgacgtcgccacgccggtgccggtcgcgctgcctgtcggcgctgccgaggtcgcggcgggttgtcacgcggcctcagtactgggtagcaacggcaccgtctacgcgagagggttcgaacacgacgggacagctgggtgccgggggtttcttcaacgacctcgtaccggtccaggtgcagttgcctcatggcgtgagcgtcagcgacgtcacctcgccaggcgtgtcgacggtggtcctgacaccacgagcggcgccgcctctgtcatgggcggcaacctgttcggccagctcggtgacggcatctacgtcacggccgcgacgccaacccgggttggacagtcacagctcgaagcggtcgcgatgggcggcttcacgaactggctggagccgttcccgaccatcgtccgcaccgacgctcggaccctcaagctcgagcgccctcctcggcgaggagtcgtggcagcgcacggggtgcgacgagcgcccgcacgacctcggcggcgcggcgtcgcttcgggacgatggctcgccgtgtgagaacgtcgtagtcgttgcgttcgacctcgagcatgatggcgctgtagagctcgcgtgccacctcgacgcagcggcgggaggcgcgcggcaggaggggatcaccggcgagtgagtcccgatagagggtccgtgctcgttcgatctcgaagcgcacgagcgctcgtaccgccggcgagggccgacgcgcgagcaagtcgtcgagcgccccgtggttcgccacgtcctcgagtggcaggtagatccgtccccgatcgaggtcttcgccgacgtcgcggatgaagttggtgagctggaaggcgagcccgagcgcgcgagcgggctcgcgagcagcgggtgggccaccgaggatggggaggaccatctcgccgatgacggcggcggatccttccatgtagtcgagcagatcgtcccatcgctggtagcgccggacggtgaggtcgcgccgcatcgcgccaaggaagcgagcgagcgtctccggctcgatctgccagcgctcgtaggtcgacaccagcgcatcgagggccgggtcgtcgctgccgccgcgtacgagggcctggcagagcatcgcttcgagctcgtcgagaccgcgacgcttttcgtcggtggtggcgctaccgtcgacgatgtcgtcggcccgtcgacagaaggcgtagatcgcccagatgcctgggcgcgcgtccggctcgaggaggcgggatgcgaggtagtacgtgcgcccgtagcggcgcgcgacggatcgagtcgaggagagaccagcggattggcgcatcatcgacgtaccatgcttcccgggtggtcggcgagcacgcgagccgcggcgagctgacccgaggtgagcgcgagcggaacgccgacgcccgggtgcgtccccgatcctgcgaggacgaggttgtcgaactcgcgaggggccatcggcgcgcggaacgggcccgattgccagaaggtgtgcgcgaacgagaacggcgtcccggcgtccatgccctgggcagcccacgcctcggggtcgagcacgatctcggagatggggtccgaacgacgagccagtccgaaggtgccgagacgctcttcgaggcgttcgcgcgccgcagccgcgtcctcgggccagcggagctggccgttcaggttcggcacgggctcgagggcgtagacgacacggccacggggcgcgatcgtcggatcggtgcgctggggcagcgagacgagcgtcgaggggtctcgcatgaggcgccgggtctcgatgaggtcgtcgaaggcttcctcccacgcttgcccgaagaacacgttgtggtgctcgaggtccgcgggaagcggggcgtcctcgtagcgcaccacgacgagggccgagggtgcgaggcgccaccgtcgcttggcgtagccgaggccgagacgtcgaccgaggccgagcgggtcctcggtcgtgacgacgacgtcggccgggtagcgcccctgtggcgtcgtgaccgcgctgatgcggctcccggtgcgttcgtagtgcgtcaccggctcgtcgaggtgcagctcggcgcccaggtcctcgcacaggcgcccgagcgcctcaccgagggccgccatgccgccgcgtggaaaaacgacgccgaggaccacgtccatgtaggcgatgacgccgaagagcccgagtgctcgctgcggggagacgccggcatagagcgcctggaaggtgaccgcccggcgaagcctcgggtcggacaggacgcgggccgcacgagcatccaagcgtccgaaggcgccgagtcgccacagacgccagagcgcgggtgcgcgcgtgagcagtcggtcgacgctggcgacgtcggcttcgatgaaggtcggcagctccgtcccggcgagctcctcgagccagcgggcccagcgctgccactcgtccagggcccgcgtgccggcgaaggcacggacttcctcggccatgcgctcgcgatcgctccaggttcgcagcacccccgcgccatcagggcccgtcgagtctgcgaacgcgagccggtaaccgggctcgacggggatgaggtcgaggtagtcgtcgaggttgcggcccgccgcgcgccagatcgatcgcagcgtaccgaccatggtgagcacgacggggccgaggtcgagcgtcgccccgtcgatgcgcacggcgtcggctcgcccccctgggcgcgagcgacgctcgagaatggtcacccgatgacctgcggccgccagcctcgaggccgcggagagtccggcgaacccagcgccgacgacgatgatacgtgccatcgatcagtgctgacgggcgacgatgaaggtcgcgaggtccccgagcgcgcagcgcgcctcagcggagagcgggaggtcgccgagggcatccatcgcctggtcggcaagctcgtcgatgcgttgctcgacccgatcgagggcaccgctacgacggacgaggccgagcacgtcgtcgagcgcacggccttcgaggttcgcatccccgagcgcctcgtcgaagcggacgagatcggcgacgtcgagccgctctcgggtctcggcaaccagcagggtccacttcccttcgcgtaggtcgtcgccgaccggcttgcgggtgcgagcaccgtcgccgaagacgccgaggacgtcgtcacgcagctgaaacgcgagccccaaggggagtgcgaagcgcgagagcgccgcgagcaccccgtcggccggatccgccagcagcgcgccgagatgcagcggtcgctccacggtgtacttggccgacttgaacagggcgatgtgctcggcgtgctccggggtgtcgaagagctgggcgctcgcgaccacgtcgaggtactggccgagattgacctcgagcttgagctgtgtgaacgtggcacgcaccgggagcggggccgcctcgagggcgccgtcggcaagcgtgagggccaagtccccgaccaagatgccgatcgcatccccgtaggtctcggcctcaccgcggagcttgagggagcggtgctcgtcgcgcgcgcgcgcatgaacggtcacagcaccgcggcgaagttcggagcgatccatgatgtcgtcgtgcacgagcgcgaaggtgtggaggagctcgatcgccaccagcaggtcaccgaggagctcgtcgtcgccgtccacaccgagcccacgcgcggcccagaacgcaagggcggggcggaggcgcttgccgcccgcacgcgtgaggcgtgacagctcatcgaacggttcggcgaagcgttcgtcgatggcgcgccagcgtgccgcctctgcgtcgagcagatggccgaggcgtgcctcgaccaggcgtgtgggggctccgaggacctccggttctgcgacgcacggctccaccaccgcgctcgattcgtcgtccacctgcgcctgactcctcgaccactcgtccttcacgacactgtgcaaccgcgaggtcgcaccgtggcttcccgtaccgagcctagtgacgagacctcggtaggctgaagccgtagcgacctggaggggagcgtcgtgatcgatccggagctggtggacctcgtgctccagcgcgcgctcgcccgtgggggcgacttcgccgaggtgttcgtcgaagaagtgcgctcgacctcggtgagcgtcgacgacgggcgggtcggcgccctggccgacgttggatggcgtggggtcgggatccgcgtcgtcgtcggcgagacgaccggctttgcccacaccaccgacctgtcgcctcgcgcgctcgtcgcggcggccgagaccgcctcgtcgatcgcgaagggaggcgcgagtcgggtcgctcccctcgaggtagcacccatcgagcctgcggcgcccgagcgcgacccgagcgccaagcggcgcatggtggagctgctgcgcgctggtgagacggaggcgcgagggctcgccgatgcgatcgtccaggtgtccggccaggccgcgaccgcgcggcgtcggatcctcgtggccaactccgagggccgattcgtcaccgatcggcaggcacgcacgcgtgtgtcgttccaggtcgtggccgccggggacaccggggcccagagtgggcgcgagacgtctgcggccaccgtcgatctcgaggagttgctcgacgccctcgacgtcggcgccctcgcgcaggtcgctggacgacgggcgcttgccaaactggcggcgcgtcccgctccagcaggcgttctgccggtggtgctggcgaaggggtcgggcggcatcttgttccacgaggcctgcggccacggcctcgaggccgaccacatcgccaagggcgcctccgtgtacgcaggccgtctcggtgagcgggtggcgagcccgctcgtgacgctcgtcgacgacgggacccgggccggggagtgggggagctaccacatcgacgacgagggcaaccctgcccagtcgaacgtgctgatccgcgatggtgagctcgtcgactacctctgggatcgccgcagcgccacgaagctcggccagagcccgcgtggcaacggtcggcgccaggactatcgatccctgccgatggtgcgcatgacgaacaccttcctcaccccgggggagagcgatccagcagacgtggttgcgagcaccgaccacggcgtctacgtggccgccctctccggcggtcaggtcaacacggccaccggagacttcgtcttcggggtgcaggaggcctacctcatcgagcacggccgcatcaccgctcccattcgcgacacccagctcatcgggaatggccccgaggtgctcgctgccgtggatgcggtcgcgaacgacttcgacatgaccgcggggacctgtggcaagaacggtcagtccgttccggtcgggtgcggccagccgacgctgcgactggccggtgtgacgctcgggggaacgatcggtggctgagctgttggagcaggctctcgcgctcgtggacgatcggcgggccggggaggaggtcgaggtcgtcgtcgggcgatcgcgccaggtggaggtcgtcggcttccacggcgcggtcgagtcgctgacccaggccgaggaggtcaccatcggggtccgggtcctcgtggcgggccgcatcggcttcgccacggtcgatgcgctcgaccccgctgccgcccgcgacgcgctctggcgcgcgagagagaacgctgagctcgtcgaggcggaccccgacgcggtcttcgcggtgcccgacgacgtcgcccccgtcgtgctcgagctcgtcgacgagaccctgtcggcggtctcgctcgatcgcaagatcgccacgtgcctcgatctcgagcgcgcgtgtcgggctgcggacccgcggatctgcgacgttcagtcggcgacctacggcgagctcgacggcgaggtcgccatcgcctcttccaccggtgtcgcgacgcaggtccgatcgacccgcgcttggctgttcctccaagcgctcgctgcggatgggcgcggtgtgctctcgacgggttttgcctcgtctggggcgcgaggcttcgagggcctcgacgcagatcgcgtggcgcacgaggcggcgagccgtgcgctccgggggatcgacgccaccaagcccgtgggccgcgaggtccaggtccgtttcgagcctcgctgcgcacagacgctgctcggtctctgggcgggtgccctgtcggggctcgcgctcgctcgtcgtcgctcgatgttcgtcgatcgcctcggagagcgggtcgcgccctcgtggttctcgttggtggacgacccgacggacgggcgctcgctgggggcgaccccggtcgacggcgagggactcgcgacccgaccccatcggctcatcgagggtggcgttgccgccgaggcgctctatgacgcctatgccgctcgactcgccggacggcaatccaacgcggccgcgctccgcgcggttggcggcctgccggcgccgggcgcgcgcgccgtgcgggtcgaggcgccgaggcgaccggtggccgaactcgatgccgccggtgacgtgctcgtcgtgcggtcgctgtcgggggtgcactcgggcaccagcctgatctcgggggacttctccgtggggatcgaaggggaactcgtcgggccgaacggtgctcagccggtgcgtgaggcgaccatctcaggcaacctccagcgcatgctgctcgatctcgctggcgtcggtgacgacgaggtcgaactgccgagcgggacgcgcgcggcgagcctgctggtcggatccatgacgctcgcgggccgctaggtgcgcctcgatctccatgtccacacctacgcctcgggggactcgacgacgagaccggaggagctcgcggcccgcatcgggcccgatgacgtcatcgccgtcaccgaccaccacgcgatcgtcgcggcgcgcgaggtcgcggcgcttgtcccgggccaagtcatcgtcggcgaggagatcgacaccggcgcgggggagctgatcggtctcgggctcgacgctcgggtgccgccgcgtgcgggcctcctcgagacggcgcggcgcatccgcgacctggggggtctcgtgctcgccccccacccgaccgatcccgcgcgtcgtggtctcggtcgagcgggactcgagcggctcgcggacgacggtctgctcgatctcgtcgaggtcgccaacgccaaacgcgtcgcctgggatcgggaggcggcgctcgtggcacgtgagcgagggatcacacaggtcgccgccagcgacgctcacgtacctgaggctctgttcgcgtcctacgtcgaggtcgccgggccgcggtgcgagatcagagggttgacggagctgctcgcgctccttgcgcgtggggcgctgcggcacgcgccgcgcgatccggtacgtccctggccccggccggtggtcccgggctcctgaggctcgaggacgatcgcgctagacttcgcgtcgtggacgatgtcctgtggctctccgccatccgtcgggcgccggtgcttgggcggggtggtcacgagtttggtcgtgtcgatgacgtggtgcttcgcctcgtcgaagccagctatccggtcgtcgtcggcgtcctcgtgcacgtcgacgaccagcccatgttcgtgccggcagatcgcatcgaggagttcggcaccgagcggatcgtcacgacgctcgaagagggcgagctcggccggttcgagcgtcggccccaggaggtgctcgcggttcgtgacctgctcgagcaccacctgatctggtcgaagtcgaagctgcgtccgcgactcgtgagcgctcgggacctcggcatgatcccgttcgcgggcgagtggcgcgtcatcgcggtcgacgtcgcccaagagcaccatcgacgcttctggcacgccaagcgcgaggcgagggtcgtcgactggcgcgatctcgtccccttggtgggccatgtgccgagtgcgaggatccgcctcgagctgcgctcgatccggcgcctgcacccggccgaactcgccgacctcctcgaggacgcctcggagtcggaggggcgcgagatcatggcggcgctgcaggcggacccggccttcgaagcggacgtcatggaagagctcacgccgcagggtcgtcgggacgcgatccgcgagcgcagcgacgccgaggtcggcgagctgctcggcaccatggagcccgacgacgcggtcgacttgttgatgagcctggagcaggagcgacgcgagagcgtgctcgcgctggtgcccgagccgcagcaggcgaccatcaagcgcctgctcgcctacaaccctgagtcggccggtgggctcatgacgaccgacgtcgtcgcgctcgcggcagggacgaccgtcgcggaggcctgcggcacgcttcgcgcgcgcgccgccgtaccggagaacctgtgggtgctgttcgtcgtcgacgccgagggtcgcttcctcggtcagctgcccctcgtcgcgctccttcgtgccgccgacgacgcctcggtggatcagctcgctgacaccgaggcgcgcaccgtgcgtcccgacgcggacctgacggaggtcgccgtcctcatggccgacttcaacctcgccgccgtggccgtcgtcgacgccgagggggtgctccttggcgcggtcaccgtcgacgacgtcctcgttcgcaccatccaaccgggatggcgccgacgtgccgaagcgctcgacgggtagccgcggcgcgcgtggcgtgtgcgggtcgatcgtggtaggcgcgcctgcgagcgctcgcgcgtgaccctcgctggcgcgctcgtcagtggccgaggtggacgaagctgacgaccatcagcatcaccgcgatcaccaggtaggcccgaagcccgatgagggcgacctgacggcctcgcgagaagcgcgggcggtgcaagagggcagcggcgggcatcgtccagcgcagacggtcttccatgggcatcgtgggacgatggtggcggctgcgaagttgggcgatcgcgacgaccgccgtcgcgacgacgacgagggcaccggtcgcgaggacgagcccgatcacgttgatcgagggcacgatcgtcaccaccgtgagcaccaggctcagctgcaggagcaagcccacgatgaacgttgcgaggacgttgagccaaggcgggttgacccaggggccgaggatctctcgatcgttgcacaggagcagcaagaacgcgagggcgctcggcaggaggacgcccgcgaggacctgcacggcgaggttgatgaggctgagggggagacgcgggatgagggtgagtcctccggcgagcaccacgagcgcgacgtagctcgcgtagaagcctcgagcctcgcggacgggggcgttcagcgactgctcgaccccgaacaagtcgccgagggcataggccgtcgagagcgtgaccgtggcggccccgatgagcgacgcctcggcgagcacgatggcaaagagcgcacctgcgacgacgctgacgtggtggctgaagcccgatgcgatcgcgcctgcgctgccaaacgaccctgcggctcccgcgagcgccgcggcggcggcgatgatcaccgcggcggcggcgacgttggtgacgacggccccgatgaaggtgtcggcacgctcgaagcggatccagcgaggcgtgatgcgcttgtcgatgacgttcgactgctggaagaacagctgccacggggcgatggtggtgccgacgatgccgatgatgaagatggtcgcctgcgaaccgaggccgcccttgacacctgggacgacgaggccgtggagtgcggccccccagtgcaccgggctcatgcccatgagggggaagacgaggaggctcacggccaccaggatcagcatgaagcgctcccagcgctcgaaccgtccggagacgacgctgccgatcagggctacggccatgaggcccgccgcgatcgtcgggctgatcccgaagaacccgagcgcgtagcggatgccgatgaactcggtgacgagggtgaggaagttcagcaggaagaggtcgacgacgctgaaggcggcccagaaggtgccgaagcgctctcggagcagcttgccgtggccgacaccggtgacggcaccgagccggaccaccatctcttgggccaccgcgaggacgacgatgaggatcggcagcgtccacagcagcgtgtagccgtaggcctggccggcctgggcataggtggtgataccaccggcgtcgttgtcgccgaccatgacgatgatgcctgggccgaggatcgcgagcagcgcgagcagacgccggcgccagttgggtgagccagccagtgtgccagcggtgacggaaccgagcccgccacggatgacctcatcctcgggcgtgctcgtgcgggagtcgtgcacggggggacctccacgttcgagacgatggccagaacgagcgcttaggcgcggcgtgcgcgccaagcccggacggagcggcggggacttgagggctcggtgcgcatcccagcctcccttcgctgcgtcggggtcctcagtgcatgcaggggcagtctacgccggatggggcgcgagcagggtcaggcggggacgtgcccgatcacgatcgccgcctccgagacgaccgggatgacctcgacgccgccgaagccagcctcccgcaggatcgtgacccagcgctcgcgggagatcggcctttcctggacgcgcaccacgtagcgcacggcgttcttggcgatgcgccagtacccggccggtccacgggcagcgaaggcgcggaccttctcggcgatgatcgcgcggtcgctggcggactcgccgcgcccgagcatcatgtcgccgatcacgaggcgacctcccggccggagccagccgtaggcggcacggaccacctcggccttcgcgcgatcggagagatggtgcaagacgtagttggagaccacgacgtccacgctgcgaggctcgagcgcgaagcgctcgagcggcgtcgcctcggcggtgacgttggcgaggttggcggcgcgcgcgcgctcgaggaggcgggcgaccatccgctcagagatgtcgacgccgtggacgtggtgggcgatggcggcggcgggcaagctcacctgacccgagccgcagccgaggtcgacgacctcgtcggtggggccgagcgcggcgtgggcgacgaccgcctcgacgacccgttcgagccctggcgaggcctcgtgctcccacgatccgacgcgccgttgccacacggtgcgttggagccagattgcaaggtcttcgctgcgtgccacgcggccagtgtaggagagcggggccgaggtacgcttgagggccatgtgcggccgtttcgaccagcggttcgggccggagcgcctcgcgcgagcgatcgccgagcttgcgacgccgctcggcgctgaatcggcgacgccgtcgggcatcgcgtcccgcggcgtcgtcgtgccgtcggacggcgcgatcgtcgtccgtatgagcccctcgctcgaggtcggtgagctcaccttcggcgtgaggacgcgggccggctcgctcgtcatcaatgcgcgtcgtgagacgctcggcgagcggccgctgtttcgcggtgcgctgtcggggggccgctgtgtggtgccgatcagggggttctacgagttcaccgggccgcgcggtgcgcgctcgccggtgttcttccactggaatggcgagctgcactggctctgcggcctcgccgtcggcgagggactcgtcgtcgtgaccgagcctgctggcgggcccgtcgccgggtggcacgatcgcgagcctgtcgtgctcgatcacctgggcggcgccgcgtggctccgcgacggcgaactcgccacgggcggtgcacacgacgccgaggtcatcgtgctcgatcgctcgtggacgtcgccacgtggcgatcgcgacccgttggcgttcggggggcctaggccggatccgacgtgatctcgggggtcgccgattcgtgcgcgccgagccaggtgcggatcttggcggcgatcccgaagccgtcgaggccgagatcggcgaggagcgcgtcggggggaccgtggtggatgtagcgcgtcgggatcccgagcgtcgcgacggggatggtcgggcgcacggcgcgcagcgcatcggcgaggaacgcgccggcgccgccgtggacgtagccgtcttccacggtgacgaccgcatcggccgaactggcgagggcgatgaggtcggggtcgatcggtcggacgacccgtgggtcgatcaccgtcgcctcgaggccatcgtcgtggaggaggtcggctgcggtgagcgcgggcgtcaccatcttgccgtaggcgacgatcacgaggccagatcccgcgtcgcgcaccacccgagcgccaaggcccgtgccgacgccgccgcggatgcgccggggacccggtgtcttcgagaagcggatcaggctcgggccgtcgagcttgagcgcctcctcgagggcgatgcgcacctcgtcggcgctcgacggcgtaaagatcgtgacgtcggggatcgcgagcatctcgacgaggtcgaggacgccatggtgactcggtccgtcgtcgccggtgatcccggcgcgatcggcgacgaagacgacggggaggtggtgcagaccgacgtcgaggttggcctggtcgaacgcccgagagaggaaggtcgagtagatcgcgacgaccgggcgcagcccgaccatcgccatccccgctgcggcggtgacggcgtgcgcctcggcgatgccgacgtcgaagtagcgatcaccgaagcgttcctggaacggcaggagccccgtgggagcgcccatcgcagccgtgatcgcgacgacacgccgatcgcgttcgccggcatccaccagcgcgcggctgaacgcctcggtgaacgagaccggctcggccccctcgatggtcgtgagcgctcgtggcaccttgaggtcgtgcatgcgctgcacctcgtcgtcgaccgctggctggtagccccggcccttctcggtgagcacgtgtacggcgatcggcccgtcccactccttggccccctcgaaggcgtagacgagctcgtcgatgtcgtgaccgtcgacgggcccggcgtagcgaatcccgagggcctcgaagaacacccgcggctcgatcgcttcgcgcagcgcggcggtcaccgaggcgatctgggatgcggcacgagggccgacacgaggaatgtccgagatgacctgtttgacgcggttgcgcgccgacatgtaggtggggttgagtcgcagtcgggtgagcgacgacgagagtcgggagatcgtgggggcatacgagcggccgttgtcgttccagacgatgatgatcgggagcttgcggtgaccgatggtgttgagcgcttcgtaggcgagcccgccggtgagcgagccgtcgccgaccaccgcgaccacccggcggtgtggtgcgctgccggtgaggtcgaagccagcggcgatcccgtaggcatacgacagtgccgtggaggcgtgggagttctcgatccagtcgtgctcgctctcggcgcgattcgggtagccggacagccccccttgctggcggagcgtgtcgaagatcgcgtgacgcccggtgagcagcttgtggggataggtctggtgcccggtgtcgaagaggatggcgtcacggggcgagtcgaacgcgagatggagcgcgatggtgagctccaccgctccgaggttggagccgaggtggccaccgttcgcgagcacggtcgtcacgatgcgttcgcgcagctcggcacagagcgccgtccgttgggcgggggtgagcgagcggaggtcctctggccccttgattcgatcaagtagttcgtaggacatgtaacccctagcttacgacggcgacgaccctcgttgcacaacgcgaatcattgtccacttcgtcccgtaggctcttcgtcgtggggcactggttctacctcgaggtccttggcctgtgcatactggtgacgctgccgctcgaggtcctcggggcgcgggtgtggcgccagccgcgtcggctcgctctcagcgtcggcatcgtcgccgtctgcttcagcctgatcgacgccgtcgaggtgtaccagcgcctgtggcactacaaccctcgctacgtgaccggtctgcgcatcggtgatctgccgatcgaggaggtcgcgttcttcgtcgtgatcccgatctgttccctcctcacctacgagaccgtgcgacgacgccacgagctcgtcgcgcggtggcgccggcggtgagctacacgctcgaggcggtggcgctcgcgatcgtggccgtcgccatcgactggtgggtcacgcgctcgcgtgtggtgcgaaccgcgtcgttctggatcacctgggtcgtggtcgctgcgttccagatccctgtcgacggagccctcacccgactccgcgcgccggtggtggagtaccgatccgggacctacctcgggatacggctcggccacgccatcccgatcgaggacttcgtctacggctttgccctcgtgctcgtgacgatctccctctgggtccggtttggtcgtcgcgcgagtcgctagggtggtactcaggcgtcgacagagcgtctctggcggctgtcgacggcgaagcaggaggtggcgcatgctcgtgctcatcgcgctgatcgcgttcgtcgcaatggaacccgtggccgcgctcgtccatcgtgggatcatgcacggtgtgggctgggtgatccacgcctcgcaccatcggccccgggaagggacgttcgaggcgaacgatgccttcccgctgttgttcgccctccccacgatcgcgttgttctggttcgggcggcatgaccctgtcgctgttgcgatcgcggtgggcatcacgctctacggcgtcgcctactcgttcgtgcacgacggctacatccacgagcgcctcggtcggatgccgaaggtgcgctacctcgagtacctcaagcacgcccatgcggtgcatcacctctacaacgagggcccctatggcatgctcgccccgatcgtgcccgccaagcatcgcgcgaagctcgagctcgaggcggtgcgcgcctggcgtccatcggtcgcacggtaggagcttcgctcctcgcatcgacgagaccagacagctagcatcgggacggtcgagcgaaggaggctgatcgtgccgaaggtgctcatcctgaccggcgacgctgcggagtctctcgaggtcttgtatccctaccagcgactgctcgaggagggctacgaggtcgatatcgcggcaccgtcgaagaagaagctccgcttcgtggtgcacgatttcgaggagggcttcgatacctacacggagaagccgggctactcgtggcctgcagacctgagctttgcggaggtcgaccccacggcctatgtcgcgttggtcatcccgggcggtcgggccccggagtacatccgcaacgaccccgatttcgtccggatcgtccgccacttcttcgaggctgaccagcccgtcgcgcagctctgccacgcgccgatcgcgctcgctgccgccggcgtgctgcaggggcggcggtcggctgcttatccagcgcttgcaccggacgtgcgcgctgcggacgccgagttcgtggatgcggcggcggtggtggatgggcagatggtgtcggcgcgcgcgtggccggatcatccgagctggatgcgggccttcatcgggatcctccgcgagaaggctccggtcggctgagtaccgtgccggccgcgaccagcttgtcgtaggtcggcatcgcacgacgggtactgtcgcgatcggtgcgacgtctggccacggtggtggcgcggcgaagctcgcatctcgcggcgtcgacggtcgtgtgcgagccgaggtgtcacggcgcacccgtcggtgactcaggggggtgctgtctgctcgagcacgtcccggagagggcaccgtctgttcgggcatcgtctggtcggggcgtcgggtggcctcgccggttggctggaccggttgtacaggaccagccgcgctggatggtcggtgcgagaccctcgcgggcgatgaggtgcgctcgcggtcgtgccgagtgggtcagtcctgcgcggcgaagttcggccggatctggaacagcaagtaccacccgatggcgatctcgatgagcgtctcgagcacaccgccgaccccgacgaagatggcgatgacgatgccgaaggcgagctggaggaccgtccccacgaagatgaggcgccagcctcggtagcgtccgcgcttcagcggtcccgtggccgcgatgtagagtacggcgaagaccgccgtcagggcggctgcgaggtagagctcactcgtaacgtgggtactcacgaagaagatgcccgcgagcgacgagccgagctcggtcgcaaggcgtgcgagctggacggcgtcgagtgcgaagaggatcccgacgacgaggctgatcagccacgcccaacgggtgagccacgccacggctccggcgggtagcttcggcaagccctcgctcagcgagccgaggcgctgctcgagcgcagtgatcacgacgacctccagttctcagcgatgtctcagtgtagcgacactcggtacgacgaagcggtcgttcatggggcggggcgaggagtggcgatcggcgcgacggtcccggcaccgaggtcggcgaggcgcgctgcgtcgatcgcgacgatggtgtcgggcgtgcccgcggccacccatacgacgcccgcacgagcgagctcggcgtcgaccaccacgcaggcagtcggcggcgcgatgagtggggtcgcgcccccgggcacgacgccgagcgcctcgatgaggtaggtccccggtgcgggctcgatgcgctggcgggccgcgcgctcgagcgagcgtcgatgcactctgcgatcgcccgcgacgacggcgagcaccgggccaaggtctccgcggaacacgacggtcttggcgatcttgtccgggtgcgtgccggcggctgcggctgcatcggaggcgaggtgggtcccggtcgcgaactggcgaatggtcgcgaggacgcctcggcgtgcgaggcgctcggcggccaagccagcgggatcggcgagcagttgcggcgtcatgcctcgagcgcgtcgacgatcgagacgccggccgggccgtcgagctcgccgatcacgagcacgcgcaccggctccccggccgcgacaccgtcgccgtcggggaccagggcgagcacgttggcgcccgcgagccctgagagcacgtgggagccctgaaggcggtagggctcgacgacgagctcgccgctgcgaacgtgggcccgcgcgcggacgaggtgcagcttgccgtcggggtggcgggtgatgggttcgagtgccctcgcggtgaggaccgggcgatgccaggtccgagcaccgagcatcttgcggatgagcgggcgtgcgaacaactcgaagctgacgatcgacgacaccgggttgccgggcaggccgatgacgggtgtctggcccatgcgcccgatggcgagcggcttggcgggcttgatcgcgacctgcatccagcgcatggttccccgctccgcgagcacctgcttggtgtagtcgaagtcaccgacgctcaccccgccgctcgtcaggatgagatcggcgctcgcagccgcctcgtcgaaggcgcggccgaggagcgctggatcatcggggatcgcgccgagatcgctgggaatgcctccggcctctgcgacgagggcgaggagcgcggggcggttcgagtcgtggatcttgccggggggaagcgggtcgaggtcggtgagctcgtccccggtcgagaacaccgcgacccgcggccgacggtggacgaagaccttgcggacgccgagggacgcgagcaggcctctgaccgctggcgtgacgggcgtgccctcggcgaggactcgctcgccggcagcggcgtcggagccgcgtcgacggacgtgcgtgccggccgcgatcggagcggtgaggtggacctcagagccgtcgacgatgacgtcctcgacgatcgcgatcgcatctgcgccctttgggatcggggcaccggtcatgatgcgtgcggcggtgcccgcggtgacgacgacgtcgttcgggtcgtggccggcggcgatggtagccacgatcgacaaggtcaccggcgtggcgcggctggccgcttgcgtgtcgacgctacggacagcgaagccgtccatgccggtgttgtcgaacggagggagcggatcggcgacgacgaccggcgcagcgaggacggcaccgagtgcctcgtcgatccccacctcgaccacgggtctcgcaccggcaagctcgagggctgctgcctgggcttcagcgagtgggatcacggtcctcctctgtcgtctcgaggagctcggtgagcacccttcgcagcgccggaccgaggtcgggccgttgaagggcgagctcgacgacgctccggaggtagtccagcttgtcgccgatgtcgtagcggtgacggccgtcgaagcgcaccgcaacgaccggctcgtgctcgatcagccgtgcgatggcatccgtgagctggatctcgcctcccttgccgggcggggtctcggcgagggcgtcgaagatcgccggcgtgaagatgtagcggccggtgatggcgagattcgacggcgcctcggaggcatcgggcttctcgacgacgctgcggacgtagtcgacaccgtcctcgtcgacgacaccggcggcgccgtagagcctgatgcgctcgggcgggacctccatgagcgagagcaccgaggcgccggtgcgctcgtggagggcgagcatgtcggccaggagcggcgaggcgggtcccatgatgtcatcggcgagcatgacgacgaaggggtctcggcccacgtgctgggcggcgacgctcaccgcgtggccgaggccacgcggttcgccctggcggaggtagtggatctggccgagatgggagatgtgctcgaccagcgccagttcggcgaacttctcttgcctggcgaggaggagctccagctcgacggcgcggtcgaagtggtcctcgatcgatcgcttgccgcgcccggtgacgacgaggatgttggtgaggccgtgcgtcacggcctcctcgacgacgtactggatggccggctggtcgacgaccggcagcatctccttcggttgggccttggttgcagggaggaaccgtgtgccgagcccagcggctggaatgaccaccttggtgagcacgaccgcctccatccatcgtctggcgcctggccaacagagcggagtctaggcgacgagaagggccaggttggggcctacgatggaaggtaccaacgtgcgcgccgtgtgcgcgagttgcgatcgtggtgcgatgagtcgttcgaccgaggtcgaggaggacaccgatgccgacctacgagtatgcctgcaagcagtgcggcgagcacctggaggtcgtccagtcgttccaggacgagccgctcagcgagtgcccgcggtgcggcggcgagctgcgcaaggtgttcggctccattgggatcgttttcaagggttctggcttctacaagaccgattcgcgtgcgagctcgtccgggtcggtcggtcgcagccacggctccggtgggagcgatgccgcgagcgctcccgcgtcgacctcgtccacgtcgacgtcgaccacgggcgctgagtcgtcctcgtcgagttcgtcgacggctggctctgccgcctagggtcgcctgcccgggcccgggggttaccggacggtaggctacgtccgtgcacaaccaccaggcctggtgcggtccttcggccgtgcgagcgagtcggggcgccagctctcgtggctgaggatcgtcttcgtatcgccctcacggtgtatcgagggaaccccacctccggaggccaaggcgtctacacggccgaactcgcgcgccgtctcgtcgcgcggggccacagcgtcaccgtcgtgtcgggtccaccgtatcccgcgctcgccgagtcgatccgcctcgagcccctcggcggcctcgatctgctgcgccagccggatccgtttcgccggccccgactcgacgaactcaccgacgcctacgacctggcagaggtcgcgctcttggcgaccggcgccttccccgatccccgcgcgttcggcctgcgctttcgcgcctggtggcggcgtgagggtcatcggttcgacctcgtgcacgacaaccagtcgctgacgccagcgcacgccgagctcgtgcgcgacggcgtcccggtggtggccgcgatccaccatcccatcaccgtggatcgccagctcgccctcgcggccgctggatcggtcaaagagcgcatcggcctgcgccgcttcttcggcttcgtgccgatgcaggtgcgcacggcgcgggtgatgccgcgcgtgctcaccgtctcgtccgcctcggctcgtgacatcagccgcgagctcggggtggcgcgctcgcgcctccgggtcgtgccgatcggcgtggacgcggaggtcttccgacccctcgaaggggtgcagcgcaccgccacgttgctcgcgaccacggcgagcgcggatgtgccgctcaagggtctcggggtgctgctgctcgcgctcgcgcgcctgccgagcgacgtcgagctcgtcgtgatgggcccgcgccgggagggctcccccatcgaggcgctcatcggtcagctgggcctcggtgagcgcgtgcacctcgtcggtgcggtgagccgcgagcggatggtggaggtgtacgcgagcgctgcggtcgcggtcgtgccgtcgatgtacgagggcttctccttgcccgccgtcgaggcgatggcctgcggggtgccgctcgtcgcgacgaccggtggggcgctcgcggaggtcgtcggcgggctggcgccccaggtgcccccgggcgatccggtcgcgttggcccaggcgatcgccgcacagctcgccgaccccgccggcgcccgcgagcgcgccgcgagcgcgcggagccgggtgctcgcgcgctactcgtgggacgaggcggctcggcgcaccgagcaggtctaccgcgaggtgttggaggcgtgatcacctttcggccggagcacctcgcaccgctcgagggtcgtcgcgtgctcgacctcggtgcgggtggcggtcgccatgcggcatggctccgcgaccacggggccctcgtcgtcgccggcgacctcgtcgtcgaaccgaccgatcgtgagggggtcgactgggtccgcctcgacggtgcggctctgccctttgcggacggctcgttcgacgtggtgctctgtgccgaggtcctcgagcacgtcgcgcacccggctcaggtggtgcgcgaagcgcggcgtgtgctcgcacccgggggccagctggtcgtgagcgtgccctcggcgtggccggaggccgtctgttgggcgctgtcgctcgagtaccacgccgttcccggcggccacgtgcgcatctggacgctcgcagggatccggcgcctcctcgaggccgagggtttccgcgtggtcgcgcgccatcgccgtcacgccctgcacgcgccgtactggtgggctcggtgcctgctcggcgtggagcgctcgggtcaagatccgcgcatcgagtggctggggtggcgtctcgtcaaggcggccgtcggcgaggctccgctgctcgcgcgcctcgagacgctgctcgaccccgtcctcgggaagtcgctcgtcctctatgccgaggccgcaccgtgctgagccggagcgagctgcgtcgcaccgcggcggccatcgcgagggtccagttgccctcggggatgatcccctgggccccgcgtcgccatggcgatccgtggaaccacgccgaggcggtcgccgcactcgcgctcggtggggaactcgccgccgccgagcggggtctggactggctggcgggcgtggtcgcgcgagacggtgccttctgtcagtactacctcgcgagcggcgtcgaggagcctcggatcgacctgaacgtgtgtgcctacccgatcgtcgcgatcgtcgcgtgggtcgcggcagggggctcggtcgcgaccgcacgggcgcacctcgcgtggtaccggcgcaccctcgagctcgtcctcggccaccagctcggcgacgggaggttcccctgggccctcgaccccgggcgtcgtcccctcgagggctccttgcgtgccggttcggccgcgatggtgatcgcgctcgatggcgccgcctgggccgcgaacgaactcggggtgctcgaggctgggccgatcgaggaagcgcgctcgcgtctcgcgctcgcgatcgccaaggacgaggggttcctcgaccgcttcgagtggtcgatggactggtactaccccgtgctcgcgggcgtcctcgagctcgatgcggccgaagatcggctcgatggactcttcgagcgggcgcgcgagtcgaccggccagctgcgctgcgtgctgtcggctccgtgggtgacgacggccgagaccgccgaggcggcgatggcggcctggcgactcggtcgcatcgcagatgcccgagcgctcctcgcgtccgtcgagtccctccgcgaacccgacggctcctaccgcaccggtatcgtcgtgccggagggacactccttcccgaccggggagtgctcgacctactcggcagccgcggtggtgctcgcgcaccacgtgcttcgtgccccgccgcgcgccggcctcatcgaggccctcgtcgcggcctcgtagcgcgcctcgcgatggcgagcgagccggtgcgctcgacgaggtcgaagccgaggtggagggcggcggtgagcatgcgccacggtgcctggcccccgtcggccgggtcctcgaagacgtcgtggacggcgagcagcccgcccggtacgaggaagcggcgggcgagctcgagatcgagatggcagctccgcgcgtcgtgaccgccgtcgacgaggacgaatcctgccaccgggcgcacgaggtcgatgaggccacgcccatcgcccacccagagggtgacgtgacgctcgaggtcagcgagcgccagggcgtcgcgcagcgtcccgagcgagtcggggctaccgaggtcgccgtcgaggagacgcgggtcggcccaggggaacggtgggcgcatctcgatggagccccggtggtggtcgacggcgaggaggcggaggcctcgttcgcgtgcgaccgagccgagccgcacggtcgagcgaccgcagtaggaaccgagctcgacgagccatccgcccgctcgcggggcgactcgcgcagcctcgatgagcgcacggagctcgtcggcggggaagaagcccgggagtaggtcggcgagagcagccggcccgtctcgcctaggctggtcggcgtgcagcttcgctggatcgtcgtcgcgctcgtgacgctggcggccggcggcgccctcgggggcgccggctggatcgcgggtgccatcgcggcggccgtggtcgtggccgccgggaggcgatgccgaggggcctcgtgcgcgagctcgcacggcgggctcaggcgagttggctggtgagccgtcctgcgtagcgggcgcgcaggcgcaggttgacctggtagcgctccagggtctgggcgagcacgcgcttgcccgccgggatcgggtgctcctcgaggaagcgtacgatctcgccggcgcgctggtaggtggtcggtccgatgacgagcgcgatgctctggagcatgcgatcgatcgtgttgagcgggaatcgggcgagcatctcatcgaagcgagcgaacaagaagtcgatcgcctggttctggagcgctgggttcgcgatcactcggttgatgaggaagggtgcgtcctgggttcgcacttcgctcatggccagatccagcacgcgccgcccgagcgctggttggcggaactccgcgagggcgaacaggtgacgctgctcgtcctgggggttgcgcgggtgccgatagcgatcgagcatgaaggcaaagtccgactcatcaccgaagcgcgcgacgacgccgaggacggccgcgacgagatcggcgctcggcccgccgatgccgctcatctcctcacggaagcgttctctggcgtgctggcgcacgtcgggatcctcggcgatgtcgccgagcacgtcgtaggcgatggcacgcgcggtgcgatcctgcggggtgtccgtcgggcgggcctcggtgccgaagtagtcgaggaccggtccgaacaccgaggccgcgagggcacggacgtgggtgatctcgctcggttcggcgatgcgctccagcaggccgagtgcggcttggccgatcccgaggatgttcgggtcgcgctcgtcgcggaggcgctcggcgagaccgaggaagtcctcgagtggcgcggcgcccgactgggtgagcgcccatgcatcggcgatgaggttgaagcgctcgagcgtctcgagctggccgaacgactcggccagctgggcgaggagctgttgggcgtagcgggcccgaaagacgccctcgccgtgggcgttgaccacgaccggcgcgggaccgacctcggccgacatctcgggctggtcgagcagcacccgccgctcgccatcgacgagcgagcgcagtgcgatcggcacgtgccacagtgatccgatggcgccgatcggatcgtcgtcggccgcgaggagccggaacggcgtctgggcgagccggacgccatcggggagcggatcgacgctgacgagcggatggccgccctggaacacccaggtgtccatcatggcgccgacgtcggtaccgctcgcctcgccaagggcagcccagagatcctgggtctcggcgttgccgtaggcgtgggcccgcaggtagcgacgcacgccgtcgcggaagacctcgggtccgaggtgctcggaggccatgcgcaagatggacgcccccttctcgtaggtgagaaggtcgaacatgtcctcggcgtcctcgggtgcgcgcaccgtgtactcgatggggcgggtcgagggaagggcgtcgatgcccatggccgcgagccgaccgatggcaaaggcctcccaccggcgccactcggggcggaaggcgtcgacggcggtgacctccatgaaggtggcgaaggcctcgttcagccagatgccgttccaccagcgcatcgtgacgagatcgccgaaccacatgtgggcgagctcgtggcagacgacgtcggcgacgcgctcgagatccacctgcgcggcgttgtcgcggtcgacgaggagggcggtctcgcggaaggtgatcgcgcccaggttctccatcgcgccggccgcgaagtcggggatcgcgagcaggtcgaccttgggggcggggtaggcgatcgcgaagtagtcctcgaagaaggcgagggcgtgctgggcgacctcgagagcaaaggccgtgagctgctccttaccgggcacgtgcacgacccggatggggacgtcgcggtggaagaccggctcggtcgcgacgaagcggccgatgaccatggcgagcaggtaggtggacatcgtcatcgtgggcgcaaaacgccaccggtcggtgccgggtgcgatcgtcgtgcgctcggtgacgggatagttcgagtaggcctcgaggtggctcgggatctcgagcgtgacggcgaaggtggccttggcgtcgggctcgtcgaagcaagggaaggccttgcgcgcaccggtggattcgaactgcgtcgtcgcgatgcgatgcgtcgtgccgtctgcgtcgcgataggtcgacaggtacagtccgtcgaggtcccgacgcagcgcacccgagaagtcgagatcgagcgcgaaggggccggctggcatgggcgcatccgcgtggagctcgaccacgccgtgctcgctgcgcgggcggggtgtgagggtgacgcgcgtcccggcgaacgtggcgatcgccgacgagatcgccagatcgaccgcgtgcacctcgagcaccgcggtgggctcgtggacgtcaccgtcgatgcgcacgtgacccgtgtaggggtcgacgtccgggtcgacctggagcgtgaggtcgtagtgtcgaggggtccagacccgcgaaagccggtacgggttgtgctctgtcacgggtgccacgctagctcggcccaggtccctgtgagacacgatgccaccggtaggctcgccgtgtggccagacgagacgtggtagcgctggggtcggcgatcgtggatctcggggtgcgggtgcgcgctcgggagatcgatcgtctcggccttgcacgcgggacgatgacgcttgccgaggccgaggacctcgatcgcctgatcgaggcggtcggtggtgaggtcgagatccgaggtgggggatcggccgcgaacacggccgtcgggctcgcttcgctcggggtcgacaccgccatggtgacccaggtgggcgacgacgacctcggggagcggtgggcaagcgaggtcgccgaggccggcgtcgaggtcgtgctcgtgccggcgccaccgggctcgcggaccgcacgctcgttgatcatggtcgacgaggggggagagcgcaccatggtgacctcgctcggggtcgcgagctcgctcgatgtcgacgagctccctctgcccctgctcgccgaggcccgctggtgcttcgtcgagggctacctgctcgatgcggccggcgacggactcttcgagcgcctcgatgtggtccggcgtctcggcggtcggatcgccctctcgctcggtgaccaactgctcgtcgaccgtcaccgcgatcggctcgtgcgggctctcggtcgcgtggtcgacgtcgtgctcggcaacggcgccgaggcggcccaactcgtgcgtcgccaggccctctcgaccatcgtcgaggagctccaggctcgcggcgtcgagggcgcactcacgctcggcgccgatggcgcggtcgtcttcagcgcggacgaggcgctccatcagcctgcgcccgagaccatcgcagacgtcgtcgacaccaccggtgcgggcgatcagttcgcggccggctaccttgccgcgctcgtccgcggtggcgacctctcgagccgagcgatgctcggcacgcacgtcgcgaccgccgtcgtgacgcacgagggcgcgcgtccacggcccgacaccccactcgccgcggctccggcgctcaccgaactcttggccgggctcggactgagtcgtgaggcggatcccgccttcgacgagcggtcgagcgatgagcctgtggcgggggagcgccacggcgagtgacgagccatcgggcccgcgcgggtgggccgtggacctcgtgtgcgtgcggtcaggtcgccctgcgtcgttcgtcggcgcgcggggggcccgccatggctcgggtacctcggcgcgcaggtgccggcagaagttgcgcgatggtcagggcgtcgggctgggtgagggaccaggagcagctgggctgcgacgattcgtgagccagacgagggtcgcgagtgcgacgccgaccccggcgaagagccaggtcagctcccgcgcgccgaggcgcgggaggaggagcgctgccgcgagacccgccgcggtccacccgatcgagtagctcgcatagaggacggagaaggcgctcgtgagttcgttgggcgcgaacatggtggggacgagtccgacgcggagcgcgttgatcggcgcgatggcgatgcctgcggcgacactggtcgcgagccagagccacgcggcaggcgccgagagcccccaggcagccagggccgctccaagaccgagcacgagcgctgcgagggtgctcacacgtgcgggccgatggctccagatgcgcgtgtagacgaccccgctcgcgaccgagccgacgctcatcgctgtgagtgcgacaccgccgagcgggctcgatcggagccagtgcacggcgagagggaccgcgagcaggaccgcacccccctcgagcacgccctcgagcgccgagagcacccagagccaggtgccacggcggagccggtgggggagggctcgctggtcgatgtgcggcctcgtgcggtagcgaagtgccccgacggtggcgacaaggccggcgagtgcgacgaggtcgaggaggagcggacggaggccgacgacgacgaggacgctggcgacgaggggcgccccgagccacgtgagctcctgggccaccgagtcgatggcgaaggcgcgcccgcggtcggaaggatcgaggcgatcggtgaggttgcggcgcagctcgcccgtgacgagggtcgctgcggcaccgacgccgaacgcgccgacggcaccgagggcgagtggggcaccgacggtgacggcagcgagcagcgcggcggcgcaggtcatgaggccgaggcggctggggagcgacgcggcagcgacgaaggggacggcgagcagggcgagcgcgccgacctcgccgagggggacgagtgccgcgaggccgctcgcggtggcgtagccaaggcgcgcaccgacgacgtaggtgatcgcgatggggacgaggaagttcgcgacgcgatagggggtggcgagcgcgagccatcgagcgagcgcgcgaccgggcggcgcgctgcgttcgaccatgggagtcaccctaccggcgagcgcacgacgaggtgggcagggcagcgctcgtgtgattggatggtaggcgtggcacttccactcgaacagtacggcttcgtcggcgatctgcacaccggcgcgatgatcggtgcggagggcagcgtggcgtggctgtgcgtgcctcgcttcgacgccgatgcgtgcttcgcgtcgctcctcggcgacgagtcgaacggcacgtttcgcatcgctccgtcgggcccgttcgagtcgacgcagacctacgtcgaggacacgctggtcctcgagacgacctttgcgacccggactggtcgtgccaaggtcatcgacttcatgccgatccgagagcgccatgcacggctcgtgcgcatcgtcgaggggatctcgggcgaggtttcgatggaggtgaccctgacgctgcgcttcgactacgggcgctccattccgtgggtgcggcgcgtcgcgcgtggccactcgttcgtcgtggggccgatcgcggccctgctcgagaccccggtcgagctcgagggtcgcaatcagcgcacggtcggttcgttcgtggtgcacgagggcgagcgggtcccgttcgtgctcagtttccacgactccgtcctccccccgcccaggcggatcgacccccagctcgagttggccggcgtcgtcgagtggtggcggcgctgggtcgccacttcccaggtgcgcttcggtcgctacgagccccttgcgcgacggagcctgatcaccttgaaagcactcacctacgccccgacgggtggcatggtggccgcgctcaccacctcgctccccgaggaccccggtggttcgcgcaactgggactatcgcttctgctggctgcgtgacgccgcgttcgccgtggaggcgttcctcgcgcgcggcatgctcgacgaggcccgcgcgtggcggggttggctgttgcgcgccatcgcgggggacgcgcgtcagatccagatcctctacggggttgggggtgagcgcaggatccccgagctcgaactcgagtggctgcccggctacgaggggtcgcggccggtgagggtgggcaacggcgccgcgggtcagttccagatggacgtctacggcgaggttgccgacgtgttgtggcggatggtgcgagctggcatccgtcccgacgagaacgcatgggagatccagcgctacctgacggacttcgtcgtgtcctcctggcgtgagcccgacgacgggatctgggagatccggggcgagcgccagcacttcacccactcgaagatcatggcctgggtggcgatcgatcggggcgtcaaggtcgccgaggcgatgggcgtcgaggcgccctcggcctggcacgcggcccgcgctcaggtgcacgccgccgtgctcgaggaagggtggaacgagtcggtcggtgcgttcacccaggccttcgggtcgacgcggctggacgcggccgtgctgctcgccccactcgtcgggttcatcgaccccgacgatccgcgggctcggcgcacggccaagaccatcgcccgatccctcacgaagggcgggttcgtccagcgctacgagccgaccgccggtgtcgatggcatcggcgagcccgagggtgcctttctgccctgcaccttctggctggtgcagaacctcgccctccagggcgaagtcgacgaggccgaggtctacttcgagcgtgcgagccgggcggccaatgcgctcggcatcttctcggaggagtacgagccgacggagcgacgcatgctcggcaacttcgcccaagcgttcacgcacgtcgccatgttgcacgccgcccacgcgctcgagcgtgctcgcgaggcccgtcgcgacggtgagcgtgagcgccagggggcctagcctcagttctggagatggtcgagcaacgggaaggactggccgatgacgcagaggattccgttcgtgctcttcggggcgaccggcgacttggctcgccgcatgctgttgccggcgctcatgtcggtgcgagagcgccatgcagactaccagttggacatcatcggcgtcgcgggtagtcgtttcgacgacgagagcttccgtgcgcacgtggtggagatcctcaccaaggacaagcgctgctcccgcgaggaggccgagaccttcgcgaagaccatcagctacctctcgggcgactaccacgacccgaacctcttcgacgcactggccgctcgggtctcgcccgacgagcgtcctatcgtctacttggccatccctccctcgctcttcgaggtcgtgatcgaacagctcgcgcgcgccggcttcgacgagcacgctcggatcatggtcgagaagccgttcggccgtaacctcgccgacgcccagcgcctgtcgaaggtgctcgcaagccacttccgacccgagcagatcttccgcatcgaccacttcctcggcaaggaggcggtgcagaacctcttggtgttccgcttcgcgaactcgatcctcgagccgctgtggaatcggaactacgtctcgcggatcgagctcaacatgctcgaggcgttcggcgtcgaggggcgcggcgccttctacgacggcgtcggcgtggtgcgcgacgtcgtgcagaaccatctgctccagctgctcacgctgctgctcatggagcccccgctcgcgatgagcgggcgcgacctcaccgaccagcgcacgaaggtgctccaggccatccgtccgatccggcccgacgacgcggtgcttgcccagtaccgtggctatcggctcgaggccggggtggccgacgactcgtccacgcccacgtacgcggcaatccgcctcgaggtgaactcctggcgctgggcaggggtgccggtgttcgtgcgtgcgggcaaggggttgcgcgagacccgcaccgaggcggtcgttgagttccggcgcccgccgacgctgatcttcggcaccggggaaggggagcagcaccagcccgagccgaacgcgttcatcttccacttcaagcccgacgggcgcatcgagctcttgatgcagtcgaaggtgcccggtcctcggctgatctcgagaccgacgatgctcacggtgtcctcctcggacgactcggcgcgctccgacgacgcctacgcccagctcatcgacgacgtggtgcgcgacgatcagacgcgctttgcgacccaggagtcggtggaggctggatggcggatcgtcgatcccgtgctcgaggcgccggccgagtcgacctacgtcgtcggcagtgatggaccgcgcgaggccgatcgcctcgtcgccgacgtgcatgggtggtatcgatgacggcgcaggtggcgagatgggggtccgacgatgagtgacgagatcctcgcggtcgatctcggcgggacgaactttcgcatggccaaggtgagcagcgagggcgtgctgctcgctcgggccgagatcccgacggcgtcgatcaccgacgtcgtggacggcctcggtcggctcgtcgaccaggtcgacggtggcggggtcgcaacgctcgtgttcgcggcccctggcgtcgtcgaccgtgacgcgggcacggtcgtcttctgcgggaacctcgatgacgccgtgcggcgcaccatcgtcgcgagccggatcgccgatgcgctcgccaagcgcgtcgtcctcgtcaacgacgccgatgcggccgccatcggtgaggcgtgggcgggagccgggcgcggcgctcgaacggtcgtgtacgtgaccgtctcgaccgggatcggtgcgggtctcgtccaccgcggcacgctctacgtcgggcgcttcacgggcatggaggccggtcagatccgtctcggcctcgaagacgtcgatcgcgccgagcacgtcggttcggggaccgcgctcgctcgtaccgcccgccagctcgggctcgagctcgccaaccccgaggtcgtgcgccgcgcgcaccaggagggtgtcgcgcgcctcgcgctcacccgcacgatggaggcgctcggggtcacgctcgccaacctcgcctggctcctcgtgcccgatcgcatcgtcatcgggggcgggctcggcctgtcggatccgctggtcctcgagctcgccacgcaggcgttccaccgcgccggcccggcgttcctcgaggatctctccatcgtcccggccgcgctcggcgacgacgccggactcatcggggcggcgttcgcggagcgggcgctccaaggcgcccagtgaggttctcgctccagtcgacgcgctcgctcgcagcgctcgctggggcgagcatcctggtcggtgcgtacgatcaggcagcgatcggggtcgccctcggtccgctgcgacgcagctggcacctctcgagctccgaggtggcgctcatcgcctcggcatcggctgcggggatggtggtgggtggcctcgtggccgggttcctcgccgatcgctgcgggcgtcgtcgcctgctcgtcgtcgacgtcgcgctgctcgcgctcgcgagtctcgccgctgcgttcgcacctggggcgggtgtcctcctcgctgcgcgcttcgtcggtggggtcgccgtcggggcgagctacacgatcgtcttcgtctaccagcgcgagctcacgagcgccgcgatgagcacgcgttggatggcgaccacgctctgggcggccaactggggcatgcttcttgcctacggcgtcggcgccgtcgcaggtggcaccacgttgggtgcgcgcatcgtcctcggcgtcggtgcgctcggcgcccttccgctcgttgcggcccgacgtcggctcccggagacccggacgacggatgggcacctctcgctccgcgcgagcctcgcagccctccgttcggtgcgagagctcgaggccgcgggggcgtggttcctctatcagatctctgaccagggcatcaacgtgctgctccccatcgtcgtcgccagcctcggcgtggtgtcgctgcggagcgccgatgcgacggcgctcgtcgtgaaagccgtgaccatccctgcgtcgctgacgacgatctggctggtgggttggctcgggcggcggcgtctccagttggctgggttcctcggccgagcgctcgccctcgggctcgtcgcggtcgccttcgccctgggcgctcctctcgtcgtgaccgtgatcctgctcgcggttggtcttgcggcaggctccatgggccccgacaagacgacggtgatgggggcctgtctcgaggacgagccgatggcgctcgcgacgcgccagggcgtcgcacagaccgcaggtcgcctcggtggcatcgtgggaccggcggcgttcgtgctgctgaccagcgtcggtggcccggcacccgggatcgccctgttcgcgctcagcgcgctcgcgggctgggccatcaccctcccgatgacggcgtgagctggtcggtcggctagctcgcggcttctcggggcgcgtcgcccaccagcacgtcggtcgcgacctcgggagcgacgacgttgatgggcacgccggtgccgagctcgaagcctgcacgggtggtgagcttcggatagacgtgggcgtgccagtggaactgcccgaaggcgcgatagggcgatgagtggaacaccacgttgtaggcgacgggcccaaggcgcgtccggaggcgtgcgaggccgtcgcggaccatctcgccgacggcgaacaaggtctcctgggcagcgaggtggaggtgggctccgtggtgacggggcacgatgagcagctcgaacggcgtcgccgaccagtagggcgcgatcacgaccgcgtgttcggttccgagcacgaggcgctcaccgatgctctcttcgagtgccaccgtgttgcagagcagacatcccccgacgaagcgcgcaaaacccgcctgctcgtcggagagctcgcgtgggacgaaggagatgccgaggagctgtgcgtgggggtgggccatggaggcgccggcgtcacgcccttggttgacgatcacctgggagtagcggatggcagccgagtgtgagtgcgcctcgatccgatctcggatggccgacatgaccacgtgcgtctgctcgtcgtcgagcgctgcccagctcgcgtcgtggtcgggggtgagcacgaggacctcgtgaatgccgctcgcgggtgcgctcgtgaagaccggtccgtgggtcgtcgagaccatgggctcgtcaccctcgaaggcgggatagaggttcgggacgacccgtacgctccacgagccgctcggcccgtaggtctcgagggcgggaggggtgtcttcctcgttgcccgggcagaaggggcaaggacgcgagtcgtcctcagggccgtgctcgtcggagagggcgagggcctttggacgccagcgacgctgctctgcgacgacgacccagcgaccggtgagtggatcgaggcgcagctgatgcgtggccatgggctccctctgctgagaacggacttatcgcccccagcgtagcgcgtcggcggttgctcgggcgggcccgccggtcgctggcgctcgtcgtggttgggtgtcgcctcgtagactcgctcccatggcggtctacctcgaccacgccgcgaccacgcggatcgcgcccgaggtcagggcgctcatggttgagctgctccgcgtcgagggcaaccctgcggccgcacacgcctgcgggagggccgcgaaggccattctcgagcgggcacgggtcgaggcggccgacgcgctcggcgtctcgtctcgtgaggtcgtcttcacgggttcggcgaccgaggcgctcgacatcgggatcggcgatctcgacctcgcgcccgacgtcgtcgtggccacgagtccgatcgagcaccccgccgtgctcgatgcgctcgcggggcggcccatcgtcgagcttcccctcgacggcgaggggcgagtggccatcgggtcggcgcgcgagatcctccgcgacctcggcccacggctcggagcgctcgtcgtgaccggggctgcgagcgagaccggcgtcattcagcctgtcggtcggctcgcccacatcgcacgcagcgtcgctgcgaaggcggtcgtcgtgagcgacctcgtggcgctcgcaccgctcgggctcgacgcgggctctccggctcgtcggatgctggaggtcgtcgacgtcgcggtggtcgcgccgcacaagctcggcggtccgacgggggtcggagtcctcgtggtgcgggagggaacgccgctcgcgccgcggcgtcgctacgtgggccaggagcgcggcctgcgcggtgggacacaagcggtgtggctggcggggggtgcggcacgcgccctcagccttgcggctgcccagggcgcgtcacggcgcgaggccatcgtcgcgcgacgtgaacggctcgagcaagcgctcgtggaggcggttcccgctgccaaggtggcaggcgcgggtgctgcgcgtgtcgggatcagcctggtggccgtccctggggctcgctcggaggaactcgcggtgctcctcgacaccgaaggcgtgtgcgtgtcggtgggggcggcctgtcgagcgggtgctcccgagccatccccctcgctgctggcgatggggtgggacgagcccgaggcgcgatcggtcgtacggctgagcgtcgcgccggagacgaccgacgacgacgtcgtcgcggcggcgatggcgctcgcgcgtatcgcggagctcctcggggccgccgggtgatcggtcttctgtcggccacgggtccgatcgcgacggtgctcatccttgcccatgtcggcgtcgggatcgtgggctatggtaccaatgcgctggccggctgggacgcaagcgaggtcctgcgcggtcggacggaggggcggcggtttctcgacgggagcgtcgcgccatcgcagctcgccatgctctgggttccgatcctcggggcgctgctcgtggcactcgtcgatccagaggcccttggcacggcgtggttcctcgtcgcgttcggtgcgtggtgtgtgagtgtcgcgctcgtgctcgcggtggcgtggccggcccagcgagaactcgggcgcttgctcgctgcgacgtcggccgtacccgaggcgctgcgcagaccagctcgacggatgctgcgtgcgcagcagctcatcgtggtctgctacgtcatcgcgttctggttgatggtgctgaagccagggaatcggtaacgatctgcgtcgtacgagcgtgatcgattggggtggtggcctggatcgcaaggatgccgatcatggatcggactgatcgccgggtgcgcgatgcgacgggccttctcccagccagtgtgacgcctgctaccggaggagagaattgacatgacgccgagctcgcccgtcgcgtctctgccgcgcggcgccgacgaggacgccaccttaaggcaggtccgacgaacgtaccctcgctggtgctcgaccagcggcgcaggtgtgttggcgtcggctgtgacctcggcgcgagcgacgcgactttggcaactcgggtgggccgggaacgcatcgatcgacgtgagcaagcccaggagcgcgcgcgtccacgcggcgacgccgccgaggagtggctggccgcatgagcatctgctcccaccgcgaatcgagagacctgtgccacacacatggtcatagcagacaggcgatgctcttggcgactcgccagaaggtgtcgcagccggcatcggtcccggttggggtcgcaagaagacaagcctgtcatgagccacatccacgacacgccctcatcggtggacgtgcttgcgatcaagccaccgcagcgggccgggatcactggcggcatcggtccccaggcggacaggtcccaggcattgcaccccgacggggtcactcggttcatgcgtctcaccgggaaccagacgacgacattgatcgatcctgccagcaggcccgaggccagccaaggacgatacgtacaggtggttcagtccgctcccacgacactctcgtgccaacgtactcggctgtgtgcgagggatggggcatcacgtcagcagggagggaactgtcgactgcacctcggtcgaatgcagggaccgagaacaccgcccaggcacggtgtgcctgggcggtgtggagtgggggatcagtggtctagtacagccgtgcgagggttgaggccggctccagatacaccgtcttcaagttgccgctcggggtgaactgcaccacctcgaaggaggagaagacgttgtggtactggttgaagttctcgttgccactcgcgccctcgtagttgatcttcttgccctctttgaggagtgttgcgcagctggtgtagctgtagcacttgatcccaggagggttcgagaccttggtgatgtagggccgccacaccgtgggattggacgagtgggctgcatccatggcgagtgccgcgataatcaccgcgtcgtacattgccggggaggccggcaggggctggttggtgtgccacaccgcctcgtaggccgacaggaaggccttgttcgactgggcgtatcccggaggcgccgccatgccggtcagccatcgagacgcattggagagtcccatcgcctgagccatctgcagtgacgcacccgtgtcgcccgtgatgtaggggatgttgagatgccccagctgtttgacgttggcgaagaaggtgctcgctgtctgcggatccatgtggaagaacacgcatcccggctgtgcacctgagaacatcttggccacgaccgacaggtaggagctctggcccgccacgatcgtctcggaagcgacgatcttgccaccgagcttctcgtacgcacgggtcactggtccaacctcggcttgcgcgttcggcccggagtcgtacacttctgccgcctgggtgcagtgcttggccgtgtaggcgtagtaggcctcgcccgacaggagctcagagtctgacgggaacactcgatagacgtatgggtagcgcatgtagtcgagctgcgtcgtgccgccttccatgagatcgaccacgtggtcaggaccgaagtcccggatcacgccctcgatctcgagcgaggacggtccaaagaccacgaccggcttcttgagcagcaacgtccggagcgccgtgactgcgtccacagggtcccccgcagtgtcctcgagctgtgaggtgatcttcgcgccgagtacgccgccaccgtggttgaccgcgtagatgcccgcgagcacgccgtggtcgaaccattgtccgacgaacgcctccttgccgctcatcggcagaaggatgccggcttgaatcggtccggtcagcttgccagaggagctcgccgagctggccgacgagctcgacccgcatgctgcgagcgccagagatccgagcgcagcaagccccgccgccatgccacgggtccgccaccggcgagtcccctgtcggttccgttgcatctatccttcccccttcgttgtcactcgtgatcttgggaatcacgatcccaggaagaggcgaccgccgcctcctccgccccccccgattggccgaggaagattgctgccatgtcgagctttgcgagctctgccggcgccccgtcacgaagattgcgtccggcgacgaggatgtagacccagtccgcagaggcaagcgcccgctcgacgttctgctccacgacgaccacggtcgtcccgagggcggccacctgggcgatctgcgaccagacaacgtccacgttcgccggtgagagaccggcagtgggctcgtccaggagcaccaccttcgggttgctcatgagcgcacggcccatgccgagcatgttgcgctggccaccggacagcagacccgccttgcgcttgcgggccagcgccaaggcggggaagatctcgaagaccagctccttgcgggcgtcgagcgaacctcgctcgacgaatcctccgagctcgaggttttcctcgacgctcatcgaggcaaagacgttgtccacctgagggacatacgccatgccagctcgggcagcgtgatgggcactgagatccgtgatgtcggtttcgtcgagatacaccttgccggccatgcgcggaatcagtccgaaggtggccttcagcgccgtcgacttgcctgccccgttggggccgatcagggtgacgacctgggagaccgacgcgtggaagctaatcccgtcgacgatcggcgccttgccgtagccagcggtaagtccctcaacgcgcagcacgtgcatcgctggctcctcccgtcaagtacgcattcacgacggcctcgttctcgcgcagctcggccatggtcccggttgcgagtgcgcagccagctgccatcaccacgacgtggtcggtgatccgctcaaccacatcgaggttgtgttcgacgatgagaaaggtcacgcccagcgaagagcggatctcgttgatgtgttcgcagatgcggtcgaccagcgcggggttgatccccgccatgggctcatccaagatcagcatcttcggctcggccatgacggcacgagccagctcgagcagacgcttctggccaccagagaggctgccagcgtactcatcgcgcatgtgctccaacccgaaggccgcgaggatccctcgggcgcgtgcaaccagctccagctcctgctgtcgatagcgccgaggtgcgaagagcgcggtcatgagaccctcgcccacctgacggagcggggacaccatgaggttttccatcacggtcatcgccggatactcccgtgagatctggaaggttcggatgagaccgagctcggcaaccttgtggggcgcgagtccagtgatgtcgtgcccgtcgaagttgatcgtgccggcgtcggggcgcagcgctcctgcgatgaggttgaccatcgtcgacttgcctgccccgttcgggccgatcaagccggtgatcgatccgtccgcaacggtgaagctgcagccatcgaccgcatggacacccccaaaggcgcggaccacaccgtcgaccaccaggatcgggtcagtcgtcgacatcgacggcacctccagccacgggaatcggatcgggcagacctacgagcttgactggctccgggaagcgcgctttgcgctctgggacaacgccttgcggacggaaccacaagacgaggatgacgagtgcaccgatgcacatgttgcggatctctgggatcaggttcggcatcgaggagatcgctggcaagaatcgagtggcctcattgaagagcaccgcaaccaggaacgatcccacgaccgcaccagtgttgttgccacgacctccaacgatcagggcggcccagatgacgaaggtctcactcgtgccccagcctgccggggccagcgccgtcacgtaccagatggtgaggacgcccccgatcccgacgaagacgcaccccagcaccatcgcgatcatgcgcactcggtaggtgtgcttgccgaaggcctcggctacgtcgaggtcctcgcggatggcccgcatcgtgcgaccgagcggcgatcgatagaggcgattggcaagcagccagcagatagccatgaccacagccgagaaggcgagaaagaccagggaataggagttcggtccgagctggagcacgccgttgaagggttgcggcaccccgaccagtccctcgaacccatcaaagatcttggtgttgttcccaacgagcccatagatgatcgagccggcggcgagcgtgacgattgcgaggtagtcgctgcgcagccgccggagcgccacaagcccgatcaggtagccaagcaatcccgctgacgccgccccgatcagcatcgagattggccatgggagcccaaggccaaggatgtagtagatccccgagctcggcacctcgtgggtcagcgacgcgacccccgccatgtaaccgccgatcgccatgaaggtgatgacggtgaagttcaggatccctgcgtagccgaactgaatgttcaagccgagcgcgaagatgttgtagatacagaagtacaccccgagagtggccgcataccccacgatgacgcccatgatgtgcctcctaagcctttccagcggtcgcgaagatcccctgcggccgaatgagcagtgtcaagaccagcaccaagaaggcgacgtccaggctgtaggcagcagagatcacgagcgtcgagaggctgatggcgagcccgatcacgagtgcgcccaccatggcgccgtagatcttgccgataccgccgaggatgaccgcggcgaagatcacgaacaggaaggtgttgccggtgaaggcttgaaactcgaccgtgttgagtgcgagcgtgatgccccccagtcctgcgagcgcaccactcaggaaccatgtccagcgtgtggtgcggcgcgtgtcaatgccgctcgcggcggcgagcggcgcgttgtccgacatcgcccgcatcgccatgccgagtcgcgtgcgcgtcagcagcaggtggaccccgaccatcaccacggcggcgacgatgacgaccccgatctgggcggcggtcaagctgaaaggaccgaggtgcaggggattgcctgctgcgatggggtagcgatcgaacccaaccccccagattgcctgcaccaggttcagtaggatgagcgagaggccgaacgtcacgatcaagaggaagaagccactcgtgcctcgacggacgaaaggctcgagcacggcgacatcgaccgccacagccgcaagcccactggcgatcaccccgaccaagccgccgagccagaagggcaagtgcaggccgaccgacgcagtgtaggtcacgaacattcccactgcgagataggctccgtaggcaaagttgacgtagttcgtgactccgaactgcaagctgaggcctaccgcagcgagcgccagcaccgccgaagtcacgatcccaaagcccagggtcagtaagaacaggctcattctcccccctctcgttggcctctcgtcttagtgccgcttgcaccgcgtgcgggagtttggccaccaagatgcagtttcgtgcgaatcgtgcactttggctcgtttcgctcaccgcgcctcacccctgggagctcgcgggtccacgcagcgaccgtgtccgtgccgtggcgacgcgtgctgggggagggacatgaacagtgcatgctgactcgcccctggtgacggcccgccaagtgccggcgaggcgccccaccggaccggacaattccatcgcgtcgcttcggcccaggtcctcgatcggcaccgcacgatcaggaggtcgttcgcgagcgcgacgtgaacgagccggtgcttgccagccggaccaccctctgttgcagtcgtacgtgaggccacgtcgctggtcgtgtcgctgcacggagagggtggttgacgattgagaccccggccaccatgacgcccgagcgcatgccaagtcggcacgggaccagagccatacccgatatgcccggaccaagggttctcgagcgaacccgaaggacgagatgctgctctgcattcgtgggctcgggcaggccagcgatcggggcgtcaagtcgttggccgatgctgttcagcacccctgtactcgggcctttgccgagcgtgacagcctctcgaagcgagggggagagcttcggtccgccaaacgggtcgcgggtccttccgcgtcagcgagtggcgttgccgcgtgagcgtggtcaagacggcgcgcggtcgtgcccgctagggtcctcgtcgctctgtgcagccggaggtcgcgcgtctcgagtgctgccctgttgggtgaggccgaccgcatcaaggctcgcaaggccaccgcgttgcagaagacgtcgccgtagacctggagcgaccgatcgtcgccgacgctggcgatcacgaggcatgaggtggccccgacgcgtgcggtcgtcgtgcgccgaggagcacacagcgcgtcgtctccggggccacggtcgtcttggggaagcgagacggcagctcgacactgcgccgatgtcgagcgcgcggaagaaggtacggtaacgtgttcgcgctcttcgggtgttgtgtcgaccagcaacgcccatcgtcggcatgaggttgagccgcggacctaccactcagcgaaccgcggccgtgatcgccgagatcgggcctgcgcgagggcggacagcgacttgcgatggaccggtgcgttgcccaggggggagtggccgaggatcggcgtgcgacggtgtccgatcccatcccaaagcctgccaccggccgagcaggagagggccgtccggagctgcgggccgaggtgattggtcttccccgcagaccgaagcatgcagggccagcatcgtgccctgcctgaagtcggtctgcactggctgagagacctggtgagctgcgacgaccgaacccgggagagcctcgtcttgccggttccgctcgtcgctcgccatgggctcgtcgctcgtgcgattacgtggatgaggttggtggcgatggtgatgcaacctcgtgtttcggttgggactcgagtccaaccgaccctgacgtggcgagccggtgcgggtgctaacgaggccatcggtagcgatgctcaggtcgcccgattccgtagcggagcacgagctcgatccgtcccatgcgcgcgaggtgtgagaggtagcgttgcgcggtggcccgagagactccggagcgggctgcgacttcctcggccgagagctcctccgtcgcgccgcgcagcgtctcgacgatgaccccgagcgtctcacgcgattgccccttgggcagcgaacgttcgacgctcgttcgcagcgtggtatagatctcgtccaccttgtcctgactggcctcctcaagggcgtcgagcttcttccgcatggcggcataagcctcgaggcgctccatcaggatcgagggtgcgaagggcttcaccaggtagtagagggctcctgagcgcacagactcggcgacactcgcaacatctcgtgcggcggtaatcaccatgacgtcgatgggtcgccctgcgatgcgcccgagtgccttgagcacttcgagccccgagacatcggggagatagagatcgagcaacacgaggtctggatggtgctcctcggcggcagccagcgcgtgcgctccggtgtgggactctgccacgacctcgaagcccgatacacgctcgacaaaggccctgtgcagcgcggcgacccggaagtcgtcgtccaccacgaggattcgatacctcatgagtgctgcgtgtcagagaaggctgggatgtgttgacgcaggatcccaggcaatcgaacgacaaacactgcgccaacctctcgcagcacctcgatcgaccctccatagcgctccacgagttgcctgagccgccccagattccgttgacacgtcgtaagtcacacgtaccatggcagagggaaggggaggtcgatggggacgtcgagaaggaagttcaccctggagtaccggaccgaggcggcccaccgggtcatcgacagcggccggagcgtcccagaggtggcccgtgagctcgcgatcggggagcacaacctctatcgatgggtgcgggaggagcgcaggcggatcgaagcagcaaacgccactggcagcccgcccctcacggcgcaggagcgcaccgagctcatcaggctgcgcagggagctcgaggagctgcgcaaggacaacgagttcctgggaaaagcagccgcgtacttcgccgcgaagccaccaagcaagagagattcgcgctgatggaggcggagtacgctcgcttcgagatcaaacggatggcacgcttactcgaggtctcccgggctggctactaccgatggcgacgcacccaggtagcaccgtcgcgtcgggcatgtgcaagacgcgacctcgagaaccgagtggtcgcggtccaccaggcatcctctggcacctacggcgcacgacggatcacggcggcactcctcgccgctggcgtggtgacgagccacaacacggtggcagcagcgatggccaggcgcggcatcgccggtatcagccccaggaggttccgcccagcgaccacccacgccgatccgaaggcgatctacccaccagacctcgttgccaggaagttcgacccggggcgcctgcacgccctctggacctcggacatcacctacctcgctctcgccggcgcgatggcatacctgtgtgtggtgcgcgacgagcactcgcggcgggtgctcggatggagcgtcgcggagcgcatggagaccacgctcgtgctcgaggccctcggccaggccgtcgcggtgcgtgggtcccacgcgcagggggtcatctggcacaccgaccgagggagtcagttcagcgaccatcgagttgtggccttctgtgcccgacacgggatcacgcgctccatggggcgaaccggcacctgctacgaccacgcgagcgcggagtccttctggtcgatcttcaaacacgagttcttctaccgccacgcctttggcgacctcgccgagctgcgccgcggcatacagagctacatccagttctacaaccaccagcgcagctgctcgaagatcggctaccttgccccagtcgtcttcgagcacctcgtcgcggaggaggctcgcgtgaagtaacctgggtgtctacgaaatctggggcacctcagccgtacgagggcgaggccaagcccccggcgtgtcccactgcgcgtgagcttggtgctgaagccgtcgagaaagatctctgaggcgatgtgggctgggacccttggacctgagtcggcgacgatcatggtgagcgcatctcccatggcgagaaagctcgcctcgatccaggcgttgggagtatctgcagctgcatcgatcgcattgtcgatcaggttgccgagcagtgtgacgagatcgctcgcgggcatgcactcgggcggcacgcggtcggaaggtccgaggcgtagctcgacgtgacgctcggcagccactgcactcttcgccaacaggagcgccacgatgacgggattgcccacctcgcgggccaggcgatccatgagcgcggtgtcacgaagtgcgatgtcggtggcgaatcggatggcctcatcggtctctcccagttcgatgaggccgacgacggtgtggatccggttggagaagtcgtgcgcctgtgctcgaagcgcgtcggtgagtccgagcatgccgtcgagctcgcgcagcagtgcctcggactcggtgcggtccacgagcgtgacgacatagccgagtaggcgcccttgcacctcgacggctcgacgattggcgatcaggattcgatcctcgtggacgacgagcaggtccttgcccacgacctcgcccgtcagaatgccttggagtcgaccatctggcaccagcacgccgacagggcgctcgaggaaccttactggaaggtgtaggaggcggcgggcctcctcgttggcgaactggaaccttccctcgggatcgatccccgcaaccgcctcccggatgccgtggaaaatcgcgtcctgttcctggatgagtttggtcagctcgtcgagctcgaggccaaaggtgcgatcgcgaagccatcggctcgccagccacgatcctgctgcaccgatggccagtgccacggtgagcgcttcgagcgcacgcactgcggatccggtgatgagggcaagtgggttaggcgccgagaactcgacgacgactccgagaccagccgagtgcgagatcggggctcgcgcagcgacgggtccggaaccgccgttgaggacgccactccagacgtttcgtccgtcgagctcggcgacgagctgaccacgagtgagtgatccactccccgcctcgacgagaccatggcgattcacgactgccacggcgagcgcgccaatggccctgcgcgactgtgtgaggagggcttgtcggttctccgttccggactcgagggtggcgatatctgggttcgcagcgacgctctgtgccgcaaggagcgcctgatgtgtgtcggatccgagcccagtcgggacctcgagcgtcacccacgcgatcgctgcaatgacgctcaccagaatgatcccggcctggatggccagcatgcgagaggcgagcttcgcgccccgcctacctctcgagaccgacggatcgtcacgcatgtgtaccccaccacaacacgccgcacggtctgcattgacctgcccttgagtgtacggtggtcgcttgtgcccgcgcaagtgagacgaagtgaaccgagcctcctcgaagtcgcgcggtcgctcgtggcgcagcggccagcgcgtgtgtaggcaccgggcgttaactgaccctagaacaccggaacgatagtgacccaccctccagagtaggttgccctcgagaatcaagaagggggcagcccgatgctgaagggcaggatgctcctatgtctgtcaagtggcgagcgcgctcagcccttcgagccactggcgatactggatggccaactcgtcgtgacgcgtgaggccgccctcgagccgcgataggcgccccacggtcgttgacagggcagctgcagccgcttggagcacgacgcccaagggagtgccgtagctcgcgaagttccgtgccggtgatgacgggcgcggggttcgtgaggaggccaaagatctcccgggcgatggagcgcttcaggcagcgcatgatctctcgatcactcttgccttcctggcgtcgccgctcgaggtagcgcatggtcgggccgtgacggtgggcgaggcggaccatcgcgatgcgccagagcgcgttgttcgcctcacggttgccaccccggttcaggcgatgtcgtacgaccttgcccgaggaagctgcgatggggctcaccccggcgagcgcagcgaaggaggcctcgctccggaggcgctcggggttgtcgcccgctgccacgacgagggctgaggcgacctcgggcccgacacccggagctgcgacgagtgcagggttcacctccgagcacaggcgagcgatcgcgtggtccagctcggcgatctctcgctccagggcctggtggcgcctcgccagcgtcacgagcgccagcgtcgttgcggcaccagtcgcaagtgcccacagcgtcgccccaggctgccacacgctccacctggcgagcacgacgaagcctcgtgagttcctcacgctgctcatcggccaaggtgacgatcaggtcgcggagctggttgccagcttcgggtgcgtgctcggatcgcagagcgacgcgcgacgccaagtgggcttccccccatttgcttgacagtctgaatttaggccacggccgcctcctcccgggcccaggtgagctcgtactcgattggcggtcggtacccgaggctcgagtgcagccggacggtgttgtagcgatggatccaggctgcgatggctgagcgggcctcggcgaggttcgcgaagcggtagcgagccaccagctcgcgcttcaaactcccgaagaaggactcggccacggcgttgtcgtagcaagtagtcaccctgcccaccgactggcgaacgccgagggtcgcgagcaggctccgaaccttccgggagaggtactgtccggattcaaccggtcgtcgcaacacctgttgctccatctgagcctaggagtgcctccagcgcttctgctggggtccgccagccgagtgtcttgcgaggccgctggcccgagcgcgaaggcgaccgcgtcgaggtcgtgctcactccagcgggacaggtcggtgcccttcgggaagtactggcgcaggagtccgttggtgttctcgttcgtcccgcgcatccatggcgagtgagggtcggcgaagtagatggcgagtcccgtgtcgatgcgcagctggacgtgctgggccatctccgtgccgcgatcccacgtgagcgatcggcgcaggtgctcggggagggtggtgatcttggcagcgatcgcagtgcggactgcctcggcaccgtggccggcaaggggtggtccgtgcttcgcgcgcgcctcaccgtcgtggccctccatgggcggtaggtggagcagcatcacggagcgggtggtgcgctcgaggcgcgtgccgatcgccgaacggtgcagcccgatgatgaggtctccctcccagtgcccgggcaccgcacggtcctcggcctcggcgggccgctgcgagatcagcacctccggggtgatgaagccctggcctcgtccgtgagcccgtgctcgtgggacccgaagggctcgtccggtcctcaaggcaggtcacgagttcgcgcctgagcaccccgcgcccctggacgaagagtgcctggtagatggcctcgtgactgatacgcatcatcgtatcgttcgggaagtcgatcgggaggcgcttggcgatctcgtcggggctccaggcccgtgcccacctgcgatcctgactgcggccgtggcgacgacccgtgaacctgacggtgggaccgtctgcggtcgtgccatcgggatgggcgatgcgaccagcgaggcgatcctccacgtaggcacggagctcctcgttgcgaacgagcttggccaccttcgggcgcttggcggcgagcttgcgccttccactgggcaacgaccgcccggtactcgagcgtgccacccctcgtggctgcgttgcgacggagctcacgcgagatggtcgaggggtgacgcccgagctgacgagcgacgcttcgaccccagccccttttcgctcgtgcgagcgcgatctcctcgcgctcgctgagagcgagagggagcggcccgagggctcgcccagcgtgcatggtggcaccccaccagcatggctgaaccagcgcgcaccgaccgccaccgacacgcccacgcgctcgcaggcgtccgcggtcgagatccccgtggcgatgagctgccagaaggcccgctggagcacccgtggtgggtctggccgccctggggagcgcatcggcggccgcagggcacgatcggccgcccactgtcgcctcgctcccggaggagcctggttcctgtttcgttgcacgtgctcctccgtcaccgggggtgttgcaacgaccggttgaacccggacagtagctctcccggaaggttcggagcctgctcgcgaccctcggcgttcgccagtcggtgggcagggtggctacttgctacgacaacgccgtcgccgaggccttcttcggaagtttgaagcgcgagctggtggctcgctaccgctgcgtgaacctcgccgaggcccgcgtcgccatcacagcctggatccactgctacaacaccgtccggctgcactcgagcctcgggtaccgaccgccaatcgagtacgagctcacctgggcccgcgaggaggcggccgtggcctaaattcagactgtcaagcaaatggggggaagcccaggcctcctggcgggagatccagtggtagcggctcactgtcccccctccttcacccagaaggccatcgctcgcttgagcagctcacgttccatggtgagctgcttgacctgccgacgcagccgggtcagctcctcgcgctcggcgctggtcaggccttctcgctcacctcggtcgaatggaggagccccgaagcgaccagctcatcgatgctgccgccgtactcgaacattgggttgagactcagccaaggttccggccaaagcgttccctcgctgagggcttcttgcaccctggaacggattcgctcatcgcgaatatcaacgaagctctcgacgaatgatctgaactcgcgaacgacggtgtctcgaaggtcgaagacgtccattgccgtcctctagagctccgacgtcagggtcacaagttgatgcgaaccattctccactacagtgggcttccccccatttgcttgacagtctgaatttaggccacggccacctcccggcaggcccaggagagctcgtactcgacgggcggtaggtacccgaggcttgagtgcaggcggaccgtgttgtaacggtgaatccagctagcgatggcagagcgagcccctgagaggttcgcgaagcggtagcgagccaccagctcgcgcttcaagctcccgaagaaggactcggccacggcgttgtcgtagcaggtcgcgaccctccccaccgactggcgaatgccaagggtcgcgagcaggctccgtaccttccgggagaggtactggctgccgcgatcgctgtgaaagatcgccccagccaggctgccccgagtcccgagtgcttcgcggatcgcctcgaccaccaggtcatcgggcatgtgacgcccaagtgaccagcccacgatgcgcctcgagccaagatctgccaccgtggcgagatagcagaacccctcatcggtgcggacgtaggtgatgtcgctcacatacctgcgcttcggctcaccaggagcgaagtcctgacggacgaggtccgggagcgctgcgtcctctccccgcctcgtcgtgactacgaagcgccggcgtgggcccgctgccatctcgagctcgcgcatcaggcgttccacccgcttgtggttcacgcagaacccgcgccgtcgcagctcgtgggtgatgcgggggctgccgtaggtgccgtcgctctcgtgccagatggcgcgaagctcgctcgcgagcaccaggtgctcgggatcctcgcctcggtcccgacggtgtcgccaggcgtagtaggcctggcgagagaccccgatgactcgtgctgctgccgctacagagaagcccttggcctcctggcgggagatccagtggtagcggctcactgtcccccctccttcacccagaaggccatcgctcgcttgagcagctcgcgttccacggtgagctgcttgacctggcggcgcagccgtgtcagctcctcgcgctcggcgctcgtcaggccctctcgctcacctcggtcgatgcgttcctgacggacccagttaccaagggtctgctcgttgatgccaagctcacgggcgacgtcagcgatggtgcggcgctggtcgagaaccaacgctgccgcgtccttgcggaactggctcgggtagcggccgcgtcgtcgtccagcggggccgtcgcccggtggtgggttcggtgtctggctcatcccttcctcctatagcaggtgtcaacctggaggggggaaggccacagtctcctggcacacaagcatgctggtgcgagcaccgaggccatggctcgatctcatgtcgatcctcggcgaagcttagcggaggccttgggtgagggccagcggcccgggatgccagcgtagcgtcgctgccgctcgtccagggtgcgaacgcggtttggccgagccacatggacctcgcgccaggagcaaggttgtatccctcgtgctccgtgccaactcctctgacgtgcgcacggtacacgcggagcatggacccgcatgagctccacagcgaacttggctgcaagcaccgtaacggccgtcggccccggcacagccggggccgacgtggtctgggtgggagtgaaggttgtgtcggctacggagtcgtgtcgtcgttgacgttgacgtcgaacgtcgaccagccctgagccccgttcggtcctgtcgcgatgacgcgccagtagccggccgtcgggaacgtgagggtcgcctgggccgtgccgtcgacgagatcgactgatgcggggtacgtggcagacggagcccccgacggaccgaccaccgtgaggttcaccgtgcccgagacggatgtatccgtcgtgaggccagcagtcttcgcctcgacgttcacgacgagcggcgttccgggcgtcgctgcgagattctcggcaggatcggcgacctggatcgtgtcgctcggcacgtcgggtagcgatacgggagcgatcggcgcttggtggaagtcgaacatgccgagcaggtcgttctggcgggccaccagcttggtgagcgggtgcatcccccagaggcgatccatgagggcaaggatccccatgtcggtcgtctgcttcgagaagactccgggtcgcacccacggcgagatgaccaccatgggggtgcgggtgccgtagccgaaacgctgcgcgatcggcggggccacgtgatcccagaagccaccgccctcgtcgtaggtgatgaagatggcggtgctcttccactcgggcgagtgctcgatcatcgacacgagctgtccgacccatgcgtcaccgagctggatgtccgtgggcggatgctcgctgtagagccaggtcggaacgacgaaggagaagttcggcagttggttgttctggacgtcggccacgaactggctcgtgttcgcgacgtcgttccagaggtgcttgtcctggagcaccggcgtgtaccaggctgggttccagtgggtgacgaagccgttcccctcttgggttgggggtgggccgttgtagtcgccctggaagatgccccaactcagcccgtgctgggtgagctggtcgaagacggtgcggatcgggaaggacccagagctcggcggggaatccgacagccacgcgtctgcggtgcccgccacggcgtagatccgattgggctgggtcgggccgatcgcgggctggaagttgttgtcggcgagcacgaagtgctgggctaggtcccagaggttcggctcgacgctcttgccgaaggtcgtgatggacgcaaggccgttcgtcggcagcgtggtgtagtagttcatcttccaccccggcttgccggtcaggtacgcgttcgacggcgtcgcggaggtgaagtagcccgtcccgcccgccagcagtgcggggcggtagtccatcgcctcgatctcggcagcgcggttgtggttgaggtccaccgtgtcaccgacgttggcgggagccgggatcggcgcgacgggtgcggctgcgtagttcgtcgacggattcgggaactcggttcctgccgggatcccgttcgcgccagggaacgacccgaacaggttgtcgaacgtatggttctccagcatgatctcgacgacgtgctggatcgggctccgcatgccgctcgtcgcggctgctggggctcctgtgccgagggtgctccagcccactaaggctgtcgccaaactggtcgccgccgcgatcgaggcgacccaccgactgcgtgctcgcatcgttacctccccttcgatgatgtgggtgtccactcgggacgactccatgcttgaccccagagcttgcgctcaggttgcgctcaggtgactcgcaggacacggggagtggaacgtttgggtggcggtccgacgatcggtcgccctcgcgagttcggatctctcatgtccccacggccacctgcatgcgacgagcgcgaggccgctgcccgagggagcttgctcgcgtggcagatggacccctgaccggctccttccggcgagctgggcgggcgtgcgagatgtcgcggccgcggtggtcgtggcgctggtaccgggacgcatcccacggcagaaccgtgcgcgtgggggtgctcatgtcgtcccgcacaccccttcgacctcacggccgaggctgtgcttgcagcgaggtggtgccctgaaggtagatcgatcgctcccgctgggaatcggaccgcgcgagctcggcgaaccccacagcatcccacgcgatcgctgccgtggcgcgagggcggctcgaccgcgcgacacgtgtcgatcgccttcgtcgccccgacctaggtgcgcccccaccgtgggcgcgatccgtgcgcgtgcgcgtcgcggatgtgccgactacggcgcgctctggccgcggtggttcgccaactcgaggacctcggccccgtgtgcgagtccctcgacgacgcgttcggcgtgcgtcaccacgaccagggttcgatcgatggcgagccgggcgagaagtgcgacgagatcatcctcggtctcgccgtcgacgttggcggtcggctcgtcgaggatccacgtgtgctggtcggcgagcagcaggcgagcgagtccgatgcgctgtgcctcgcccgaggagacggcgtcgtgggcgaggcgcgtttggagcccgtcgggtagtcgcgcgagcagcggtgcgagtcccacgtcgccgagcgctcggacgaggtcggcgtcggatgcgtcggggcgggcgagccggaggttcgccgcgagcgtcgcgtcgaagacccacgcttcctgggggacgtagccgacgtggtgcgccacggtcgactcggtgagctggcgcgtgtcgacgccgccgaggcggatcgtgccacgggtgggctcccatgcggctcgcagcagaccgacgagcgtcgacttgccagccccgctctcaccgacgacgaggagccgacctcttggagggatcgagaggctgaggcgatcgaggatcgcggtggtggcgccagggtaggagaagctcacgtcctcgacgtcgatggcgaggggaccgtcgggcaggggcgtagtgttcgctggctggtcgcgacctcggagcgcgaggaccgagtcgaggcgtcgggacgaggcgagctcgctcgcgagatgggtcgcgctcacgccgatgccgctcgtcgcctcgaagagcccgagggcgaggaacggcacgacggcgagctccacggcctcgaggtggtggtgcgcgatcgccccggcaccgatcgcgacggttgcggcgatggtcagtgcttcggcgagaccggcgagcgaggcggggatcagctcgagcgctgcgttggtccgtcgacgcctggcgagcttgcggatgtgggccgcgagctcatcggtgagggtgtgctcgcccggcgttccggcgcgctcgggagcagagtcggcgatggcgagtgcgatcgtgtgggcggcttcggcggtcgcggcgagttcgcgggtcggtgctcgcccgagccgcgccgcggccgctggcgcgacgacgagcgtgacgacgaggccgagggcgaggaccactccgagggcggggttgaagacccaggccacgaccgtgcccacgaggcctgcacccaccgcaccggcgaggggagccgcgatgcgcaggagcagcgaggagagcgcatcgagatctcccgtggcagctcgcgagagcgtgccggcgatcgcgctcgggaccctgtggggtgcggccccagccacggcacgatagagcgcgacgcgaaccacgcgcacgaggcgcagcgtgaggcgatggccgaggaggcgctctccatactgaccggcacctcgggcgagggcgaagaagcgcaccgaaccgacggccacccccagcgtcaagatgccaggtcggagcgaggacttggcgaggaggtaggcggagaaggcgaacaggatggctggggagagcgcagcagcgagtgaggtacccaggtagccagcgaccagtctgcgctcagagtcgaggtggttgcggatgatcgtgacgaggttcatgtcgtcggctccgtcgtcggcgatggcgtcgctcgggtcccgatcgaagcgtcgctgagctcgaggacgcaggtagcgcggcgaaccacgagctcgcgatggctcgcgctgatgacgatggaccccttcgcctcgcgcgtgagcagctcgaggaatcgctcctcggtgcccacgtcgaggtggctcgtcggctcgtcgagcacgaccacgtcgcggccgagtgcgagtgcacgcgcgagggcgactcgttgtcgttggcccgccgagaggttcgcccccccgggtgcgaccaggtcgtcgcggcgctgaacgagttcgatcgcgccgagctcggcgaggaggtcgagtgcgacctcgaggcgatcgtggcccgcgacgagttggaggttgtcagcgatcgttccgggcaccatggcggggcgagccggcacccacaccgttcgttccgcagggagcgctcgatggatctcgtggtcgagcacgagggttccacggagcgttgcgccgcgacccacgagggccatgagcagcgtcgacttgccgatgccgctgcggccgacgacgcagagatggtcgccaggtgcgagcgacagcgtgaccggagggtcgagctctatctcgacagtggtcacggaacggagctcgagcagcgcctcatcgtgcgacggtgcggcccgcaggagacgtgtcgccggagcttgggacgtgcgtggcacgggggactcaggaggcgccgcgagggcgtcgatggcctcggctgctgcgcggccgtcggcggtggtgtggaactggagcgatgcggcccggagcggggcgaacacctcgggcgtccagaacaggacggtcgcgcccgtggcgagcgccatcgaggcgtcgttcagtcggatgccgatcgagacggcgacgagcgccacgacgatcgccgagaggatgtcgaggctcacacccgagaggaacgcgatctcgagcacgcgcatggttcgatgctcgagcgatgcagctgcggcgtcgacggcatcggcctgctcgtcggcgcgtccgaaggcggccagcgtccccgcaccaccgaggagatcgaggtagcgatgctcgagctcgatggtggcatcaagttggtcgcgagcgcgccggtcggtggcgatcccgatgagcgccgcgaggatcggcatcgcgacgaggccgccggcgagctcgatgccgaggatggggctggccaaccaggtcgcgaccacgagcgtcgggatctgcgcgacggtctcggcgaccggtggcgcgaccgatgcgaccgcggtcgcgaggcggtcgaggccctcgctcgcgagataggcgaggcggctcggatcggggttcgtcccgcgtgcggccgcgaggagggcgggctctgcggcgctggctgctcgctcgccagcctcacgggccgccacctggcccagccgccgcaggacgacccgcacgacgagggcagccccgaggacgacgccggccgtggcactcgcgccgagtcggtgcgcgacgacggcgtcgctgagcgctgcgccaaaagcgcgagccgccacgaggagcgcgacgagttgggcgagcgtggtcgcagcgaggatcgcccagaacggcatcgcccccggtgcgcgaagcgcccgggggtcgatgggaccacgtcgctcgctcacacctcgtgcggctggtcgctcgcggggacggtctcgtggggcagcgagacgcgacgccggaagatgtagtagctccagccctggtagaggaggacgaacggggtgaagatcgccgccacgatggtcatcgcgcgcaaggtgtagggctgcgaggcagcctcggcgatggtgagcgacgcagcggacgagagcgacgaggtgatgacgtcaggatacaaggtcatgaagaccgtcgccgtgatggcgaggatggcgacgcccgtcacggtgaaggcccagcccgagagccgctcgcgattgagccagctcgccgcgaccacgagcaggagggcggacacggggatcatgcctgggacgtcaccggcgtggtgctcggtccgtgccacctcccacgtccaggcgaggaaggcgaggatgatgacggcggtgatcggcgcgatgcgcccggcgagcgcggaggcacgctccttcagtgcgccggtggtcttcaggttgaggaacaaggcaccgtggaggaggaacaggctcagggtcgcgagccccgcgacgagcgcgtagggctgcaggagcgagagcagcgagcccgtgaagatgccgttcgcggtgatcgggatccccttgatgaggtcgccgaaggcgacgccccagaggagggcgggcaccagcgaccccaccgtgatcacgatgtcccagttgcgtcgccaggtcgcgctctggcgcttgccgcggtactcgaacgcgacgcctcggatgatgagcgcgacgaggaggatgaacagagcgaggtagaacgcggagaacatgcgggcataccacagggggaacgccgcgaacgtcgccccgcctgccacgatgacccagacctcgttgccgtcccaggtcgcaccgatggtgttgatgacggcgcgacgttcgaggtcgtcgcgtccgatgagcgtcagcagcatgccgaccccgaagtcgaagccctcgaggaagaagtagccggcccagaggacgccgatcaggatgaaccagaagagttcgagaccagtggtgtgcatcgtgcgctcctagtagatcagcgagccgacttcgtgctcggtctcggtgtcagcgccgggttcgagtgagcgtcgaccatagcgaaccatcaacgagatgtccacgaccgcgaggatgccgtagagcaccgtgaacccgacgagggtgatcccgaccgaccatggcgacaggtgcgaggccccttgggaggtcttcaacaagccgtagacgatccagggctggcggccggtctcggtgtagatccagccggtggtgttggcgatgaaggggagcgggatggtccagagggcgaccttggcgaaccagcgcgactgctcgaggcgatggtggtagagcagccagccaccccagagggcgatcaggatgatgacggctccgatccccgccatgatgcgaaagctccagtagtcgagggcaacgggcgggatgtagctgcccgggccgtactggcggaccatcgcggcttggagctgattgatgccctgaacgaccccgttccagtggtcggtggcgagcaggctgaggacgtgcgggatgccgatggagaagatgggcttgtcgtggaggttgccgatcgtgaggatcgattcggacgcaccgcgggacgtgttgtagagggcctcgccggcggcgagcttcatgggttgggtctcggcgatcacctggccgtcgatgtggccgtcgaggcccatgagcagcgccgagatgagcatgacgatgagcgacacgcgcgcgcctgcggcgaagacctcgcgggtctcggtgctgcggtggtactgccacagcgagatgccgagcacgagcgcagagccggtcaggaaggaggcgagcagggtgtggaacagcgtcacgaggaagagctcgttcgtgaggatggcccagaagttcgtcatgaccgcctggtgggtggccggatcgatgcgatagcccaccgggtgctgcatccacgagttcgcggcgaggatgaaggcggcagacagcatggtcccgatcgagacgagccagatggaggcgaggtgcacgcgccgtggcacgcgatccttgccgaagagccacacgccgaggaaggtggactccatgaagaaggcgaggagtccctcgatggcgagcggcgggccgaagatgttgccgacgtaggcggagtaggccgaccagttcatcccgaactggaactcctggacgatgccggtgacgaccccgatggcgaagttgatcaggaagagcttgccgaagaagtcgagcacgcgctcgtagcggtcgtcgcccgaacggtaggcggccgtctgcaggatcgccacgatcagacccagcccgatggtgacggggacgaacaggaagtggtagatggtggtggctgcgaactgccacctcgacagcagcacggtcatcgacgcgaccatgagaccctccctctgacaccgcagctcgagctgaacgtacgcaaccgagctgcgagctccagcctacgaatcgtcctgatgggcgcacctgggcccttcgtcacgtcttggccgggactcgggtcgcccgccgggagcagcgagtcgactagcctcgtggcttcatgggttctctcatcaagaagcgccgcaagcgcatgcgcaagaagaagcatcgcaagatgctgaagaagactcgctggcagcgccgagccggtcgctagctcgcacgacgttcacgaacgccccgcggctgcggggcgttcgtgcgtcgtggcggcttcgccaccggagcctgcccgcttcgccaccggagcctgcccgctgtgccagcggccctcggcggtcaggctgactcgccggcgctcggtgtctcgctcgacacctcggtcgctggggaggcgagggcgcggggcagcgtccgtgtctcgatcagccacacgggcaagtccgcgagcatgaggcgcgtggcccggacgtcgtcgcctcccacggtgacgtgggcagcagggcccctcgcgaactcgtcgccgaggccgagggtgcctgccgagtgccaccacgccagcgtcgagcccgagccggcgagtcgaggacgtcgtccggtgcgtcgctcggcagcggcgatgagcgcccccagccgtggctcgatggcgcaggcggcggcctcgaggtcgtttgcgacctcgtcgtcgtcgtgtggtccaccgagtgcgtcccaggctcgatagacggagcccgtcgcgacgccgaagggcggcacgatgagcgtcacgaccgcatccaggtcgtcgagggccatgacctgctcgccgatgccgcgggcatcgacgtggccagcgagctgacacagcgcgacgtcggcaccgaggtgccggccggtcgcgagcggtgctccgaaggcgcggaggacggcgcccgcgtcggcggagccgccgccgagccccccttcgaccgggatgcgcttcgtgatcgcaagggtgcctgtctcgccgatgagctcaagggctcgccaggcgaggttcgtcgcgtcggtcgggacgcgagcgaggtcgacccagggggcgccagcgacgaggtcgatggtggtggcaggggccggggcgaggtcgacggtgtcggcgagggcgaggtggacggcctcgatctcgacctcgtgcagaccgtcggctcggcgtccgagcacgcggagggtgcgggtgagcttggcgggcgcgacgagcctcaccgggcacccttcgaggttgcgatggcgcgccccagcgcgacccactcgtcgagcgcgagcgactcggcgcggcgcatggggtcgatgccgacggcatcgagcgccgccagctcgtcgtcgccgagggcgcgtcggagcatctgacgccgacgttcgaagccgtggcggatcgcacgcaccgtggcgtcgaaggtcgtgggctcggtcaccgcgagcggctcgctgcggcgatcggcgacgacgagcttcgaccacaccgtcggctgcgggtggaagacgaccggtggcaccttggcggcgacgtgcgcgtcgatgctgagcgcgagccgcaccccgagcgccgagcacgctcgggtgccggcggcagcgacgatgcggtcggcgaactccgcctggaccatgacgaccacacgctcgaggaaccaggcctcctcgacgaggcgaacgaggatctgtgagccggagtggtaggggaggttcgcgaccagcgcgctggggcgtcgttccagcgggagcgggtcggcgagcgcatcggcgtgctcgattcggacgttgtcgatccctcgcgcggccagcacctcgccgagcgccgggatcagtcgtcggtcggcctcgagcgccaccacctcgtcgaagtactcggccagccacacggtgagcgagccgaggcccggccccacttcgaccgcgacccgaagccccgcctccgcggccagcgctgcttccttgcgcgcgatgttgccgtcggtgaggaagttctggccgagggccttggagggctcgagcccgatgcgctcgaggtgtgcgacgatctcccgcttcgtgactggacgcatggtgctcagggagatggctcgacctcacggagcccgaagagccgccgtgtcgtcgccgcggtgatcgccgcgagccggtcggcgtcgactcccttctcgctggccacgaagcgtcccgtgacggcgacgttggcgatgtggttgggtcggccgcggagcgggaccggcgcgaggaagggcgtatcggtctcgacgagcagccgctcgatcggggcgagccgaagcgcctcgcgaacgggctgggcgttcttgaaggtcacgatccccgagaacgacaggtaccagccgcgtgcgagggcgcgctcggcctcgtcgggaccttccgagaacgagtggatgatgaccgctggcggactcggggcgtcgtcgaggatggcctcggtgtcggcccaggcttcgcgcgtgtggaccacgagggcgagcccgaggcggtgggcgagggcgacctgctcggcgaagacgcgccgctggacggggcgcggcgagtagtcgtagtggtagtcgagcccgcattcgcccaccccgacgacgatgcccgggtactcgacgacgagcgcggcgaggtcggcgatcgcgccaccgtgcgcctcggcatcgtggggatggatgccgatcgtcgcgccgacgctgaggtcgagccgttcggtggcgagctggtcggcgatacgggccgcttcttgcgagctcgcagggtccgtcccgatcgcgacgaacccgacgaccccggcgtcgacgaggagcgccagctcctcgtcgaggctcacgcgctcgggatgggcgtgcgcatcgatccagcccgcactcatcggcgccccaccacggcatcgaggtcggtgcgtgggaagagcggggctggcttcgtgatggtggccccgcccatgcccggttgccaagcgagcggtcccgcctcgtcgaacccgagcgctcgtcgggcacgttcggccccatcggggatggcgggggagaggagcacgctcgcgaggcgcgccccctcgcgagcggtgccgaggacggaggcggcctcggccgatcccttcgcgagacgccagggctccgtggcctcgaggtaggcgttcagccgatggacgaggccgatcgctgcgtccatggcgtcgttcggccgccaccgttcccaacctgcgcggacggcctcgatggtctcggcgatggcgagctcgtcggggggcgtcgcgggtgcgtcgggcacgtggcccccgagccgttggacgatgagcgagcccacccgcgcgacgaggttcccgaagccgttcgcgagctcggcgttgtagagtgcgacgagcgcctcgagggacacgtcccagtccggcccgatcgccgaggagcgcaccaggtagtgccggagcgcatcggcactgagcgcgcgttggacacccagcgggtcgatctggttcgcgagcgacttcgacatcttctcgccctcgttgagcagccagccggtcacgatcagctgggccgggggatcgatgccggccgcgaggcacatcgccggccaccacacggcgtggaagcgcaggatgtccttgccgagcaggtggtgggccgcgggccaccaggcggccacctcggcggagtcctctgcgtagccgatcgccgtgaggtagttcacgagcgcgtcgtaccacacgtagaagacgtgtcgcgagtcccaggggacgcgcacgccccagtcgatcgaggtgcgggtgatggagatgtcggtgaggccgccctcgatgaagcggagcacctcgttgcggcgcgactcgggccagatggcctccggatggcgctcgtagtgctcgaggagacgatcttggtagcgcgagagggcgaagaagtagttctcttcgcgcatccgttcgcaggcgacgtggtgcaccgggcaaagctcccccggctcgagctcgccgggttggtagtaggcctcgcaccgcacgcagtagaggccctcgtaggtgccgaggtagatgtcgccgcggtcgtggatgcgctcgaggaagcgttggacgcttcggtggtggcgtggctcggtggtgcggatgaagtcgtcgtaggagacctcgagcgcatcccaggcgcgtcggaactgggccgaggtcacgtccacccaggcctgtggactcacgccgtgcgcctcggccgactgggcgatcttcagcccgtgctcgtcggtgccggtgacgaagcgcacctcgtcgccgatcaggcgatgccagcgggcgatcgcgtcggcgaggatcacggcataggccgtgccgaggtgggggtcaccgttgacgtagaagatgggggtggtgatgtagaagcgccccacgagcccagcgacctcctcgccgatcgatctcgtcccaagcttaccgaggcgccggtcgctcgctgggacgagcgtcgggacgcgccgcgaggatggcggcataggcctcctggcggggcgcgttcgtgaggcgagcgacgatccgcgccgcctccgacggcgcgagcgaactctcggcgagcgctcgggtgaggcgctcgtgctcgacgacgctcgtgggcggggcaactcgtgccggccccaccacgacgacccactcgcctcgccgatcgatggcgcgcgcccacgcccctgcggcgcgcgcggtcccttggaaggacgtctcgtggatcttggtgagctccttggcgagcagcacctcgcgctcggggtcgagctcgccgatcgcatcgacgagctcgaggatgcggttcggggcctcgaagacgacggtggggacgccctcggcgagcaggtcagcaaggagccgtcctcgctcggccccgcgctggggcaagaaccccgccacgcagtagcgggcgacctcgtggggccagagcgccatcacggccgtcgcggcgctcgggccggggatgacgacgacggtggcgcccaccgcgcgcgcggtggcgacgaatggcgcccccggatcggaggtgcccggcatgccggcgtcgacgacgagcacgacgtgctctccgtcgaggaggtgtgtggcgagcgcttcgggctcgatcgcgttctggccgcggagcgcgcggaccgctcggaggcggatgccgagtgcgctggcgaggcgcctcgtgacgcgggtgtcctcgcagacgacgaggtcggcggtctcgagggcgcttcgaagccgcgggctcgcgtcggcgaggttgccgatcggggtgccggcgacgctcagcacgccgctcatcgacggacctcgaggcggtcgcccgccgaagggggggcgtcgtgccagagggcgcgtggcaggacgacgatgcgccagggggcgacgacgaggcgtggccgccatggatggagccgaacggtgctgcggacgagcccgttgcggtcgagggcgagcgcgagcgcatcgccgagctccccgagcccgctccagagcgcgatcggtgtcgagatgagcaggccgtgggagtcctcggtgtgccagatcaccgggcccgcggcgtccagggtgccgagcacccgaccgcgctcgttcaccagccacgccatggcgatcacacgttgaagcggatctcgagcacgtcgccgtcggcgacgagatagtcgcgcccttcgagccggaccttgttctgcgccttggcccgggtccacgagcccgcctcgaccacgtcgcgccaggaggccacctcggcgcggatgaagccgcgggcgagatcggagtggatgatgcccgcgcaggtctgggcgttcgagccgcgtcggaaggtccacgcgtgggtgtccttgtcgccgctcgtgaagaaggtccagcgctccagggtttcgaaggcggctcgagcgatgcgctcgagggcgctcgaaccgatggcgagggcctccatcatctcggcacgttcggcaggctcgagcctggcgagctccgcctcgagcgcgagcggtgcggtgacgacggtggcgtgatcgccgaggcgccctcgcacggtgtcctcgacggccacgtcggcctcggcaccctcgtcggcgttgatcaccgcgatggcgggtttggtcgtgatgagaaaggccgagcggaccagctcgagcacgtcggtctcgagggtggcccgatagagggggatcccgtctgcgaggaccgcttggacgacctcgagggcggccacctcgggtcgggccgaggggtccgaccgcgcgaccttgcggcgccgctcgagcgcgctctcgacgctggcgaggtcggcgagggtgagctcgagctcgagggcgtcgaggttcgcgatcgggtcgtcgtcgcccgggactcggtcgtcgtggaacgcgcgcagcacgtagaggatggcgtccgcctctcgcagctggccgaggaagcgattgccgaggccggcgccttgggaggacccagcggtgagcccggcgatgtccgcgagctgcatgtgggcatagaccagcttgcgcgagtggtggatcgccgcgagcgcgtcgacgcgctcgtcgggtacgaccgcctcggcgatggtggtgtcggtggtggtgaaggggtggggcgcgacgggggtgtcgagaccggtgagggcgttgaagagtgtggacttgccggcgttggcgagtcccacgagaccgagcttgtccatggccccctcgatcatagggccagcggggagtcgtctctcgagccgctagccttgccccccgtgtcgaagcgaaccgtcaagcgcaagttgcgcgcgaagaagaaggccaatcacggacgcaagccgaactgcggtcgcggctagtcgtcaggcgtgatgccccgacgtcgctcgatgccggtgatctgaccccggagctcctctgggacgatcggtctgggtttcgtgctggcctcggcgagggcggcctcgatcgcgtcgtaggcctctcgcgatttgggcgcgcgtgccagatagagcacgacgtgcgcgagcgtgatgcgggcttcgggcatgccgatgcgctcgaccgtgtccgcggccgcggccgcgaggacaagagcctcgggatcggcgaggccgacgtcctctgatgcaaagatcacgaggcgccgcgcgatgaagcgcggatcttcgcctgcggcgagcgccgcggcgagccaccggatcgcctcggtcggtcggctctggcgcatcgacttgatgagcgcactggcgagctcgtagtgggtcgagtcgtcgagcccgagcgcggcgatctcgctgatgcgctcgaggagctcgacggtgagcggtcgctgggccgccgcgggggctgcacgctcgaggatgcgcaacagcgccctcgcgtcgccgcgcgctgcggcgacgagccaggcgatcgccgcatcgtcggcgatgaggccgaggtgggcgagcgctcgctcggcgaccgcgcggagcacggggggctcgagtgcgcggagccgaacgacgtcgcagcgcgacagcagcgcgggtgagagcgtgacggcggggttctcggtcgtcgcaccgatgaaggagatctcgccccgttcgatgggcgcgagcaggagatcgagctgggtccggccgaagcgatggacctcgtcgacgaaccagagtgtcccgtcgccgtggcgggcgcgtcgggcggcttcggcccgcgcctcgcgcaggtcccgcacgccggtgtcggtcgcgtgcagctcgacgaggtgctcgcctcgtgcccgtgcgagcaggctcgcgatggtcgtcttgcccacccccggcggcccggtcatgatcaccgcgatcgtccggggcgcggtggcgagggcctcgaggcgcgctcgcgcgtggtcttgtccgaggacctcggcgagcgaggtcggtcggagctcctcggcgagcgggcgtgctcgcaccatgtgctcctcgaagagactcaccgcgtccctgagcgcagctcgcgacgtcgcgcctcgagcccgagtgcagcgagcacgccgtcgtcgacgggcttcggtgcaccggtcatggggtcctggccgctctgggtcttcgggaacgcgatgacctcacggatggtctcctcgccgagcaggagcgcgacgaggcgatcgatcccgaaggcgaagccgccgtgcggcggcgggccgaagcggaaggcgtcgaggaggaagccgaagcgatcggccgccgcctgctcgtcgagcccgagcaggccgaagatctgtgcctggaggtcgggacggtggatcctgatcgagcccgagccgagctcccatccgttcatgacgaggtcgtaggactgggagcgcacccgcaacggctcgcgctcgaggaggtccatgtcgtcggcgtggggcatcgtgaaggggtggtgggccgagacgaggtgaccctcgtcgtcgacgccctcgaagagtgggaagtcgatcacccagaagacgtcgagcgcgtcggggtcggcgaggtggcgcccgagcgcgaggcggatggtcccgagcgcggtgcaggcgacctcgaagcgatcggcgacgacgaggatcgtgtcgccgacctcggctccggtgcgctccacgagtgcttcgagcgccgccggcgtcatcgccttggcgagcggtgaggcgatctcgagcggcgtgcggctctcgacacggaaccaggcgagtcccttcgcgcccgcgctgcgggctcgttgggtgagctcgtcgagtcgggagcgcgagaggggctctgcgacgacgagggcggtgacgtagtcggccgcgagcgcgcgcgcaccggagtcgcggaccgcctcggtgacgtcgacgagttccatgccgaagcgtcggtcgggcttgtccgagccccagcgggtcatcgcctcgtgccaggtgatcgtcccaatggggacgtcgtcgacgccccgtaccgagcggatgacctcgcgaatggccgcagagacgaaggatcgcacgtcctcttgggtgacgaacgacgcctcgaggtcgagctgggtgaactcgaactgtcggtcggcgcggagatcctcgtcgcggaggcagcgcgcgatctgatagtagcgatcgacgccgccgatcatgaggagctgcttggcgatctggggcgactgcggcagggagtagaccgatccgggctgggtccgggagggcacgaggaactcgcgtgcgccctcgggcgtcggtgtccagaggagcggcgtctcgacctcgacgaagccctgggcctccatcgcgcgtcggatggcggcgttggtggcggcacgggcgcgcaggttgcgctgcatgcgtgcgcgccggagatcgaggtaacgccacctgagccgcgtggtctcctcgacctcggcgtgctcgtcgagggggagcggcaggggatcggcgtcgccgagcacctcggcgtgttgcacacgaagctcgatcgcgccggtggcgaggtcggtgttctccgttccttcgggacgccgcgccacctgaccctcgatgcgcaccgccgcttcggtgtgcagcgaccctcgaccgtccatgacgcactgcacggtgccggtgtggtcgcgcacgtcgacgaagacgaggtgttctccgtgctcgcggatgcgcgccacccagccgcagacgctgacgtcgcggtcgaggagggattcgtcgagcgcgccgatgtagtgcgttcgaaggccggctgctggcggcagggtccgttcactcatgcgcggtggcatctccttcggttcggggcgctggcctcggcggcagcacctcgcgagcctagactgccgccgtggtcacggctcagggaaggctcatcggcgtcggggtgggcccaggggaccccgacctcgtcacggtccgtgccgtgcgtacgctcgagcgcgcccgcttggtgctggcccccacgctcgatgcggcgagccccgggcgcgccgagcgcatctgccgcgaggcggcgccgtcggcacggatcgagcgcgtggtcatgccgatgacgagcgatgcggaggcttcgtcgcggcgccgggcgagcgccgccgaggtggctcccctggtggtggccgcgctcgaggtgggtggtgacgtcgcgtgggtgacgctcggcgacccagggatctactccaccttctggctcctcgtcgatgccgtccatgcgctcgcccctgacgtgctggtcgaggtcgtcccgggcgtggtcgccttcagcgcccttgccgccgcggccggcgttgagctcctcgacgacgccgaccacctcgtcctcgcgaccgggcgcacccggaccgaggtcgtcgacgctgccctcgccgatcccgacagcgccctcgtgctctacaagcccggtcgccaggtccagagggtgcgtgaggcggtggcgtcgtcggatcggcgtgcggtcgtcgggtggctgctcggcacgcccgaagccgagatccgaccgctcgccgaggcgcccgacgaggttccctacctcaccacggtgctcgtcgcaccgaggaggccacgggcgtgagcgtcgagctcgtgctcggggctcggcgatcgggcaagtcggcctgggcggaggcgcgcgccgtcgagctgcggatcgggacctatctcgccaccgcagcggcacacgcgctcgatgcggagcgtctcgcggcccatcgtgcgaggcgcatcgggcgcttcgtgacgctcgagccgggcgacccgggcgaactcgtggagttggtccggaccgtcccggggggcctcctgctcgacgggctcgggctctgggtcggctggcagctgagctcggaccacgacgtgtcctcgggcgagctcgtcgcggcgctcgcacggcggagctccccgacgatcgtcgtctccgacgaggtcgggtggtcggtgcatcccgagcgtgcactcgcgcagcgcttcgtcgatgagctcggtgcgctcaaccaggcggtggccgccatcgcggcccaagtcaccctcgtggtcgcgggcctgccgcttcggctcaaaggtgcgtgagtgaagctcgtccgctcgctcgccgggggcctcggcttcctcacgatctggccgttcgcggcaccggtgagcgccgagagcgtcctcgggttcccgctcgcgggtgtgctggtggggctgtgcctcgtcgtcgtcagggtcggagcccagcgtgccggagccctcgtggtgggggcgctcgcgttggcggcggacgcactcgtgacgcgtgggctccactacgacgcgctcgccgacaccgccgacgggctcggggggttcatggagccggcagagcgtctcgcggcgatggacgacccccgtctcggcggcctcggcgctctcgcgctcgcggtgacggtggtggtgcgcgctgcggtgctcggtgcggctggcatcagcgcgctcgggctcgtgctcgcgctcgcctggtcgcgctccgtcatgggtgtggtggtgctggagagtccgagtgcaaagcccggtggcatgacgcggtggttccgcgacgcctcgctcggggtgcgtgtcgcctcggtgagtgccctcgtcgtgttctcggcggcgatcgtcgtggtcgagggcgcgccggggttgttcggcgtgtgcgtcgggacgatcgcgggcgggttgctgtggctgagggccactcgcgcgctcggcggcgtcaccggggatgtggtcggcgcggtcggcatcgtggccgagaccgcgctcatcgtgggggtcgtgctgggtgcgacgcactaggtcgctcgagctcgcggtcgcgctcgggctcgatgcgatgctcggtgacccgcccgaccgctggcacccggtggcctggttcggtcgggccgcgagcgtgctcgagcgacgctactggcgtgacgatcgtcgtgtcggcgcgctcgtggcaggtgcgctcgttgtgggtggcacgctggtcggcgcggtgatcgatcgcgtgcctggtggggccctagccagtgcgtgggtcgccctcggaggggccgggctgcggcgacgagcgctcgacgtcgcgcgtgcgttggacgacggtgacctcgagcaggcgcgtgcgtggctcggctggctcgtgggtcgcgatcgcgacgggctggacgcgaccgagatcgcgcgcgcgaccatcgagtccgtggccgagaacacggtggatgccgtgctcggccccatggtctggcacgtcgcgctcggctcgatgggctcgatcgcgctgcgcgccgtcaacaccctcgatgcgatggtcggccatcggaacgctcggttcgagcggttcgggtggttcgcagcacgcctcgacgatctcgtcatggcgccgccacgccggctcgcgatcgcgctcgcggcgccgtcgcatcgccggctcctcccggcggctcggtcgcacccgagtccgaacgccgggcccatggaggcgctggtggcggccgcggtcggcgtgcgcctcggtggtgtcaaccgctacggggacgcggtcgtcgagctcccggtgctcgatggcggacccccgcccgacgccgcagccattcggcgggcggttcggtggtcgcgcagcgtgacacttggcacgctcgcctttctcgccgtggccgagcaggcggcgaacgcggcggtgggccgggccccgtagcgtggtggtgtgctggttcgtgaggtgcgtgtgcacacggggcgtcggctcgtcaccgacgtctccgccctcgtcgcagcgatcgtcgccgaccagggcgatggcctcgtcaactgcgtggtgccgcatgcgacggcaggtctttgcctgatggagatcggctcgggatcggaagacgacctcgccgtcatgctcgagcagctcgcgccgcgcacgacgccgtggcgccaccgacacggaactcccgggcacgggcgtgatcacgtcattccggcggtcgttgcgccctcggtggtgctgccggtgatcgacggtcgcctgctgctcggcacctggcagtcgctcgtcatcgtcgattcgaacgtcgacaaccccgagcggcggctcgtcgtcgccatgctggctgatggcaaatcccggggcgcgagcgcacccgaggagcgctcggatgcgggcgaacggcccggtcgggacgtgccttaggccgtgcgcagacgacctgagggccgccgctccggtgggacctgtgcgatgagtgggttcgtctggtcgcgctcggagatgacggggtcatcgagctgccagaggccgtggaacgtggggtcgttccagcggagtccgagttcgtcgtcggggttgtagtagccgtcgacgaggtaggtcagcgtcaggtccgtgagggcggcgaaaccgtgggcgaccccaggggggatgaagaggccgatcgggtcctcgtcgcccatcagcagggaccacgtcgtgccctcggtccgcgatccgtggcgaaagtcatagagcagcacctgtgccgtgccccgcacgacgtaccagtagtcggcctggtggaggtggtagtgcatgcccacgagcgagccagcgaccttgtcggagcgcgacccctgcaccatctcacgaccgagcgggaaccacgagcgacgataggtctcttggaacgcgccgcgcgcgtcggcgtggacggtcgggcggatgacgatcacgtcggcgatctctccgtgggccatggcaacctcctgactcgccggctcagtgtaggcccggccaagctaagtgggcggtggccgtgagtctctgagcgatcggcgacattcggtaggctatgagtggcacagttgcacgcacggtgcacgcaaggagctctatgaatgcagcgatcgtgatcgtcgcgctcttcgtggtggtcggcgtcgtggccatcgtctcgcttcgaggacgtacgcgcgaggtgcgcacggtcgatcaccatcagcgagcgctcgacacgctcgagcgcttcgccaaggagcgcggtgtgcaagccgaccatcgcgtcggcttgcccaagagcgagcaacgtcgagtcgccgccggatcggacgacgcgcccccggtgcggctcgacctcggtcggctcgccgacctcaccgacccggacatgatccgcatcgaggcggactacctggcgagtggcgccagcgccgagacatccgctcaggcgcccggtgacgaggaaccgacgaaggatgctgccgtggccgcatccacggaggacgaggcggtcgagcaggccccgccaccggcgacgaggccgatcgatcgggccgtggccgatcggaccacggcgatggcggcgatcacgcccgatcgagcgcccgaggaccgaaccgaactgctctcggcggtgggcccatcggccgccgtggccgccgacgatcgatcgcaccgcggtgacgacgctgtgcgcgagcaccgggtctaccagctccatcggcgtactcggctcccggccgtgatcggtggtgcgggaatcgcggcgatcgcgatcggtctcgtcgccttcgaactctcgagccaccatgcggcagcaccgacgtcgcagtccgcctcgagcccgacctcgtcggcgccctcgaccacgaagcagtcgtcgaacgcgaagacctcgacgacgtcggcgtcgaagaagacctcgacgacgtcgaagacgacgtcgtcggcgaagaaggccaagggttcggcgagcgctgggccggcggtcgcgctggtgagctccagcagtaccggcgcgacctacaacgtggtcggcggtgcccacaccgtcgttctgcaggtgtcgagcgcaccctgctgggtcgaggacgcccaggctcccggtggtcaggtgctctgggacgcgaccttgccggcgggtggcagctacacgatctcctggagcggtggaccgctgtggctccgcaccggcaactcgggcgtgctgtcggtgagcgtgaacggccatccggtgcacttcagcgcaccgccgggtccgttcgacctgctgttccagccggtgcgttagtcggtcgctggggtcagcgccgcttgcacgaaggcaaggacctgggcctcgtcgtgccaggcgtccttgcgcttcgtgggcccgaggtgaccttgttcgtcgtcgacacggatccacacccgtgcctcgggattgaccaaccggagcttggctacgtacttgagtggttcgaagaagccgacgcgcacgtcgttcagcccggtcgtgacgaggatcggcgggtaggtcccttcgtgcaggttgtcgtaggggctccatcgcgccatcgtctcggcgatgacgtcggattcgagcggattgccccactcctcccactccgtcacggtgagcggcagtgaggggtcggacatcgtcgtcaggcagtcgacgaaggggacctcgaggacggcggccgcgaagcgctctggcgcccgattgagggccgcaccgacggtgatgccgcccgcactggcaccacgaatggcgatcgcggagggatcggcgatgccctccgcaacgaggcctgccacgacgtcgagcaggtcgcgcacggtccgttccttgcgctcgagccgaccggcgtcgtaccacgatcggccgagttcgccgccgcctcgcacgtgagcgatggcgaacgtgatgcccgcgtccaagagtgagaggcgcgagatcgagaaggtcgggtcgatggcctcctcgtaggcgccgtaggcgtagacgagcacgggtcccggcgcaggtgcgctccggcggcgagcgatcgtgaccgggacgaggacgccgtcgtcggcggggagccacagccgtctcgtctcgtagtcgtcgaggtcgacgtcgccaccgacgcgctggcgccagcgctgcgtcgtcgtctcggtggtcggcatgtaggaccagatggtggcgggctcgacgagcgagaccgtctcgaagcgaacctcgtcgtcgtcgaggtcgaggttgccgaccagcgctgcggtcgagggctgctcgggatcgacgaggaggcgacgttcgctcgctggcgctccccaggggaggaacgacacgacgagcgaggcgcggcgtcgcgtctggatcgcaaggccgtggcgggtgatctcgaacccctccaggatctcgccgtcctcgagtaggtcgacctcggtgaggggttgctcggggtcggcggtgcggaagagacggaactcggcgtcgtcgcggctctcgatgaggtagaacccgtccgggccgtggtcgagctggtagagtcgaccctcctcgcgcggtgcgaagggccgagggggggtcgcgagtgggtcggtggcgtcgaggagccaccattggctcgtgcgcttggattcggcctggatggtcaagaaggcgcgatccttcgtccgtcccacgtcgaggaagtagtgggcatcgggttcttcgagcacgaggatgtcgtcggacgggtcgctgccgatgcggtgtgcccacacggacgcggggcgcagggtctcgtcggggcgcgtgtagaggagcgttcgcgagtcgttggagaggacgaagccgtagccggccggaaagatctcctcggctcgagtgatgatgccggcctccagccggccgacgacgaggcggagctgctcggagccgtcggtgtcgacgccgacgacgacggtgtgctcgtcgtcgccgatcaggagtccggcgagtgcgaagtaggcgtgaccgtcggcccaggcgttctcgtcgaggacgagctcgcgtggtccgcctgcgacgggctcgcggtagtgcaccggatagtcgaggtccggttcgatccggctgaggtagcgccatgacccgcgacggacggggtagctctcgtcgggttcgaccacgcgtgagcggatcgtcgcctcgatgcgtgttgcggcgggcgccaggcgttctgcgagtgctgcgaagctggtgcgagccgaggcgatcatgtgctgggtgcgcgggtcgtcgatcgagcgcagataccagtaggggtcgatccgtgtgcccgcccgccctcggagcgtgtgtggttcggggtcgggagcaccgagaggagcgaggtccctcgtgagggcatcgagcatcgtgcgcatggacgcgagtgtagggagcgccgttggctcgggccgttcggggcgatatagactaccgaggtagtgcaaatagggaggcccgatggcgaaggttgacctggccctcgatcgctacaagctcggctggtctgacgaagaggcctatgtcttcaagccccgcaagggcttgagccgcgagatcgtcgaggagatgtcgcgcatcaagggcgaacccgagtggatgcgccgattccgcctccgctcgctcgactacttcttccgtcggccgatggcgccgtggttcgcggtgaacatgcccgacctcgacttcgatgacatctactactacatcaagccgaccgatcgccaggtggaccagtgggaggcactccctgagaccatcaagcgaacctgggaccgcctcggcatccctgaggctgagcggaagtacctcgccggcgtcaccgcccagtacgagtccgaggtcgtctaccaccgcaaccgcgaggagctcgcccagcaaggggtcatcttcaccgacatggactcggccgtgcgcgagtaccccgacctcgtgcgccagtacttcggcaccgtgattcctccgaacgacaacaagttcgctgcgctcaactcagcggtgtggtcggggggttcgttcatctacgtgccgccaggggtcaaggtcgacatgcccctccaggcgtacttccgcatcaacgccgagaacatggggcagttcgagcggaccctgatcatcgcggacgagggcgcgcaggtccactacatcgaggggtgttcggcgccggtctactcgagcgactctctgcactcggccgtggtcgagctcatcgccaagcccggtgcgcgcatcacctacacgaccatccagaactggtcgtccaacgtctacaacttggtgacgaagcgtgctcgagcagaggccgaggctcgagtcgagtggatcgacggcaacatcggctcgaggctcacgatgaagtacccgtcggtgtatctcgtgggtccgaaggcgtccggtgaggtgctgtcggtggcctacgccggtgccggccaacaccaggacacgggcgcgaagatgatccatgctgctccggagaccacgtcgaccatcgtgtcgaagtcgatctcgaaggacgggggcaatgcgacctatcgcggactcgtccacgtcgacgatggcgccgagggcgcgcggagcttcgtgcgttgcgacgcgctgttgctcgacgaccattcggtgtcggagaccaagccctacatggaggtcgccgagcgcgcgtcgtggatcggtcatgaggcaacgatctccaaggtcagcgacgaccagctgttctatctgatgagccggggtctgtcggagtcgcaggcgatgagcatgatcgtgaacggcttcatcgagccggtgacgcgaaccctgccgatggagtatgccgtggagtggtcgcggctcatcgagctccagatggacggggcggtcggctaggtcgtcgtcgctgccgcgagcgcgcgctggttggcggggtcgtagccgagttcgcctcgaggtcgttccatggcggcgtcccggggcgcgcgggcatcgctcgccgacatgtctgctctttcgtagctcgtcgcatttgggagcttcgggggccgtggtcggtgtttggtctgcgaggcttctcggggagccatcggaggctcgtcgcacgcgcatccgggcgctggggcaacgatcgtcgtcgtgtcgcgacgtgcacgagccgctcgaccgtgcctcgccagattcaaggtctcgccgtgaggttcgccggctgagggtcgtgtgagcgcatcgcgatgcctgaagcgtacgccggctcgcagtcgcggcccgaactcagatggcctgcgccgttgtcggctgtgggcacgggggcgcgacagctgggcagcggcgccgtcgtgaggatcgaggacgatgcgcatcgaaggccggtggtacaatcggccggagagccattcggaggcgtcgtgctcacagtcgatcaagcgacctcccagaccaaggggaatcaggcgcgcccaacccggtcggtgccgcgtgtgttgcggtttgctcctccttcggtcctcaccccggacgaactcgtccggctgcagcgttcggtgggcaacgaggccgtcgagcagttgctcacccaacgcctcgatgcgcttgctcacaagaagcccatcgatttcacggcaccggtcacggtcgtggtggatgacggtgtgcccgacgttacgaaagggcagtcttctccagagccggatccatacgccaagacgccgggcaccgttgggaccggcaccgaactccagggccccggcaacgcaccagtcgggccgacgtcgccctggagccagggcaatcgcccctttggaccgcgtacgacgccgttgatcggccagcgggactcgaagtcgccggatccatacgccaattcgaagtcgccgagtccggtgtccggacctgcgagcaattcctggcagtggggattccgatcgcacgtgcctgcgaagctgagcgtccttggttctggccggcgaagcgatccgtacgctcggtcgcctggaagcctgcccgcacccacgacggctccaatggcacagggtccatcggtcacgcaggcactcgaggttacagggtctggctccggcgctcgggtgcccaagtcgctgaagacgacccagggctatctcaaactcaagtcccgtcgctccgaatttgaaaacgagttcacttcggtcagcgaatccatgaaacgggtcatgaagtttgtcgagtcggggttgcagcgtggagagttccccgacaccacggtcgagggtgtcctcatgcatgcctttggttggaccgaggatgattgcaagaaatatggtaagttcctcaaggatccgacgaagcagtacaagaaggaagagacccccgtcgtgactgctgtgcagccgaacgagcgctatcagtacgagctgcatttcggctcaaccatcacgcgaggaacatcgaccactccgtatgacaccacagcagagcggagtcagttcctcggcagtggttatgccatctacgtcatggaccagcaggggaagttctatgctggaaaccagaaggtcggtcttttccaccactcctcgctaatcggaggaggccaggtcgcaggcgcaggggagctgcaagtcaagaacggcgaactgaagttcttgagcaacgaaagcgggcactatcgtcccggcattgaacaatgtctccaagtgcttgaagagctacgatcgcagcggattgatctctccaaggtggagttcaagttcgtgtcatcgtgggatgaaccaaagatctggaatgccgaacagctctggaacgtgctctcgcattctcaggtaccgtcttaggcccggtcggaacgagggtctctggtgaccgaatgagtcgttcgcagcttggcgacgtcgtcgcggcgtatcttgtcaatcggccttggggtgttcaacaggtggccgacgccacctatgccatcgaagttcatggtgaacatgggcagtggcagtcatacctcacggttcgagaggacgagcagcaggtgctcgttcacgccatactgccctttcgcatcccgttcgaccgccgagccgaggtggcgttgtatctcactcgggccaactacggcctggtcatcggcaacttcgagtttgatctcgatgacggcgaggtccgtttcaagacggcgatcgatgtcgagggcgctgccttgaccgaggcactggtcgaccacctggtgatcgcaggagccgtgacgactgatcgctacctcccggggatccatgccgtggtcgaaggtgcgacggctcgcgaagccatcgccgtcgtcgagggcgagcagggccaagagttgtgagggtggtcaacgctccgctggaggcggagtgtcggaacggttgctcgacgcgcgaacttggtgcatctccgcggcgggaaccggcgagcctgtgagcaacggtcgagctgagctgctcgtgggtccgagccaccctcatcgtcatggcggcggtcggccttcgggatctcgtcaccagggagtcctcgtcgagtgcgcgcagagacggcagatcggaggcgacgttactcagttggtggtgagggaactcctcgaaacgagtgcgtagccgctcaggatcaggtcgcgctgctcgttgtcgagggacgaggatcctcgtcccatcagcgcccttcagcgcgtaggtcaagaccggaccatcggtctcacggaggagtcgcggggcgaccctgacctggagatcaggttggatcacgtcccgccgagtggtgtcaactcactccctggctggcctcagctcacgacggctggctcctcctcggcgggcgaggccagcacgcgagcagcgcggaggggccgagacgtcttcgaggtgcccgccgtctgtcgtcgcgcgtggcagtttcgagctcgaccatggactcctctgacaggtcgtgttgctcgaaagcgccccatttcccgtgttggccgagcacgatagcggtgacgaggcgcccgagagctgcgtcgttgccgaagaccccgacgacgttggtgcgccgctcgatctcatgatgggcccgaccagagcgggttcgtgaccagatcgtgcccgaggagctccccgggaagctctcgggacggtgcgcgacctcctctgtggcctcggcgaccatggcgcgagccgctgggagtgtcgtggcaagggagtcgatgacctcgtcgtcctgggtcgggagcgctgccggggaggcttccctctgtgtcaatcttgagtgagaccactctcccgaccccattgttgtatcgagagggcggctgaccaaggagatcctgaggaccatgacgaccgacgagaccgcgagcacgcaccagactggagccatgccccccacccctgacccagaccctgaggtcccggagcgagctcgaggaccaagacgcttctccgcggcctacaaggcacggatccttgccgagtatgacacgcttgcaaaggccgagaagggagccctgctccggagagagggcttgtactcctcactcatcaccgagtggcgacgccaactgagaccgtgccatcgaggaagcactcgcacgcccaccaggacgccaacccgctgatccccgcgaccaggagatcgcacgcctcgaggcgccgcgccgagcgcctcgaggccgacctcgccaaggcccgcaaggtgatcgaggtccagggaaaactctccgcgcgcctggagcacctcgccaccgacagcgcgcccgcgacccacggcgagaccacgtgatcgacgaagccatcggcgaactggcgccaactgtcggggtacgcgcagcctgcgccgcccttggagagccccgggcgcgctatggccttcccccctccaggttgacacctgctataggaggaagggatgagccagacaccgaacccaccaccgggcgacgggccagttcgtcgtcgacgaggtcgctacccgagccagttccgtaaggacgccgcagcgttggtcctcgatcagcggcgaaccatcgccgacgtcgcccgcgagctcgccttcaacgaacagacccttggcaactgggtccgtcaggaacgcatcgaccgcggcgagcgcgaaggtctcacgagcgccgagcgcgaggagctgacccggctgcgtcggcaggtcaagcagctcaccatggaacgtgagctgctcaaacgagcgatggccttctgggtgaaggagggcaaccagtgagccgctaccactggattgccaaccaggaggccgagggcgtcccggtaacggcggcgtgccgagtagcgagggtctcccgccaggcctactacgcctggcgacaccgcaacaaccgaggccctgacccagagcacctggtgctcgtcagcgaacttcgcaccatctggcaggcaagcgacggcacctacggcagccctcgcatcacccacgagctgcgacgacgcgggttctgcgtgaaccataagcgggtggagcgcatgatgcgcgagctggggatggcagcgtgcccaccccggcgcttcgtgcgtaccacgaggcgtggggaagacacgccgctcccagatctcgtctgtcaggacttcgcccctcgcgagccagcgcgccggtacgtgagcgacatcacctgcgtcagaagcgacgagtgtaggcaccgggcgttaactgaccctagaacaccggaacgatagtgacccaccctccagagtaggttgccctcaagaagtcaagaagggggcagcccgatgctgaagggcaggtcgttgatgaggctattcgaactgcaggcagaggggctcagctaccgcgagatctcacggcgcacgggccactcccggaacactcctacgtcgctacctgccagacggcgcaggcacgaggaaagtcacccgcccccgacggggctccaagctggacccctccaaggcgcaagatcgaccggctggtggccgaggggctcacctcggccccggccatcatggaacggatcgccaagctgggctatgagggcaaggtcaccatcgtgcgcgactctgtgcacaccatccgccatatggcacccccgaggccggtgcccatccgccgctacgagaccccgcctggccaccagctccaggtggagcgggggatcttctcctacgtggacgcccgaggcgaggagcggcgcatcccagggctcgtggccaccctcgggcactcgaggcgcactgcgccacgtttgccccgagcgccgacagcgacgggttcatcggtgcactgctggaggccttctgccacttcggagggctcacgaagtggtgctcaccgaccacgcaaagaccgtcgtgctcggcggggatggcgagagcggctacgagtaccaccctcgagctccttgacctcgctcgctacctcggcatctcgatctcgctgtgtcgggtccgccgacctcaagaccaagggcaaggtggagcgctccatccgctacgccaaggagcacatctcgccagcccgccagttcgtcgacctcgcggacttgaacgaccaggcccgtcggtggagcctcgagcgtgaccaccggctgcatccgagcctcggtaccacgccgatggaggtcttcgaccgcgccgagcgtgatgccttgcgtcccctgccgccacgcaccgagctcgatgcctttgtgcgccgtccgagacgggtgagcttggacggcctcgtctccttcggtggcatcaactacggggtgccgatcgcctatgtcaagcgcacggtgtgggtgctgccccgaggtcgcactctcgagatcactgacgcaaccgggaaggtgatcgccacccacccgctcgggttcaagacccgcacagtggtctacctgccccagcagtaccaggggatcgctgcctcagaacctgcgctcgcactccgaggcccccgagctcgccaactcgccgaggtcgatgtcgaggtgcgctcgctcgatgcctatgaggcgcttgtccatgcttgaggtcgccgaagcactccttggcgagctcggccttgcccgcagcgccgagctgctcgcttcgaccatcgaggcagccacccaacgcgaggcctcgtacgcggacttcctgatcacgctgctcggtgccgagcgcgacgagcgtcgccaccgtagctacgagactcgtctcaggctggcgggcctgccccatcgcaagggccttggcgagttcgacttcgacttcgccaccggggtggaccgctccctcgtcaacgagctcgcctcctcgcgccttcgtggtgaacgctgcgggcgtggtgctcctcggaccccctggggtgggcaagactcaccttgcggtgggactcgccctgtcggcgctcgaggccgggcactccgtctacttcgccaccatggcccgtatggtggcagacctcgagggcatggtgagcccgaggcgcttgcgcaaatacctcgcccccaaggtgctcgtcatcgatgagatcggcaccggacgctctcgcacggggcagcaggggtcttcttcgaggtgatctcggctcgctacgagaccgggagcatcatctgcacctcgaacaagggcttcggggagtggggcagcctggtgggggacccggtgctcgcaaccgccatcttggaccgcctgctccaccacgccacggtcctgaacatccgcggtgagagctaccgcttgaaggaccgcaccaagcaacggctacccggtgggctgctgtcccaggcggccgaggccatggcgaaaggaggtgatgccgaacaccacgatctggggagctatcccctatagttgtgtcgcgggtgggtcagttctgactggtgatatcgggtcaaaagaaggccggtgcctacaacgaggggttctgctatctcgcctcggtactcgaccttggctcgaggcgcgtcgtcggttggtcactcgagcgtcgcatgccaggagaacaggtggtcgaggcgatcgagggagccctttcgactcgggggagccttgctggggccatcttccacagcgatcgcgccaatcagtacctctcccggaaggttcgccagctgtgcaccacgctcgggcttcgccagtcggtgggcagggtcgctacctggtacgacaacgccgtggcggaggcgttcttcgggagtttgaagcgcgagctggtggctcgctaccgcttcgcgaacctcgccgaggcccgctcagccatcgcagcccggatccaccgctacaacaccgtccggctgcactcgagcctcgggtacggaccgccaatcgagtacgagctcacctgggcccgggaggaggcggccgtggcctaaattcagactgtcaagcaaatggggggcagcccagctcgctctggcgtcgctccctggatccaccctccaacacggtcggagtgcattccgagcctcgggtacgtgccgcccgtgaagtacgagctctcctggggggcgaggaggtggctgtggcgtaacttcagactgtcaagcaaaggggggaggcccagggtgcctcttctggctagctgctaactgacacaccagagatcgctcgggggcccgccctcctggagtgcgggccggccggatatgacaccacttggtgggacgccactcagtttcctaccctaggattggctcatggcagctacgaacatcccgcagtatcacgagctgatgtggccagtgctgactgctctcagggagctgggcgggtctgccacggtcagggaaatctacgaccgggtcgtcgaaaacgagcatttctccgaggaccagcaggctgaatcgaccaaggatggtcgtatgtctgagatcgagtaccgcctccattgggcgagaacccacctgaagggaatcggcgcgatcgagaacagctctcgtggtgtctggtcgttgaccgacaagggccggacgatcacgctggaccagatgaggaccgatacgaaggcgtatcgagacgaggtgcagcgtcgggcaagacagaagcaggctttgaacagcgcagccgtagaaactggtgatgaggagccggagacctggaagaatcaacttatcgatcggctcctcctcatcccgccggacggcttcgaacgactcgctcagcgactgcttcgtgaggccggatttgtgaacgtaacggttctcggcaagagcggggacggaggcatcgacggtgtcggtgtgtaccgactttccctcgtctcgtttcccgtctacttccagtgcaagcgctataaaggaaccgtgacggcaggtgcggtccgagactttcggggtgccatggcaggccgtggagagaagggtctcctgatcacgaccggctctttcaccaaggacgctcagaacgaggccagccgtgacggagcaccccctgtcgagctgatcgacggggatcggctctgcgacctcctccgtgactaccggctcggcgtggacgtccgggagcgcgtcgaccttgagattgcgctcgattcctcgttctttgacgagtatggctctaccgacgctaccagcccgacctccgcttgaagcccgctgccaaacgccccacccgattgtcccctcttccgaggcgaagcggctgtcgtggtggatgaacacagggaggagctggcacgtgcgggcctggctccttggacttcgcggttcgtgtccccgctcgaggctggcgacgcgtgagctgccgaggcacgagcagtcggctggccgcgtcaacaacaagcgcatccatcgcctgtgggttgcagcgaggcgctcaaggtgccgatgcaagcgccgcaagcagccgctccgcggtcttggcgtcgcaggaggcgccatgggcccgatcaagcctcacgtcgtgtctggcctgtgactttcagttcgatcagacgagcgacgccaaggagccaaagctcctcgacgtcatcgacgagttcatccgagaggcccttgccacctaggtggcacgggccatctgtgctgatggcgtcgttcgctgtgtggaccagatcgcgcttgcgcggggagtaccagcctctgtccttggaccacggactgcgagttcgtggcgcgaggcagtggcggactggtgcagctacaacgcagacggggaccgttgtcatcgacccaggctcgccgtggcagaacgcctggatcgaaagcttcaacgggaggatgcgcgatgggcacctgaacccaaaccgcttcgacagcctgctcgaggccacagtgctcaggccaagactggaggaacgacgacaactggaccaggcctcagagtgcgcatggctgggtcagtcccgcgcagttcgcaaaggcctggcgagagaagcatgagttacagccacagaggggctggactcggcaatgggaaccggtcaaagtctcgagccgccgagagcgcgagcgccggggcggtcagtagctcccgccttcccgacggtgggccaggctcccaaccggaggtggatcagaccccaccaaccggtgggggccgagcactcgcgtgggggccgtagcgagatgtctgtcgctgtcggaacccaccatgggtagtcctcgcatcgtgggaagtggactcgggcggcgagcgcgatgacgggcggggtgtgagcgatcctcaggagtgcacgggcaagagatacgctccgatggtgtcgtgcacgcgtgctgggcacgtggcacgtctggtccgggcgcgagtgaggggagccgggacgccacttggctgcagggccatcgcatcggcggcgtacgactggactgattgaatcggattcccaatgggccaggaagcccacgccccttcggggccatcggcgaggcggggctgagctatgcctgagtgcggaggaagggtgggcgctgtcgggcgaagttacgtcggcggcgcggtgcgtcatcgaccgcgtacgacgcgtaccgatccgaacgccgtgacgaccgtggccgagagggctcggccgtcgtgcatgggttcacggtgccgtcgacgcaagcgcgagccgacgatggtgacgccggtgagcgcgagccgatcatgggccgcgacgacgagcttggtggttccgaacaggttgacgatgactacgcgtcggggcgggggattggtggcagggaactccactcgaagtcggcccatcgcgttcacgatcacgttgacggatcgcttgagctggagaactcccgatccgaacgcattgaagccgatgccaaccccgggctcgtgtggcgcgggcagctcgagcggccggaggtcggcgaggagtcgagcgagctcactctgcctacgcgcggcgtaggcgccctcgatgcgctcggcggcctcgtcgacgtcgagctcgccggcggcgagcgcctgacgaaggcgctccgcggctgcctctcgttcggcgtccgagcagcggtgctcgcggtcgtccgccatcgatgctgagcctataggccttttgcgcgcgacgcgggcgatgaggggatctgagtggacgatgagggtgtggggccaacccggtcagacagacgactgggaggtgggagcatcactggtgcgcgacgggtgacggggtcggcgcaggttgtcgaggatgcggcggagctcgccggtggtcgtctgctcggtaccctcggcgggtggcgtggacggcgcttcgatcgagtcctcgagatcgaggcgtggcagatcgaaaccgaacgtcgtgcctcgccccaggccgtcggaacggacccaggccgttccaccgtgtgcatgcacgatcgcagcgacgagtgcgagtccgaggccggccccgccgctcgcgcgtgagcgtgactcctccgcgcggtagaagcgctcgaagacgtgctgggcaaccgctggtgtgagtcctggtccgctatcggcgacgctgacgcggaccttctcgtcccactcgagcatcgcgaccgtcgggtcaatcccgccgaagagatcgctcacctccgtgggcgtgatggccccagggggcagaggagcgctgcgcgccaaggcctcgaccgtgacgtggacggtcgtgccgggtggtgtgtgggttcgtacgttggcgagcaggttcgtgacgacttgggtgagccggttgtggtcggcgaggacgagcaagccgtcgggggcgtccacggtggtcggacggcgatcgtcgaccacgttggcgtcctcgacggcatggcggacgagactgccgacgtcgacgggcgccaactcgagcgggagggactggtccatgcgcgcgagtgacaggagatcctcgacgaggctgcgcatgcgctgactctgctcgagcgagcgctgcaccgccatctgcgcgatctccgggtcgtagcccgagcgatcgacgagctccaggtaaccctggatcgaggcgaggggcgtgcgcagctcgtgactcacgtcggcgatgaactggcgcagtcgctccctggaggtctccgaggtggcataggcgctctggagccgtccgagcatggtgttgagcgctcgagcgagcgcctcgacctcggccggaccggattcgtcgacgcgagcctgggtgtcgcccgcgctgatggcctgggcactgcggcgcatccgctcgagcgggctgagccccagttggatggatgcccagcccacgatgccgagcgtgatggtcacgccgagcgatacgagcagctcggcgagcgcgaggcggccgacggtgtcctgcacgctggtgagcggttctgcgacgaccatcgtgccgccgaactcggggatctgggccgcgaggacgcgataggtgatgtcgctcaaggggtcgtgcagcgacactggtcgtccgacgggcacggcgagctcggcccgtccgttgctgaagcgcgtgagtggcggtgcctgctgccccacgtagagggtggggctgagtggggtggtgatggtcgagccgttggcgtagacgaaggttccccacgatccgaacggcaggctgagatgcaggtcttggttcccgttcgggtgcaggaccacctcggccgctgcgggggcgatcgactcctcgagggtcgtgtcgatgcggttgatcaggaacgcgtgcagcgcggtgatggtcgcgagatcgatgaccgcaacgccgaccacgagggtcgcgagggtgatcgcgagcagacggagccgcagggtccgttggcggcccccgtggtcgctacgccgactccgccgcacggagggagtagccgacgccgcggacggtcttgatcatcggtggaccgtagccgtcgagcttcttgcgcagatacgagatgtaggtctccacgatgtttgcgtcgccgccgaagtcgtactgccagacgtggtcgaggatctgcgccttggagaccaccttgttcgcgttcagcatgaggtagcgcagcagcttgaactcggtcgccgtgagctcgatctcgtgtcccgctcgcagcacctggtgggcatcctcgtcgaggacgaggtcgccgacgacgatccgagtgggcgcacccgtcccctggccggagcgtcgcaggatcgcctcgacgcgcgccacgagctctgccaacgagaagggcttcgtgacgtagtcgtccgagccgagctggaggccctggacgcggtcctcgacggcgtccttcgcggtgagcaggagcacggggacgtcgttgcgctcttctcgcagacgacggagcagggtgaagccatccatccctggcatcatgacgtcgaggatgagcaggtctggcttcacggtccggagtacgtcgagagcctcgcggccggacgaagcgacgctcacgtcatagccttcgaaggtgagcgccatctgcaggagctcggtgatgggcagctcatcgtcgaccacgagcacgcgaacgcccttcgctggcttgcgcaaactgtccatctgcccacctcgctgtcgtgttgagtgtaggtccttaccaggggccgtgcatcaggccgccggcgaggtgccgagcgtcgccgtcagggattgctgggccccgctctgggtcacgatcgacaacgtgatctgttgccccggcgacttggcgtggatcgccgtggcgagtgcgttcgcggaggtgacggcctgtccatcgaccgcggtgatcacgtcacctggctggatgcctgcgttggccgcgccggagccgggatagacgtactcgacgagcacgccggtctgcgaggtcggcaagccgagctgtgagtcgagcgtgggcgtgagtgtctgtatcccgacgccgaggaatgctccggatcccgccgtcgtggtcgacggtgacgtcgaggaaccggtgtaggcggtcgggttctgttcgatggtcttcacgatgggcagcaccgagttgatcgactcggcaaagcccaggttctgcgccgaggtctgaccgctcgaggcgatgaccgccgtgttcatcccgaccacgtccccttgggcgtccacgagcgggccgcccgagttgccggagctgatgggggcgtcggtctggatcatgccgctgatggtctcggtggtcccgaggctgtccgtcgcggtgatcgtgcggttgagggccgacacgatgccttgggtcaccgttggcgtgccttggagcgccagggcgttgccgatcgcgaccactgggtcaccgaccaccagcgcggacgagtcgccgaacgtgacggtcgggaggttcgatgcgccctcgatctggagcagcgccacgtcgtgagccggatcggtgccgatgatcttcgccgggcgcgagctcgactgaccgtagagcgtgacgcgcacgttgctcgccccggccaccacgtggttgttcgtgagcacgagaccgttcgacgagatgatcatcccggtcccggcgtcttcgaactggctcacgccgaagccgttgctcgtcgtgccggtggcggtgatgtccacgacggcaggctcgaccttggcgaggatcgcggggatgttcagcccgccttggccgctgagtgcggcgggctgcgccttgacctggcggatgacgatcggtgtgcgcgagccgccgctcgactgtccggtgaggcggaccacggcgtagctcgtgcccgccgcgacgagggcagcgagcaccgcggcggtgccgacgacgacgccggggcgccggcgtggcttggtgcgggtgggctgggtcgatccgaagctcgtgatcggctcggcggtcgaggtccacgacggttccgcgtgggcccaggtgacggtgtcgtcctcggcccgcggtagctcgtcggcgccgacggtgggtacctcgtcggtcggacgctcgtcgtcacccgacggaggttcgctcacctcggcggggtcagcggacgcaggcgcctcatcctgcggtgattcggccgcgtcgtccggctctccggcgacgggcgtcgcgtcggtgtcgtcgatgctcatctgtcctccctcgtggagctgggagcgccgctgggggcgccacgcataccagcatgggttctccacctttgcgggagcttaggctcctgtgggaggttcgctggaggatgaccgagcgcgcatgagctggacgttcgcgagcgcggcttgcgcaagctcggcctccatgcgcgttcgtcgggcggcgatcacgaggcgcttcgtggcacgctgggcctcggtgggagcggcgagaaattgggcggccacggcatcgacgcgtcgggcgagctcggcgtcgtccgccacgacgtcgtcgaggatgccgtacgctcgcgcttcgttcgcgtcgagctcgcctgcccccagggcgagggcgagggcacggtgcgtaccgacgacctctgggagcaggctgagtcctccgagatcggcgacgataccgaagcgcacctccggcagtgagcaacgcacccaccgcgtcccgatgcgaacgtcgcacgcgagcgcgagctcgaggcccgcaccgatgcaggcgccgtcgatggcggcgatggtggggatctcaagcgtggcgagcgcgaggaacccgcgctggagcatgccgatcgtctcgggacttggggtagcgccgagacctcgaagcagatcgagatcgatccctgcggagaagtgcttgccgctcccgcgcacgacgacgcaggcggcggcggcatcggacccgatctcggccaggagatccgcgaggtcgccgaagtcctccatgccgagggcgttcgccttggtggggttcgcgatcgtgatggtgcgcagcggtcccgaggtctccatcgtcagcatggcccgaccgtagctgacccaggcgaccttctgggttcacctgggccctacgatggagaggaggtggccaagggaggcgagtcagcggtggtccgaatcttcgatcgcgaggtcgcctgggagctcccctcgcgcagcagcgcccacgcggacgtcgtcgcggcgctggagccggcgacggagaagctcgaggcgtggcgctacagcccgatcgatgacgtctctgtcgcgtcgtacgccgcggtggcgaccgagacgatcgacctcggtgctgcccgcgcgctgctcggcgccgcgggtcggtcggggggagcagatgtcgtcgtcgggccgcgaggtctcgtcgctgcgcatgaggtcgagggctccgccgtggcgggcgatcgtggggccgatgagctgatcacgctcgacgaggagcccttcgcgacgctcgcgaacctgttggccccggagcgagtcgagcttcgcctcgacggtgcagccgaggccgcactcatcgtgggcgggagcggtcaccagagcgcagcctttgcctggatcaagatccacatcaccgccccgacgaccttgtggctcgtggacggagctggcccggagacgctcgcgagcgcgctcgtcgaggtcgaggtcgccgacggggtgcacgcctcgctgcgtcatctctcgatggggggtgcgggcagcatcggtttcctccagctgcgtacgcgtcttggggccgacgccgatctcgtcgttgccgaggtcgctgcccaagggggctaccaccgcacgcgcagcgacgtccacctcaccggcgaacgcgcgcgcgtgcgcatccgctcggccttcgtcgctgggagcggtgaagtggaggagtttcggacgttcgtcgtccacgcagcgccgcgcaccgcgagcgacctgctctacaagggcgcactgaccggttctggaacctcggtgtactccggcctgatcacgatcgagcccgctggtcatggatccgatgcgttccagaccaaccgaaacctgttgctctcgcccgaggcgcgcgcagagtcggttccgaacctcgacatccaggtcagcgatgtgcgctgctcgcacgcctcgacggtgggtccgctcgaggccgagctcgtgttcgcactcgaggccaagggcatcgaccccgatcgggcgcagcggatcctcgccgacggcttcttcgccgacatcgcggatctgtcggagggcgagcgcgcactcgttcggcgagctttggaggaacgatggctgtcgtaggtcgtgtggaggacttcgtcgacgcgaagccgcgtgccgtcgaggtcgacggtcacccggtgtgtgtggtgaggatcggcgatcggttcttcgcggtcgacgacatctgctcccatgcgcactatcggctctccgagggcgatgtctacgaagaggagctcgagatcgagtgctggaagcacggctcgaccttctcgttgctcgacgggcggccccagtcactgccggcgacgcgaccgatcggggtccatcgcatcagcgttcgtgaggacggctcggtcgaggtcgaactcggaggggacaagtgaccacgcccgcactcgtcatcgaagacctggtcgtcgaggtcgccgaacgtgaggtgctccacggcgtgagcctggcggtggagcccggcacgacggtcgcgatcatgggtcccaacggatcgggcaagtcgacgctggtgcgcacgatcttcgggcgaccgggctacgtccggcgccgtggggtgatccgcgtcggcggggtcgacgtgagcgaggcgccgacgtacgagcgcgcacgagcgggtctcgcgctcatcgagcaagacccggtcgaggtccctggcgtcgcacccacgacggtcgtcgccgagggcctggccgctcgtggtgaggacgcggcgcgcgcggtcgccgtgctcgagcgcgaggccgaggcggtgtcgctggatcgtgcgctcctcgatcgttggtacaacgtggagctctccggcggcgagcagaagaagctcgagaccgcgatcgccgcgtcgctccccgggcacgtcgtggtcggcgacgagatcgactccgggctcgacgtggacgcgctgcgaacggtcgctcgccggctcgagagtctgcgctcagaggggcgaggcttgcttctcgtcacccactacccacggcttttgacgcacgtcgcccccgacgtggtgatcgtgcttgtccagggtcgcattgccgagacgggagggatggaactcgccgagcgcgtcgaggctgaaggctaccgcgcctacggggtcgaggagggtccgctcagctgagctcgagcgcacgctcgagctcgtgtcggcgctcgacgacgtcttcggcgacgtcgaggaggacgaatccctcgaggcgcccgtcgcgatagtacgcgaacgtcgagtccgagcgttgctcctcgtcggcgtccgctcccggggtgccgagcacttggatgaggtgtccgtgttggtcgctccagccgaacgggacgtctcgccacggctcgtggccaccgaggaggttgcgggcggcgagctgaccttgggtggccgcggtctcgaagtgctcgctccgcacggggcgcccccaccccgggtgatgccaggtcgcgacgtcgccggcggcggcgatgccgtcctcgatccgtccgtaggcgtcgcacacgaggccaagtcccgcgacggctgggacggcgtcgctgatccagtcggtggcggggcgcacccccaacccgacgaccaccgtgtcggcgccgatgcgcgtgccgtcgtcgagagcgaccccgtcgtcgtcgaccgcgagcgcccggtggccggtgacgacggtgacgccgttcgcctcgtgccacgcaaggaccgtggtggctgctcgcgggccgagggctcgagggaggatccgctcggctgcctccacgaccgtgacccgacagccgcgttcgcgggccgtcgcggcgagctcgagcccgatgaagccagcaccgagggtcacgagccggtgacctggtaccagacgatcgcgaagccggagggcgtcgtcgagtgtgcgcagggtgagcgcgttcgggtggcgcaggggcgctgggtggagtggtgccgcccccgtcgcgatgacgaggagatcgaagccgatcggtccggcggtcgtcgcgaccgtacgctcgtcgaggtcgatgccctcggcgcgcacactcggccggtgggtgtaggcccccgacggggtgcgcagccgggttcgctccggtgcgacgtgaccagcgaggagacccttcgacagcggagggcgttgatacggcgggtgcggttcgtcaccgatgaccacgatgtcgaggtccgcatcgcgacgtctggcctcgagggcagcgcgatggcccgcgagcgaggccccgacgacgacgagacgcgtcatcgtgatcgtcggtcctagtcgacgatcgtgatggcttgcgtggggcaggctcgagccgcctggtcgaccagcgcgcgcaggtcctcggacggtgtctcgtcgagcacgtagaggtaaccgtcgtcacggacctcgaagatcgcgggtgcgaccgcttggcacaccgcgttggactggcacttgtcgaagtcgacctcgatgcgcattggctagctccctccctcggcccttcccaggctaccgaccccgtgggcgctcgtgccctggcgatggccgagtttgtcctatctcgataggggaaagcgggccggctatgctgaatgcgtggcaactcctgtactcgaggtcgacgacctgtgggtcgaggctgaaggcaccccgatcctgcgtggtctgtcgctggtgatccgaccaggcgagctgcacgtgatcatggggccgaacggctcgggcaagtcgagcttcgcgaacgtgctgatgggcaatccggtctatcacatcaccaagggcacgattcgctatcaaggggtcgatgtgagcgagctccccgtcgacgagcgggccaaggccggcatcttcctcgccttccaagatcccgaggccatcagcggcgtgtcggtcgtgcagttcctgcgtcaagccttgagtgctcggcggggccgggaagtgtcggtcctcgaggttcgttttgcgctcgccgagtggctcgagcgcctcgggctcgacccgtcgttcgcgcagcgccatctcaacgagggattctccggtggtgagcgcaagcgcaacgaggtgatccagctcgccatgctcgagccggagctcgccgtgctcgacgagaccgactcggggctcgatgtcgacgcgttgcgcatcgtcgccgacggcatcacgttggtgcgacaccaacatcccgagatggcgacggtcatgatcacccactaccagcgcatcctctcgctgctcgagccgacccacacccacatcctcgtggacggtcgactggttgcctccggcggtcccgaactcgccgagcaggtcgagcgcgagggataccagcagttccgagaggcggaggcgcttcgatgacagcgacacgtggccttgggctcgacgtcgaggagctgcgtaaggacttcccgatcttcgccgagcgcggtgcgggcttccactacctcgactcggcggcctcggcccagaggccgagtgcggtgctcgaggcgatggacgcctactaccgttcccaccacgccaacgtccaccgcggcgtctacggcctcgccgaggacgccaccgatcgctacgagcgcgcacgccgagccatcggccgcttcgtcaacgcccccgacccggagcgcgaggtggtgttcacgaagaacgccaccgaagcgctcaatctcgtcgcgcagggtctcggccgggtgctcctcggacccggtcgcgccgtcgtcctgacggagatggagcaccatgccaacttggtcccgtggatgatcctgcaggagcagctcgggttcgagctgcgctacctgcccttcgatggtgacggccagctggtgctcgacgacgcggagcggatcctcgacggcgccgccatcctcagcgtcaccgcgatgtcgaacgtgctcgggacgctgaacccgatcccccatctcgccgagctcgcgcacggagcaggtgccgtcgtggtcgtggacgcagcgcagtatgcgccgcaccatccgatcgacgtgcaggcctggggcgtcgatctcgttgcgatgaccggacacaagatgctcggccctacgggcatcggcgcgctgtgggggcggctcgagctgctcgagcagatgacgccgttcctcggtggcggcgacatgatcctcgacgtgacgctggaggggttcgtgccgaacgaggtgccgtacaagttcgaggccggtacgcccccgatcgccgaggccatcgggtgggaggtcgccatcgactacctccgcgaccgtgtcgggttcgaggcactcgccgcccacgagcgctcgctgaccgcctatgccctcggtagcttggctgatggcctcggggagcgcattcggatcttcggcccccgcgacccggagcgtcgaggcggcgtgatctcgttcgagctccagggcgtgcatccccacgacgtcgcccaagtgctcgatcgtcacggagtgtgcgtgcgtgcgggacaccactgcgccaagcctctcatgcgagagatcggccaggccgcgaccgcccgtgcgtcgctgtatctctacaacgaccgtgctgacatcgacgctctcgtcatggcactccaagacgcctggcagcgcttcaacgactaggagacctcatggacgacctcgaggacctgtatcgagagatcatcctcgatcactacaagcacccacgcaaccagggcgtgctcgacgatcccgacgcgatccgagaggagggcttcaatccgctctgcggtgacgagatcaagctctcgatcctggtcaagggcgaccggctcgccgacatccgcgtcgatgggcatggctgttccatctcgcgctcgtcggcctcgctcatgagcgaggcggtcaaggggaaggacctcgccgaggtcgatcgcatcatcgagcgtttcaaggcgatggtcgtcggcggtgagggagctgctgaggggctcgattcgctgcgcacgctcggtgaactcgcggcgctccagggcgtcgtgaagttcccggtgcgtgtgaagtgcgcgacgttgccgtggaactcgctccagaacgcacttgccacggctcgagctcgcggaggcgagtagcacccccacgagctcgatgcggtggggaggtgcgccgtcgcgggccttcgcgatcggcatctcgaggacctgcgtcggcgtctgacgcttggtgcgagcctctccgtgtggccggctcacaatggctgtggcggagtcagacccgtacgagcttcgcgcgttggcgagccacccgaacgatccggcgggaacctcatcggaactgcccctgccctgccacgacgatgggccagggtgtgcgcggcgcgtgcgctcgtcgcgagttcgggagatgtcgatgtggccatgcggcggatcctcgtcggctggacccggatgtttgccgcggccgacgtctctcgcgcccagcgggacctgtcatcggtcgggcgaggaggtcgggctcggggtgacggtcgagtcggttgcggggcgggccggcggtcgggtgcgaaggtacgcgcggacgctctctcacagagcacgcagtgcggagtcccacgccgacgcccacgccttcttcgccgcgagccatcgctgcagcgctctggtatctggccgcgctcggccctcagacttcgagccctcgtcgtcacgtggcgtcgcgccggcgggaccctcgcccagctctggcgtcgtcgtggccccgtcctccgtgcgcgccagttcgagccatgcccgcttgcgtcgctcgcactcgtgccagaggtcgtgacactcgggtgcctggcagcgctcgcgatcgagcatgaggttcgcgaactcgtccctcactgcgcgcgtcagccgctccgggccgacagcgtcgatcaaggcttgccattccatggacgctgtgatgaccgcatcgatcgaggcgtcggctcccaggtccgtcgccacggccaccgctgcgtacgctcgcagccatgtctcacgccatcgggaggggagttccagcgacgatcgggacctccgcatctcagagcgtcgtaggagcatcgcgagcagctcgttcacggcttccctggggtcactgatgtctgtcactgcaaggtactgctcgatcgcatctcggcgaacacaggagggccaacgtcggttctcagctcgcacggtgcacctgcctgatggatcggtcggtcgctgcggtcgagcgtcgttccgtcacggtggctctctctgcacgagctcgcgagtcatcgacgaccacggctggaccgctcgtgacgcagcactcttcgtcgtgcgcccagcaggcatgcgcccggtcggctcggcctgcctcgacgaccacgggtgcccttgctgggcgtgatgacggcgtcgagatgcccgagcccggcgaggctgatcgtgcccaggaaaccatgctttctcgtcgggtggccaaacgccggcagcgctcgatcgggatgcgggcgttgaggacgccctcgcctatcagccgcctgatcggtacccggtctttcacgacgatcaccctccatggtcgggcgttcacctctcaccggtgaagtcgttcgctcgtcgaacggcgtcgaccccccgacgacctcgcgtcgtcgtccaaggaggacgggatctgtcgagccgtgcgtggcgcatccgctgcatcgacgttgcgacctccgctggagatgcgggtgctctggcatctggcgtttcctgtcgtgagtgcacgctctcacgccttcatggcgaccgagatcaaaggggggcgagctgggttcgcccgagcgggcgtgcccgtccttggctggcgagtcagggggccgtcagttgccaatggcgtcccccgtcggtcgtgtgcagcagcgtgctgcatccatcgtgacagtccagtgactgtagccagcccgtcgtgggcgagacgaacacggccgagaaaccctggtgcaagagggacgggatgggcacgcgctcgacggaaccggtcgtgcgatgcacccggacgaggaacgagaacgacggcgtggcataggggctgagtgtggcccagaccgtcgtgggcgacgcgtagtcgatcgcgtcgatgtcgttggcgccgacgctgaggttcgtccaggagttcccgtcgttgctggtgtaggcgagaacgtcatcggaaggcggggcgccggtcgccgcggttgcgccgaggggacgcgtcgagccgatccacacgctctgggcggagagcgggtcgatggcgagcgggatcgtggacccggtgtggtgtagcgcggtcggcctgatcgggtcggtgatgggggagagatacgtcgcaccggcaccgaacccggtcgcggctgtggtctcgagggcgactccggtcccgttggcgacgaccgcagcgactgcgttggcgatcgacgagggcaccatgagggatggtcgctcaccggcacgatcaactgtgacgagctgaaggactccttcgggcgtctgcactgcgatcacgagcgccctctgccgcgcggtcgtaccgatcacgtgagcgttcgggcttgcgaggagcttcgagagcgccggagaactccatctcgtcgatccgaccagcacctcgagctggccgcttggcccgaccccgacgataccgaggcttccttgcgcgttgaagagtgagctgaccatcacgtcgggaaacgatcgcgtccagccggttcctggactgtagcgatagatgcctcgctcggagaccgcgacgacgctgccgttcgagagcgtgcgaaagttgtcgaactcgacaccgtgtgtcatgaaccaatgcggctggttggagacgaacgacggtgtcggcgtcgtagcaaggagcgggggcgacgcagggaagttggctccaggggtcggctggaagccgacgacgaggctcgatccgacgacctggaggctatcgggaaagacgccatcgagctgagggcccgggctcgagattgcctggaaggtggccgatccctgcgtctgggcaaagtatgcagtttcgccctgcgaggggctcgtcaccaggagatacgagctctgccgaccgaagtcgaagctcgcggcggttccagggtatcgaagtgccagcgtctcgagcaggtgccaggtcctgccaccatcggtcgtggcctcgacggtggttccttgcgctgcgctgagcaccacgtagccccgcgctggcgtcacgaagccgacgccgatgatcgtcgggcctgacgagaagtgatggagcaggcgaaagcgcgttccctggtcgaccatcgcgtagagatcgccgctctgcagtgaggcgacgaagccgtcgttgcggtcgaggacgtcgaggagagggtctggccctggaagccgtgcgaggtaggagaacgcgccgtctcggtaccggagcagcaccgggttccctccagtggccgatgtcgaggccagatagacggtaccggtagcggtgatcgagctttggaggatgtcgagcggaagctgctcgacagccttggtggctgtggttttgctcgccaccgcgggtcgcgaagcgatcgcgccacagcccgcgagggcgagtgacagggcgagcagcgggaggatctccttccgcggccacgagcgggatgttcgccccatcgcgtctcgaccactcgttggggaactcatgggttcatggtagctcacagtgcactcccggattgggggtccgcgaccagcgatgctcggtcgagttggggttcaaggtcgcgctcggtcgtgcccggggagacgccatgagcgtgcggggctcggtgtccctggcggcggagcgcccgggtggccacaggcacgttcctccaagtgcggcaccagcgagcgccttctcgtgtgtcgtcgcgaacggcctcgacagcctcgtccaccgggtctgccgcttgatgaaaccgacaggacgatcccatcgtgctggtcaatgtggccacaagggtgttcgtgccagcgcgcgctggctgtcgagcgggtcgtcgtcggacctgccgtcgccagtgcaagaaccgcacgagcggccaacccacggtgagctgtgcgcatccacccgcggatctcgctgtagttgatgagatgcatatagtatatggttgacatggagcgcatcatgaacccgtacaccccgggtgctggggatcgcccaccggtgctcgtcggtcgtgagcgccagctcgccctcgcagaggccatgcgccagcgcatcgaacacggcttctcggcaccaccgacgttcttcgtgggtctccggggagtcggcaagacagtgctgctccgggagatcgctgaccagtttcgacggcatggctggctggttccctacgcggaggcccgccgaggtgcttcggtggctcggatgctggtgacctacgtgcacgaagccgagaactctgcgcccgtgaagggacgccttcgtgaggctctggcccagttggtgcgccgcggtggttcagtggaggctcttggcgtgggggcgacgctggggccagagaccgtcgactcgacgacacgcgctgcccaggatctcgagcacatgcttcgcagccttggtgaggcggccaagagcgacagggtgggcgtggccatgctcatcgacgaggtccagactctctcgtccgagaccgtccgggagctcatctgggtcgtccagaaacttcgccaggacctacccatcgctctcatcggcgcagggctcccgcaccttgccagcgtcctcgccagcgcggtcacctacgccgaccgcttccgctacgagagtacggacaacctcgatgacacggacgtacgagctgcggtgcgtgggcccgctcacgagcgcctggtcgagtggagcgacgacgcactcgacctgttgtgcacgatcgccaagggctacccgtacgccgtgcagctgtgtgcctacgaagcctgggagcaggcggctcgcccgggcgaccctcggcagtgggtcgcgatgccgttgtcggcccagtgggcggtctcggagttcggggagcgcgttggacccccgtcggtcgagggccagcaggtgcatgccatcactcgctcgcacctcgatgccgcgatgccgcgcatcatcgaccagatgcgcgcgggcctgttccgctcacgctatgacgggctgaccccgaagcagttcgcctacgtcgaggccatgcttgcggagctcgagcccgactcgacggctcccgtctcggccatcgcccagcgcctccgcgcgtcgctgagtgcgctgtctcccgtgcgcgatgccctcattaggaagggtgtcatctatgcgccggggcgcggccgggtcgcctttgccgtaccctggttcgcgagcttcctggcagaggagatcgttgcgaccgagccgagcagctatgaagcgatccttcccgggcttcgtgctcgcggcgtcgacctcgagcctccaggcggttccaccggtgcccctcgatcgccgactccacctctgcagtcctctgactaaggatccgtaccgctcgattcgacgggtgtcgcggccgcgcggaggcatctgtctcgttcggccttgcgatggtggtcgcgtacagtcgggagtcgagcaacagtggagagaacaggtgatcgatgccgagaccgggcggctcggccccgtacgggtcgtcgtcgctcccgacaagttccgtggttcgctgacggcggccgcagcagcgcgcgcgatgagcaagggcatccggagccagatccctgactgttccgtcgtcgaggtgccgatggccgacgggggtgagggcacgctcgaggccctcgaggcggcagggtttcgcgtgcgaggcccggtgctcgtccatggaccctacggtcgccgcgtgcaggctcggtgggtccggcgcggacccatcgccgtggtgcaagcagccgaggctgtgggtcgtcgggccgtagggtcggatcggctgcgagcccccgacgccacgacgcgtggcgtcggtgagctcatctcggccgctctcgaaccaggcgtgcgcgaggtcgtcgtgagcctgggcggctcggtcacgaccgacggcggcgccggcatgttggccgcgctcggcgtcgagatcgccgatgcgctggggagacctgttggcgatgggggcgcggcactcgagcatgcagcctcggtgtcggtcgctcgggtggacccgcgcctccgggcggtgcgcatcgtcggcgccgtcgatgtcacgaacccgctgctggggccagatggggcagcacgcctcttcgcgccgcagaagggagcctcgccggtcgaggtcgaccagctcgaacgcgccctctcgcacttcgcggacgtcgttgccggttccctcggacgcgacgctcgcgcgttggccggcgcaggcgctgccggcggtaccggctttgcgctcgctggcgtgctcgacgcgatgctggtgagcggcgcttcgctggtgggtgagctcacgggctgctggagcgcgctcgatggggcatcgctcgtcgtgaccggggagggttcgctcgacgcgcagtcgctgcttggcaaggtgccgatcgaggtggcgcgccgagcgcgagctgctcacgtgccctgtgtcgccatcgtcgggcgttgcgagctcgaagcagccgacctcgccgaggccgggctcggcgaggtggtggcactggtcgactgggccaacgatgccaccgaggcgcagcgccgagctgcggcgctcatcgcgatgctctcggcgcgcctcgctcgacgctggtgcgggtagctgcgcgttggcgcggccgcctcgtcactcgccgatgtagctcatgacgtgcttgatacgcgtatagtcctcgaagccgtacatcgacaggtccttgccgtagcccgagtgcttgaagcctccgtggggcatctcggccacgatcgggatgtgcgtgttgatccagaccgcgccgaagtcgaggtcgcgagcgacgcgcatggctcgagcatggtcgcgtgtccagacgctcgatgcgagcccgtactcgacgtcgttggcgaggcgcatggcttcggcctcgtcctggaagctctggaccgtgatgatggggccgaagcattccgaacgcaccagctcgtcctcttggcggaggccggcaaccacggtcggctcgaagaagaaccctggccggtcaacgcggttgccacccgtggtgatctgggcgtagctggggaggcgctccacgagcccgcggatgcgctcgagctggttggggttgttcagagggccgaagtagacgtcctcctcgtccggggcccccaccttggtcgcggcggcctgtgcggtgagggcggcgaggaaggcgtcgtgcgcgctcgcctcgacgaggacgcgcgcggcggcggtgcagtcttggcccgcattgaagtagccggctccggcgatgcccgccgcggccttctcgaggtctgcatccccgaagacgacgaccggcgcgttgccgccgagctcgaggtgcacccgcttgatgtcctgggcggccgcgagagcgacttcgcgcccagcgcgcaccgatcccgtgatcgcgaccagctggggggtcgggtgggcgacgaggcgtcggccagtgtcgcgatcgccgaggaccacgttgaagacccccggtgggaagatctcaccgatgagttcggcgaggagcgtcgtcgacgcgggcgtcgtgtcggatggcttgagcaccagggtgttgccggccgccagcgcagggccgatcttccagatcgccatcatcagcggatagttccacggtgtgaccgcggcgcagacgccgatgggctcgcggcggatgaaggaggtgtgatcggccatgtactcggccgccgaacgaccctcgaggttgcgcgcggccgcggcgaagaagcggatctggtcgacgctcggcgggatctcctcgctgagcgtcagcgctcgcggcttgccggtgttgcggacctctgcctcgacgaggtcgtcggcgtgcgcctcgatcgcatcggcgaggcggaacagcagcaaggaccgctcggacggcgtcgtgcggcgccacgtctcgaacgcgttggcagcggcgcgcatggcggtgtcgacatcgacctcgtcggacgcagggctgtgaccgtagacgagacccgtcgatggatcgacgatgtcgagcgtctggtcggcgtgggcgtcgacgaacttgccgtcgatgaagttgcggaacaccgtcgtcatggcatcctcctgggtgtcgatggtggctgtccagtgaggggacgcttctagtcaactacatctgagccgcgcttgcaaccgattgcgtcaactttccatggcaattctgcgctttctgttgacgaagccaccaaaatcggtaagaatggtggcgcacgtcggttcctgggtcgtaccgggtcggggagccgacgtgggtggcgttcgggttgcacccagcggtcgcacacgaacgaactcggaacggagggaggtccatggcgcagcgtcgtgagccgtctgtgcgggccttccccatgattcgtggccagggcttcctcactgccgatcgagccgagcgcaacggggatggggagcgggcgcccgtccagctcgatgccatctcgaagcagttgatctccctgctgcaggtggatggacgcgcgtcctatgcggcgctcgccaagcaggtcgggctcagcgaggctgcggttcgccagcgtgtccagcgtctcgtcgagtcccaggtcatgcagatcgtcgccgtcacggacccgaagatggtcgggtttcgtcgtcaggcgatggtgggcatccaggccgtcggcgatctcgaggcgttggcatcgcagttggcggcgattcccgaggtcatctacgtcgtgatcgcagccggcagcttcgacctgctggtcgaggtggtctgtgaggacgacgatcatctgctgcacctgttgaacaccgagattcgtccactcgagggcgtgcgatcgtcggaggtgttcgtgtatctccggctggagaagcagacctacagctggggaactcgctagggacggtgagtccgtgtccgtcgcgtcgaggcgcacaccatcgaggtcgacaatgaagttcgacggtacgcgagtcggagcaagaagggaaggaagaggatgagcgagcagcacgacctgtcggacgtggcccgtcggcacctgtggatgcacttcacccgcatggcgtcgtacgacgagcacgaggtgccggtgatggtccggggccagggcccctacgtgtgggattcgaagggcaagcgctacctcgatgggctcgctggcctgttcgtggtccaggtagggcacggtcgtaccgagcttgcggaggccgcctcgaagcaggcgagcgagcttgcctacttcccgttgtggagctacgcccaccagccagcggtcgaactcgccgagcgccttgcggcattggcccccggtgacatcaaccgcgtgttcttcacgaccggtggctctgaggccgtcgaatctgcatggaagctcgcgcggcagtacttcaagctcaccgggcagccgaccaagacgaaggtgatctcgcggaacctcgcctaccacggcacctcgatgggtgcgttgtcgatcaccggcctaccggggatcaagaccccgttcgagcccttggtccccgggtctatcaaggtggacaacaccaaccattaccgctgtgtgcactgcagtgcggccgagacctgttcgctcgcgtgtgctgacgacatcgagcagcgaatcctgatggagggccccgagaccgtcgcggcggtgttcctcgagcccgtccagaacgcgggcgggtgcttcacgccggcgccggggtacttcgagcgggttcgggagatctgcgaccgctacgacgtgttgctcgtctcggacgaggtcatcactgggttcggacgactcggcgagtggttcggcgcgatccgctacgactaccagcccgacatcatcacctgcgccaaggggatgacgtctgggtactccccgatcggggcgatgctcgtgtcggaccggttgatggagccgttcttgcatgacacgacgacgttcctccacgggatcacgttcgctggacatccggtctcggcggcggtcgggctcgccaacctcgacatcttcgagcgcgaaggtctcctcgaccacgtccgtcgcaacgagccgctgttccgggcacagctcgacaccctgctcgatctgccgatcgtcggtgagattcgcggtgctggttacttctacggcatcgaactcgtcaaggatcgcgccacgcgcgagaccttcgacgacgacgaatccgagcgactgctgcgtggtatcctcaccccgacgctcttcgagctcggcctcatctgtcgagcggacgatcggggcgatccggtcgtgcagctctcgccgccactcgttgcgggcccggagcagttcgaggagatcgtcgcgatcttgcgggaggcgttcgagcgcgcttgggctgcgctgtgatcgatggcccctcggtggcccaattgtgtggcgaccgaggggccgatgcgactcactgggattcgacggggtctcgcctactacgcacgtgctgagctcgcggatgagccgtacgcgccccgggcgttgctcgggagcggatggcgagagtatccgcacgcggcagcgctcgcgctcgacgagctggtgctcgaacccgccccgcgcacgctgatccacgcggtcgatctcaccatcgctgcccccaaggacgtctcggtcgtctggggtctcgccgccgagccctttgccgaggccgtggccgaggcccatcgaggcgcggtggccgacgtcgtcacgtggctcgagcgccttgacctcgcccgtgtggtggacggggaggcggtccccgccagcggcgtgcgcggggtcggcgcgcaccatcgcttgtcgcgcgctggtgagccccacctgcacacccacgtcgtcctcgccaacgcgatcgaggtcggcgggcaggtagcgcccctcgaccatgggcgcctgcggcgagtgttgccggccctcgagctcgggtatcgggtcgagcttgctgctcggttgcgtcgtctcggtctcgtcgtggacggcgatggcctcgggcgatgggcggtccgcggcctcgatcgtcgggtggccgatgccttctcgaccaggcgcagcgaggtgctcgcccaggcgggctcgaccgcctcggcccgagctcgtcaggtggcggcactcgcatctcgacgagggtgggccgagggacccgtcgacctagtgaacaggcgcgagcgatggcgcgaggcggcacgacgcgagcgtcgcgacgggcccggcgagcgcggtgcggtcgctgcgaccgcccaggccaaccgtcatggagagccgatccgtatcgccgacccgttcttcgcggagttctcctggcaggcccgcgctgtgctcgatgccggccagggcctcggcgacctggtggcagcgagcctccgagcggccgtcggaccggctcgggcgcgcgggttgctcatcggcgctcggatccgggctgcggggagcgagctcgccctcgatggttcgctcgtgcgtcgctacggagcgctgccgctggccgatcgactggcgctcgcgggcatcgacctcacgcgccccatcgtcgaggtgtcgagtcgcgatgccgtgcggatggcggacgagctgcggcgtgcgaccgggcgagagcacgtgcgcgtggtcgcacggagcgatgccgaggccgccctgctccagcgcctcggggcgttccgcgatggccgccatcccgcccgggtcgtcgtggatgccgtccatcgtgccccgagtgacctgcgtgccctcgtgacgagtccggaacggaaccttctcgtcgaggtgcgtcgtcggcccgtcgtgccgtctcgatcctccctgtcgctccagcgtgacggtcgtcgcatcgagctctgcgccgatctcgagaccgcgctcgaacgctgcggcgcctccgtcgccgaggtgcttgggcgcggtgaggacgtgtggccggtggcggtcgtcccggacactgcgtacgcacggcagctccgacgcgtggtggcacgtgcgttcggggtcgatccgcgctccccggttcctggagagccggtcctcgtgccacggactgggcgaggccgcgtcgtcgacgtgtcgcgcgatcgggtgacggtcgagacggggggcgcccggatcgacgtcgccgcgagcgaggtggtaccgctcgccatcgcgaccgaggggagggctccgatcgccttggggcccgacctccagcggggggtcgaggtgtctgtagtcgtggcgccggagctcgagcggttcgtcgcgacttgccgagcgctcgggatggatccgcggcggatcgaggctgctccgccacgcgaactgctgaccgatccgaccgcccgagcgctgtggcgtcaagcccgcgggttgcatcgctcactgctcgggcggctcgagctcggcgagcggactcgtgaggtcgatctcccgggtctcgaccggggccggtggcgttgaggagtcttgcgaggcccctgcgatggcggtagcctcgtctcagagccgttgctctggtgcctggggagaggtcgatggttggcgtcgtcaccgcgtcgtcattgctcgaggtgacaccgccctacggcggcgtcatcgtgctcatgctcggcgtgcttgcctattgggtcggggtgccgaggttggcgcgtacgttgagcatgtccccgaagcgggttcgtctccgcgacgtcgcgacgcggcggcagcgactcgcgtggagtgcggcgcttgcgatcgcgatcgtcgacgagtcctggcccgtgctcgagctcgccagacgcatctcgctggtggcctatctcctccacaacctggtcatcgtgctcgtggtcgtcccactggcgctgctcgggttgccggggtgggtcgtctttcgcctcactgagcgtcgatgggtggacgccgtcttgtcgctcattgcccgcccgctggtggcgaccgtgctgttctgtggcgtcacgatcctgtcgatgctctcgcccatcgttgaggcacaagcgcgatccctggtggtcttcgtctacctccaggtcgtgctcgtcatcgcgggtgtcgcgctgtgggtaccggccctgcgcctgcaaccgggcgtggagaagctgtcgaccggcggtcgggttctgttcctcttcgctcagagtctgattccgtcgttccccgccgtggcgctgatcttcgcgaagcactcgttctatccgttgttcgcacgcaacgtccacatcgtcttcggggtgtcgggcgtcggcgaccagcaacttgccggtgcgttgtcgaagatcctcaccctggggatcctttggaccacggccgttgttatattggcgagggcccagacccgcgaagatcgcggggacgacccggagcccatcacctggctcgacgtcgagcgagagctgcgccgtagctcgtccgggtagccctcgggccagaaccgtgaggagcacgcgtgcagcttcgcaacgtggcgatcatcgcccacgtcgaccatggcaagacgaccctcgtcgacgccctcttgcgccaggcgggagcgttccgcgagggcgccgagaccgaggagcgcatcctcgactccatggatctcgagcgcgagcgggggatcaccatcttgtcgaaggcgaccgcgatcccgttcggcgacgtcatcgtcaacctcgtcgacacgcccggtcacgcggacttcggtggtgaggtcgagcgagcgctctacctggccgacggcgcggtcctgttggtcgacgccgcggagggcccgctcccgcagacccgcttcgtcctggccaaggccatcgagcgcggcctcgcgctcgtcgtcgtgatcaacaaggtcgaccggcaggatgcgcgcccgcacgaggtgctcgacgaggtgctcgaactgttgctcgagctcggtggtcccgacgtggatctcgacgtcccggtggtctacgcctcgggacgcgcggggcgggccgacctcgagttgcccatgcggagcgaggacctcacgccgctcatcgagacgatcctcaagcacgtgccggctcccgatgccgatcccgacggcccgctgcgcgcccaggtgctcaacctcgacgcctcgacctatctcggcagactcgccctcgttcgcgtgcacgccggtcgactgcgccggggccaaagcgtggctcgggtcggcgtcgacgggcgcgtgagcactttgcgcctcggcgagctgttccggatgcacttcctcgagcgcgtgcccaccgacgaggtcatcgcgggcgacatcgccatcgtcgcaggtgtcgaggacatcggcatcggcgagtcgctgtgcgaccccaacgatccggagccgctcgcgccggtgcacgtcgacgagccggcgatcgccatgacgttcagcgtgaacacctcgccgctcgccggacgggagggcaccaagctcacggcgcgcctcttggcgcagcgcttggcacaggagatcgtgggcaacgtctcgatccaggttcgccagacggagcgcagtgatgcgttcgaggtccagggccggggggagctcgcgctcggggtcttgatcgagctgatgcggcgtgagggcttcgagctcaccatctcgaagccccgcgtcctcacgaagctggtcgacggcgaagtgtacgaaccctacgagcgcctcgaggtcgaggtgccagaggatctcttcggagcgctcacgcaggtcctctcaccgcgaagggccgaactcgtgacgctggagcactcccagagcggctgggtgcacacggtctattggatcccggccagaggcttgctcggcgcgcgaggcgagctgctcacgcagacacgcggccaagcggtcatccatcactccgccgatggctacggaccgtgggtcggcccgatccgcccccgggtcgcggggagcctcgtcgccgaccgggctggtgtggccacgacgtacgcgttgctgtcgttgcaggaccgtggcacgctgttcatcggcccgggtgacgaggtctacgagggcatggtcatcgggctcaacgcgcgtccaggtgacatggacgtgaatccgaccaaggagcgcaaggtgacgaacatgcgctcgtcgaccgccgaggaactcgtccgtctgaccccgccacgacgcttgacgctcgatagtgccttggagctcatcggcgacgacgagtgcgtcgaggtgacgccgaaggcggtgcgagtgcgcaaggtccagctcgtcgggagggagcgcgccaaggcgcgccgatcaggcgagatcggggggacggaggcgtcgtagcgggagctcccgcctggtgagtggccgggtggcccccaggcggtacacctcccggacgaggtgggcggaaggtccgggcacctcgaacagcacgacgcagtacggcgctcgtgacctgggcacaccgagggtcggcccgacacgaccgggcacctcggcgaggccgcggaagtgggccttcgctggtgcgtggacgagcgccgcctcgagtggacgcacacagttggccgcggacgtcccgccggcggagcgcgctccaccacaggcgcagagcgcggccgcgagcaccaggctcgtcacgagctcacgtcgtggcattggttggcctcctggcgatccagaagtaggccgcccatccgatcggcagccagatccagtagctggcgagtcgatagaggatgacggctgcgagcatgggcaccggcgctcctccgaaggccacgagcgcgacggtgatggatccctcgacgacgccgagcccgcctggcgtgatggggaggttcgtcgcgagggcaccgacgacgtaggcactggccgcggccgccacggacacgtgggcatcgacggcggcgagcgcgacgaggagcgcgccgaagtcgaaggcccagttgccagccccgaggccaatggaggcgccgagccggcgcggtgggatgcgcagcggctgcagacggcgtgcactcgcggcgaggcgtcgccatcgcacgcgggtggcgagacgggtgaggagctcggcgacccaggccgacaggcgctcgagctgccacagggcgagcgcggcggcgatgccgacggcgacgatcagcgcatcgtcgagcgacgagagcacgctggacgcgggtgcgtgcaccacgagcgcgagtgcgaacagggcgatcagggtacccatcgcgaccaggttggaggcggcgatgaccgaggcggcggcgaggacgtcgacgtcggcgtcgtggagctgggcgaccacccagacggcgctcacaccggcgccgaaggggatcgagttggtgatcgacagggctgcgagcgagatcgcgaggaaccggacccacccgagtcgcgttccgctcgggaggaggacgtaggtcatgagcgcccacgccgtgtcgctggccgcctccaggacgaacgcgatggcaccgaggacggcgttcgcgtggaggacgatggcgaccgatcccgagagctgggcgcgctgggaggcgagtgcccaggctgcgaccgcgatcccgacgagaccgaccaggagccgccagtggtggcgaacgcgcgccagtcgggccggtggagccatcgctcgcgcaggctagtgcggcgcaggctggccgtagacttggccggcggtgccggggcggcacctcgggcgttgggagggcggcacgagcgagttcgacgtcatcgtggtcggggctggcgctgccgggctggcagcggcgtcttacctgcactacgcaggcttcgaggtggtcgtggtcgaggccgaggcaacggcgggcggtcggctccgcaccgacaccgtcgacggctaccggctcgatcgtggcttccacgtcgtcctcgagggctacccggagcttcgccggctcctcgcgccagggaccaccggcctcgttgggctcttccccggtgtcgcactgctcgcgcccggcgcgccggttcgagtcctcgccgatccgcgccgcgtccccgcgaccgtcgcgactaccgcccgcgagctctggcatctgcgtgggatcccgcgcgctcgccggctcgtcgagctcgtcacgcgtgccgatccgtcggtcgcggatctcgtcggggcgctgcccgagccgctcggtcgtcggctcgccgggcccttcgctcgtggggtcctgctcgcacccgagctcgacgtgcccctgtggcgtgcaggcgaggtggtgcgtgggttctggcgtggccgtgtcggcctgccacaggggggcatcgccaccctcgcggacatcctcgctcgggacctcgagggtcggatcaggaccgcgtcgccggtcgccgccgtcgagtccggtggcgtcgtgctggagagcggggagcgtctcggggcaggcgaggtcatcgtggccgccggtcccgaggccagcgctcggctcctcggggcccccaggctcaccgatggccttcgttggcgagcccagggctatgcgcacctgcgggtcgcgggacccgtgctcgagctcccggtcgtcgggctcggtcccatggacgagccgatctggaccgtctgtgaggtgggggccgcggacccgctgcgagcgccgatggatcgggacgacacgctcgtgacggtgagcttcgacccgacgctcgatccggcggacgtgcagagggcggcggccacgttggtgcccgcgctcggatcggccgagctgctcgcgatcgacgtggtggctcaggcgctcccagcgcttcgacgtgcgcctgcggttcgcatcgcccggggcgtcacgctcgcgggcgactggaccgcatctccgagtctcgacggcgcactcggatccgggcggcgcgcggcggaggcagcggcccgtgcgctgcgaggagcggggagtgaggatcgatgatgcgtgaggtcgaggttcccatcgaggcggcgagttcgggctcggtcagtgcccggatgcgctaccgcgatggccgtcgcgtgatgtgggtcgcctcgcgtcccaccacgcgccgtggggcgctctctgagcgcgacggccatcggatcgcgcgcgcggccgacctcgcgaaccggctcgggatccccctcgtgctcgagctgtcgacctcgggagcgaagatcaccgacggggtctcggcgctgcacggatgggggatcgcggcgagcgcgttggcacgctgctccgggcgcatcccgatcctcgccggtctcgtggggcccgccgtctcgggaccggccctgctgctcggggtcgccgactgggtggtcgtcgcccccgatgccttcgcgttcttgtcgggaccccaagccgtccgcgaggtcaccggcctcgacgtgtcgaaccagacgctcggtggctcgcaggtgctcctcgcccggtctggggtcgccttcgaggctgccgacgatcgtcggggggtcgaagaggcgatctggagtgtgctcgactacctcccggactccaccgatgaggtagcccgacgcatccaccccatcgatcccgatccgatcgacctcgatcggctgattccggacacgccgacggcggcctacgacgtccgcgacgtggtgcggggcatcgtcgacgagggttcgttccacgagctgagacaggcgtgggcgaatcagctcgtcgtcgggttcggccgcatcgagggccgcgcggtggggatcgtcgcgaaccagcccatgatcatggccgggacgctcgacatccaggcggcccagaagggcgcccgtttcgttcgtctctgtgacagcttcaacctgcccgtcatcacgatcgtcgacacgccgggctttctcccgggcaaggacgtcgagtggcgggggatgattcgccacggtgcagaactggcgttctcgtacgcggcgtgccagacaccgcgggtgtgtctcatcgtgcgcaaggcctacggcggtgcctacatcgtgatggactccaaggggatgggcaacgacgtcaccctcgcgtggccgtcggcggagatcgcggtcatgggggcccaaggtgccgtggagatcttgcaccgtcgtgccgacgaggaagcgcgcgccgcggccaaggccgagtacgaggaggtctacctgaccccgtggatcgcggccgagcgaggctacgtcgatgaggtgatcgagccgtccgagactcgttcgcgcatcgctcgcgcagtcgagctcctcgtgaccaagcaggagcacctgcggcccgccaagcacgccaactcgcccctgtgagtcgccgtggtcgacgtcgcactcgagcgcctcgtgaacgtcgtcacgcttctcgcggagcaccccacgccgctcgagcgcgacgagatcgtccgcaccgtgccggggttcccggctagtgacgctgcgagcgcgcgcgcgttcgaacgcgtcaaggaaacggcgcgcagtctcggcatcgagatcgagaccgtcacgttgcccggacgcagtcgtgtgggctatcggctccggcccacgacctggcagctcgaactcgacgacgccgaggtggcggcgctcgaggcggccctgggtgcggtgtgggtcgccggcgtcgagcccggcctcgcccgcatcgggctcgcggtgggggcggtgcccgcgcgtgggcgacggtcctcgctgctcgatgcgcccccggccatcgtgaccgcgatcgccgagcgcgccgtcatcgagatcggctatcgcggtgagcgtcgtcgcctcgccccggtcggcatcggcgcgagatgggggcacgcctacctcgtcgccgccgacgacgacggggtgatcaagacctttcgcgtcgatcgcatcgacgagccgatcgtggtgctggaggcccaccacgagatcgcgccggtcccgatcgacgaggtgctgcctcggcaccctcgcgagctcgtcatcgaccgcccggtccaggtcaccgtccaaggtccgccggagaggctcgcggccgtgggtgccgacccggagacgggttcccttcgtgcggccaatctcgacgtggtcctggccgacgtgctcctgcacgacctcgcgttggtcgggccccaactggcgcgcgagcgcttggcggatcgcctcgcgacggccgagcgggcgctcgccgcgacgccgaccgcgaaggtgcctcgggccggcgtcgagcgcacgaacctcgcgactcgctacgccatgctccagaccatgctcagggtgctcggcgagcggggtcgagcaccgctgtcggagttggcggcggtggcgggcacgacgcgagagctcgccgccgaactgctcgagacggcctcgctgtgcgggttgccgccgtactcgccggacgtcttgctcgaggtcctcgtcgacgaccccgacggcgaggtcgaggcgcggctcgagcgaacgccgccacggggttcgctcgcgatcgaggaggccgtgagcgtgggggcgaccctcgaggcgcttcgtgaggcactcggcggcaccttgccgccggtgctcgatcggctgcgtgcgcgcatcgccgagggtctcggtgtcgtgccgcggctcgtcaccgagcctggcgagcgtgcgtcgctcgtgaccgtgcacgaggcgatcgtgctcggcgcgtgcctgcgctttcgctatgccccgatcggtgcgccgagtggcgagcgccgtgtgcgccctcgtgaggtccacgcgctcgatggcgtctggtacctcgacgcggtgacgagcgacgggaggatccgcacgttccgcctcgatcgcatgagcgagctcgtggtcgaggcgggttgtgacatcgaggagtcggatcgatcgcctgcgacgacgaccgtctcgttcgtcgtcgacgtgccacgagccctcgaaccgctcgcggagtacctcctcgggtccgctgccgaggcggttcagggcggcgtgctcgtgcgagcgcactcgatcggatgggccgcccgggtcgtggtcgcactcggcgccacgccggtcgctggacccgcgacgctcttcgacgaggcgcgcgccgtgctcgccgcggcgcggcgacggctcgaggccgaccgtgacgactgagcctgctcgtcgccccgacgctcgagcggcgctggcgcacggcgcgcgcgtggtcctctcgacgcgcgacgaggcgttcggggtgcatgcggtcctcgtcaacgccttcgtgatcggcggcgatcctctcgaggtcgccgtcctcgcgcgcacgacgtcgcgcaaggtcgcgaacctccgacgcgacgggcgctgcgcgctctgtctcgtcgaagggacgagctacgtcactctggtcgggttggcgcgcgtcgacgccgatccaggcgcggtgacgcgggccgagcgcgccttcgccgaggcgttcggccggccgccacggccagcacccgagggctcgcgcgtgctggtcgccgttcgggtccagcgcgtgctcgccgacggtcctcggcggccggttcccgaaggccggtaggctcatcctcggccgatgtcgtcgtgaggcgggaggtagcgtggccaggggcacgagctcgctcgagcaacggggcgacgcatcgtcgtctgcgtcgagagacctggcgctccgactgatcgcgagcctcctgccgatcaagagcgtgctcggcgggcgagccgccctcggcgactgcggggagcaggcagcggggctcaccccgcgccacgtccacctcttggtggaggtgctggtgcgcggtcccctcagcgtgagcagtctcgccgagatcgcaggcgccaatctcgcctcggcgtcggtcgcggccagccaactcgaagccgctggtctcgtcgtgcgtaccgaggatccggtcgatcatcgtcgcacgctcgtgcgggccctgccgggcgccgaggcgttcgtggcggcgttccttgccacacgcgctgctgcgctcgagcatgcgctcgcccaactcgagcctggccacgcggagcagctcgtcgaactcctcgacgagctcgccaaggcactacgggtttcgatccgcgaggctcgcacgcccctgtcggcgcgatcgccccaggtcgacgagtgaatggttactgaaacgaaacaaagtagggctcgacgggtacgcgcggcgggtggctagggtgcactcgacgatgccatgtcggaacatgtggatggcgcgcgcggttgggtcactcgcgcagagcttcgagccgttcggccatgagctggggaggacagcgtgagtcgcttctttgatgccttgggccactgggtggtcaagctccggtggttcatcgtggtcgcgtggatcgccgccctcgtcgcgtcggtgtcgttgttgccatcgctcggttcggtggtgcagaacaacttccagaacttcctcccagcccagtcgccctcgctgcgtgctgcggcgctcgccaatcgcatccagaacgtcaacgagtcgctcgtcgtcatcgtcgtcgatcggccgaccgcgccgctcacgagcaccgatgcgacgtacgtggcgcgtctcgtccatgaggtgcgacacgtgccgagggtgctgaccgtggcggtgggcgcgatctcgcccacccgacaggcggagcagatcgaggtgctctcgagtcgatcgcagttctccgacacgggcacgaaggcgttggtggacgccatcgacggcgtcatcgcctcgagtcatcctccggctggccttgcggtgcacccggccggtgcggtcgccacggcggtagcccaggcgggccagaacaacacgaacgcgtccaacacccagctgttctcggtgctcttcatcctcgtgctgctgttcctcgtctttcggtcggtcctcgcgccgttcatcaccctcatcccggcgttcctcgtctcggtgttggccggcccgatcgtcgctcgcttgacgagcgtgctccactaccaggtgtccaacatcacccagctcctcatgatcgtcttgatcctcggagccgggaccgactacgggctgttcctcgtgttccgtactcgcgaggagctccagcgcggcttctcgggtgccgaggcggtgcagcgggcgatcgcgcgcgtcggtgagtcggtgagcttctcagcgttcacggtgatcgcggcggtgctgtcgttgatcacggcgacgttcggcttctacaaggggctcgggtggccgctcgcgatcgccgtgttcatcatgctcctcgccggcctcacgctgcagccagcactgctcgccatcttcgggcgcgctgcgttctggccgagccggccgcatggtcggggggtccgcgtgggctggtgggggcgcgtcgcccagcgcgtggtccagcgcccggccctcaccctcatcgtgggcgtcgtgttcttcggagccctcgcggcttttgcgcctcagaatgccccgtcaggattcgcgaccaccaccaccgcgccggcgggaacgagtgccgcggcgggcaacgccgccttgagccgctacttcccgcacgccagctacaaccccacggagctcgtgttccgcttccgcacgcccatctgggaccacctctcgacgctcgagaccctccagagcgccgtgagccgctcgcccctcttcacgcaggtgacctcgccgctcgctccggctggcttcccgatctcggtgacggagctcagtgcactgcacgcccgcctcggcgatcccgccaagctcccaccgacgccgatcggcggcatctcgcccgtcgtgtactcgcagtatcggtcgctgaagaacctgatcggaccgactgggcgcaccgtcgtcgtcgaggcgagcctcacggctggcgcacccgggtcgacgcccgcgatcaacgcggttcccgcgattcgcaccttcaccacccagctcgcccatcgcgtcggtgcaacgacgagcggggtcgctggcgaggcgccggcgtcctacgacgtctcgagcgcgtcgaaccacgacctcacgcacatcgtgccgatcgtcatcgtcatcatcgcgctgctgctcgccctcgtgctgcgctcggtcgtggcgccgctgttcctcgtggtctcggtggcgctgtcctacttcgcagccctcggcctcgctgtgatcgtcttcatgaagttcgatcatcagagtggactcatcttcgtcctgccgttcatgctgttcttgttcttgctcgcgctaggggaggactacaacatcctcgtcatgacgaggatccgtgaggaggcgcacgatctgtcgatgcgcgaggcggtcgtgcgcgccatcggcgcgaccgggaccaccgtcacgtcggccggcgtcgtcctcgcgggaaccttcgcggtcctcgcctttgcgtcgctcgggcaggccgagatcgaggagatcggcttcgggctggcgctcggcgtgctcatggacacgttcctcgtccgcacgctcctcgtgccgagctccgtggtgctgatcggtcgactggcctggtggccatccaggctcgctcgttcgggtcacctcgaggtgccgccgccgcgtgacgaggtcgatcgggtcggcctcgaggctgaggtgcgtgggacgctcgagcacgacgacgcctgagcggggcactgtgggttgggttcacgcctcgatcgacgcacccaccggcgtcgcgagcatcgtgctggatcggccggagcgccgtaacgccctcaacctgacgctgtggcgccggctcgcagaggtggcgcgcgaggtcgcggccgaccccgccgtccgggtcgtcgtgatcgagggtgccgggggtcacttctgtgccggagccgacgtcagcgagttcggtgatgcgcgagtcggggaggccacgctgacctacgatgcggcgacggaggccgccgcggccgccatcgaggcgatctcggtgcccaccgtcgcgctggtcgagggggcctgcctgggtggaggggtgtcgatcgccctcgctgccgacgtcgtgctcgctgccgcgagcgctcggttcggcgtcccggcggcgtcgttgggcacgctgtatcccgagggggcgctgggtcggctcgtgcgtcgcgtcggcgatcgacgcgctcgctggttgctgctcggggccgagcgcatcggcgccgtggaggcggtcacgatcgggcttgccgagcgggtggtcgacgatcgcgcgagtgggtacgagctcgtcgtccagatggcaaccctgtcgtcgatgacgcagcaagcgaccaagcgggtgctcgccgatcagcgtgtgcacggggagcttgctcggatcgtgttcgctgcccaggactatgctgagggccgccgcgcctttggcgagcggcgagcgccgcgcttcatgagttcgtgggaggcacgtcgggcgctcgaggggggatcggggtctctcgaggacccgtgagagaggggggaccgtgcgggttccgttgaccatccgcgacttcttgcgtcgcgctgtcgaggtgttccccgagcgcgtcgcggtcatcgacgagccgggcgtggtcggatcgctcgggacgctcacctaccgcgagttcgacgcgcgcgtgcggggtcttgcgagcgcgctcgcggcccgggggatcggggtcggtgatcgtgtcgggatcgtctcgcccaatgcggcgaagttcctcatcgcctactggggcgtgtcgggctacggccgtgtcctcgtccccatcaactaccggctcagtcgggacgaggtcgcctacatcgtcgagcactccggcacctcgctcctgctcgtcgacccggagttcgccgagacgttcgctggcgtcggcggtgtcgagaccatcgtgctcgacggggtcgacgacgctgcgctcttcgcggcagcggcggcggatgagccggggcctgcgtgggagccggacgaggacgcgacggcgtcgatcaactacacctcgggcaccacgtcgcgtccgaagggcgtggagctcacgcaccgcaactgctgggtgaacgcgacggtgttcggttggcacctcggcgtcaacgatcgcgacgtgctcatgcataccctgcccatgttccacgcgaacgggtggggcatgccgtacgccgccaccggcatgggcgcgacgcacgtcgtcgtgcgcaagatcgtcggcgaggagatcctccagcgggtctcggagcacggtgtgacgctcgcgtgtggcgcaccggcggtctgggccgcggtcctcgatgccgctgccgtgcgacgtgaccgtggtgagtcggtccccggacgggaccaggtccgcatcgtggtcgcgggtgcgccgccgccctcgcgcacggtcgagcgggtcgagacggagctcggctggcagttcaaccagatctacggcctcacggagacctcccccgtgctcacggtgaatcgacgtccgaaggagtgggacgatctcccgatggcggaggtcgccaagcggctcgccaaggccgggacccctgcgatcggcgtcgagctgcgtactgacgccgacggcgaggtcctcgcgcgttccaacgtcgtcttcaagggctactggcgccaacctgaggagacggccgccgcactcgagggtggctggttccacaccggtgacggtggcgtcaaggccggtggttacctgacgatcatggatcgcaagaaggacgtcatcatctcgggcggcgagaacgtctcgtcgatcgaggtcgaagacgtgctcttccagcatccggcggtcgccgaggttgcggtcatcggggtaccggacgccaagtggggcgagaccgtgaaggcgctcgtggtcgtgaaggacggccagacggtcagtgccgaggagcttcgggagttctgtcgagagcggctcgcgcactacaagtgcccgaccagcgtggagttccgcagcgagctcccgcgaacggcgacgggcaagctgcagaagtacaagctgcgccagccctactgggaggggttcgagcggcaggtgaactagagatcgtcgaggagtcggaagtcctcgacgagcggtatagcggcatcgagccgctcggccgcgcgggacgccgcggtccgtaggcgcgcgacgagcgtcgccgtggggtcgtccgccgccgtgacgccgtaggtggtgcggtactggctctcgtggcacgcgaggagctcggccttgcgtgcgatggcctcgtcggtcgtgggttcggcgtgatccggcgctggcgactcgtacagggccaggtagcgcggtcggtgggccgcgtggaaccccggctgccacgtgggttcgcgggcgtcggcgagcgcctggaaggtcgcggttgcgaccgcgcgatggtccggatggaggcggcccgggtggtcgggatcgtggacgagcaccacgtcagggcggcaagcgcggatggcggcggcgatctgccacgcgaggagcgcgacgtcgcgaaggcgcccgtcggggtgaccgaggaggcggaggtctgcgccgaggagcgctgctgcacgtgccgcttcgcgggcccgggtcgctgcgagctcggcgccgtcgatcgtcgtgtcccaggtgccgtggcgtccgtcgcttgcaacgaggatggtgatcgcacagccgtcgtcggcccagcgcgccagggtcgcgcccgccccgagttcgacgtcgtcggggtgggcgccgatggcgagcgcacgagccggggtggcaaggggggcctcgtggcgcaggtgcgcgccttggagggctgcggtgacgccggcggcttggcgagccggggtcggttgctcgttcgtcgtcatggcgatggtgccttcgcgcggtcgatcggcgggcacggtgcgtccggccagtggagggctgggtcgagcgcggtgagggtccgggcgaggtcgaggtcgtcgtccgtgtcgatgtcgagcaggaagcgcgtgccgaggagctgcacgcgtccgtagcgctcccgtagcgcgctcatgtgtcggcggagggaatcggggccaaaggcgaaggggaacgcggccgctggctcggggagccacagcgccacggtcccggtgagatgatggtcgggtgcgacggcaccgacgtcgccgaggtcggtggggagtgcgaagaacgggaggtcggccgggaccacgaggacgcgaccgtcgaggcccgccacggtctcgccgatggcagcgttcagctcgcgaccacgttggtgctcgatcgcgagcccgaggtctgcggccagctcctcgacgctcgggtcttcggcgaggacgaggacggaggccggctgcgaggcgctcgcgatgtgcgtgacgcacgcgcgaacgaaggctctgcgctcgtcgcggctgagtgtgtcggcgaggcgggacttcgcccgctcgagggagcgctggatgacgacgacgaccgatggctgcactggtggccgagtgtaggctcgctcggcgcatgctccaccagccatcgggtgatcggctcgtcgggatcgacgaggtgggtcgcggtgcctgggccggtcccgtggtcgtcggtgccgcgcgtggatcggtggcagccgccgccgccatcctcgcgcatccgcgcgggggggtgcgcgattcgaaggccctctcgcctgcggcgcgcgaggcggcactcggcgcgctcgaggcggcgggtctcgagctcacggtgggttcggcgagtgctcgcgagatcgacaagctcggactcacgggggccttgcgtcttgctgcgcaccgtgcgctcggtgcagcgagcgagctcgaggtcctgctggatgggcgtgttccctacgtcgaggccggtcgtgtgcactgtatcgtcggaggggatcgccgccacccgctcatcgccgcagcctcgatcgtcgcgaaggtgcggcgtgacgcgttcatggtggcgctggacgagctcgctgctggctacggattcgcccgtcacaagggctatggcaccgccgagcatcggcgtgcgctctcagagcacggagtgacaccgtggcatcggcgcagcttcgggccgatcggtgggatggttgagcacgggtgatcggcccctggcggagcacgccgagggcgcgcgccggggtgtcgctggtgtgcgacgcgctccgctgtggcgatatctgcgagtctgggggcgggaagggcccgtcgtaggcagtcctgtcgcgtggtgcgggtgaagcggtcgatgtgaccttcccgttggcgacgagcggcgagagctcgcagatcgtggccttggagcatgccgtcgtcatggcccggccacccgaggcgccctcccgggacgcagcgcttggcccttccctgcgtggggttgttcgtgcacctcgaccgaggaccggagctacgagcgtgcgaccgacgaatccgccgctcgatgtcggggtgcgtcgtgcccatgtcccacaaggttgtcccggagcacagccggactggtcgctgtcgtccgggcgctggtgaccaccttggcgagtgtgctcgtcgtgcgcgcctgggctgcgcgaagaccgagagcccacagcgcatcgagctcacggatggccagatggcgcacagcgcacggacgtgccgcgctcggcttgctcgtgcggaactgtggcgacgaggtcctgatgccgccggtcggctctgggcagtcggaagctagatctacggcgatgcagtcagcctcccgcccgaggagtgcgtctcgtggagggagctccctgcgctgcaaggctcgctccgcaagcccctctggccgagatcctcgcagaacggaggactcctgccatgggccagccagtccagtcgcgtgggtgaggtgcttgtcctggagcctcctaggctcgcggggcgatggagcgccgcagcctcgccgccctcggggtgttgtcagtgatctggggctgctcgttcctgttcatcaaggtcggtcttgccacgttctcgccggacctgatcgcgttcgtgcgaacgacactcggcgcctcggtcgtcctcgcaacggcgcgccttcgtgggtgggcgcttcctcgaggatggcggctctgggccaagctcgcggtcgcggcgctcgtctcgaacaccttgccgttcatcctctttggctacggcgaacagcacgtgagcgcggtgctcgcaggattcatcaacgcgacgacgccgatgttcacgttcccgctcgccgtcgcgctcaaactcgagcgcgtgtcggtcgggcgtatcgcgggtcttgccgtcgggatcgtcggcgtcggtgcggtcgtcgggatcgggaccggggcgatcagcggcgcgtcaggtgtcggggtgctcgcctgtcttgctgcggctgcgctctatgcggtcggcttcgtctacgtccgcatgacactgggactgaccggcgccaatcgcaccggcctcgctggaggccagctcgccatggccgcgctcgagaccggcgtcgtggttctcgtcatgcggcagggcatcgggaccgtgcatccgctcgcgctcgccgccgtggcgaccttgggtgtcgctggtaccggcatcgcctacatcgtcaacttcgcgctgattcatcgatctggggtcgtcggcgcctcgctcacgaccctcacgatgaccgtcgtgtcgacggtcgccggcgtggtcgtgctcggagaaccgcttcgctggtaccaaccgatcggcgcactcgccatcctcgtcggtgcgtggctcgtccagggcgcgcgtcccgtctcgaccaggctggtgccggcgaccgagtgaccaggggaggtccgacgggagctcgtcgtgtgggaggcgggcacgtctcgaacctgggctgcggtggacgggagcgtagcggtcgatgacgatcgggcgctgatcgagtggcggcgagtcttcggcaggggcggtgtctaggagtggtgctctacgtagcgagcgatacgcaggtgggtcgcctggcgccgacgaccatcggccagcgacctcggtgagtatccagggaccggttgtcggtcggcgatcgcggcgaggcgagttcccgtgtccatcgcgtgctgccaagcccgagcctgaccgagtgcggtgtaggcgagcgcgacgccagcggcgagagcaacgacgacgagaccggtccgtaggagcgacccgctgcggcgggccagcgcgccgcggaggtcgtggcccgagctgtgcaacgagcgcttggagtaggcaaaggtatggatgaagaggagcaccagccagatcccggcgagcaggaagtgcgcaggcgcgaggaaggtgtcggagaacgacgtcggcccggcgaacgtgagctcggcacctgagaggacgacgagcacggtgaccacgacgagcaggggagcgagcaaccggagcgggagccacggtgcactgcgtacgtgcgccggcgagctcgagcggtagaaggaggcgaagcgccacgtcgcgagcccgagcttcagtacgagcatcgggatcaggacgaccccgatgacgatgtgccagaagagcgcgatgcgcaggtcgagcgctgtgaggacctcgagcgcgctcaggacgagcaatgcaacgccgccgagcgcaactcccctcgcgaccgcgatcgctcggggcgactcgcgcgctcgttcctcgtcgagacggtcgaacgacgcgtgatcgaagaggtgttcgaagagcgagttctcctcgctgtagagcacacgacctcccaggcacgaacgtcccagcggcgcgatcgagcgacagagacgtccttggttcaagtatacggtctgggcaggtgtcgcgtcgggatcaaccctcggcgggcggtcgcaggtcgatcgtgaaggtcaagatgccgtcctcaagcttggccgtggcgtcggcaagtagcgagaagtcgaagtagtcgagttcggcctgctcgcggaagcgacggcgctccgggccctcgacgggtgggagcggccgctgtcgtacggcttcggcgcgttggcgaaagcgttcgacgatcgcggtcggatcgaagctcgcggcctcgtcgctcggcatgagacctcctcgtggtcggtgtcgacacggctctggaccacggcagcgaacctgcgggcatgccgggccgtggtggcgcgttagaccagtctacgaggggcgctgcgaatcggaaggcagcggccctcgtggcctgcagagtagactggcgtgggcgcctgccgaggcagggccactgcacggctcgcgggcgagcacggtgccagcggccgaagggccgcgcgaggagagagcgggagtggctcgtgaagaaggggcgtcatcgccggtacgaggaggcccgcaaggccaagcgtgggcttgcggcgccgctggttcgttgtgacgagtgcggaggcgatgcggttcacggccacgcatcgtggtgccgggcctatctcctcgaggaggagctgttcgctggccacgtcgatgacgacggtgagccagagccgtcggcgtggatcgagggggagcgcggggccgagtgagcgagccgcacgcggttccacccgagtcgtcggagatcgtctattcactgatcgaagacatcgacggcattgagatcgcggcgcgctatcggcgcggcgacgatcccctccttgtgtatctccacggatggggtcggtcgttggcggacttcgcgccgtacctcggccgaggtccatggtcggccgtggcactcgacctgcctgggttcggtcgttcgacgccaccgcttcgaccgatgggcgcgcggggctacgcggagttgctccgagagccgctcgccagcttgcggcgacgcctgcaggcctcacgcatgatcctcgtgggccactcgttcggcggacggatcgcggccgagttcgccggactcgcgaccgacgcggacgccctggcaggcgtggtgatcgtggcgagtccactgctgcgccctcagggtggtcggcctgcgctcggctatcgcgtggtgcgatcgctgcacgctgcccatctcgtgcccgccacggcgctcgagtgggcacgcgggcgttggggatcgaccgactaccgccaggcgaccggggtcatgcgcgacgtgctcgttcggacggtgaacgagcaacaccttggtgcgctcgagcgtgctcgggttcccgtcgagttggtgtggggtgcgctcgatacggcgtgtccggttccgctcgccgagcgcgtcgcggcgcgcgtcgcgggagcgaacctcgacatccgagcgggcgtgggtcacgacgtcccgcgcgacgctccggaggccgtgtggggcgcgatccatcgactcctcgggcggatcgagcctcccgtcggctgcgaggagcagctcagtgagtagcgtcgccggcactctcggaatcgtcatcgggctcgcctcctgggtgggggcgctccggtggctccgcgtcgcccaacgcgagcactacatcccgggtcgcatctggctcttcgtgcgactgtggttgcgtgagtccccggcgtccatcgtcattgcggtggtcgggttctttggggcggtgtctgcgtggagctcggcactgccgcggatccctcacctcatcgcaggagcggtcgcggcggccgcgagcatcgcggcgccgatcggcctcggtcttcgcgggcgcacgagcccgttggccctcacctggcgcctgcgtcgactggcgctcgtcgtcgtgatggtcgatctcgtcgtggtcggcgtcggtatcgcggttggcgagccgctcggtgcggccgtgagcgccggctggctctcgccgctcctcgtggatctcgcactgcgcatcaccgcgccgctcgagcgcaggctgatgggccgcttcgtcgacgaggcgacgtctcggctcaggcgtgttcgcccgcgcgtcgtcggtatcaccggatcgttcggcaagaccacgacgaagggctacgttgcggccctcgtcgaggggacgtatcgcacgctcgcgacgcccgcgtcgttcaacaaccgcgggggtctcgctcgcgccatcaatgagcatctcacatccgacgtcgaggtcttcgttgccgagatgggcatgttcggacccggcgagatcgccgagctcgtctcgtgggtcaggccggagatcagtgtcatcaccgccatcggcccggtccacctcgaacggctcggatccgaggcggccatcgtgcgagcgaagctcgaaatcgtcgagacggctcgggtggtggtgctcaacgtggactatccgcgcttggcgctggctgcgaacgcgctggagcaggagggcgcgaggcgggtcgttcgggtgtcggcgatctcgctcgaggcggacgtcgcggtcaagcccaacgacgagggcgaggtcgtcgtctacgcgcacggcgcgaagatcgccaaggcggcgctcgccgacgtcgtggccggcaacctcgcctgcgcggtcgccgtcgcgctcgagctgggggtggcgccggaggacatcgccgagcggctcggacgcatcaagccagcgcccaaccggctcgtcgccggcgtctcgccgacctcgggcgtcgaggtcctcgacgacacctacaacgcgaacccgatgggtgcgcgccgggcactcgatgcgctcggcgcgcgccgtgacggtggagggcggcgcgtggtagtgacgccgggcatgatcgagctcgggcgccgtcagtacctggagaacttcaagttcgccaaggccgcggctcaggttgcttcgcacatcatcgtcgtcggacgcaccaatcgacgagccctcgaggccggtgccgacgaggggcgggacgaacccggctcgacgctccaggagctacgatgggctcccgatcgggagcatgcggtcgcgctggtccgcgagatgctggagccgggcgacgtcgtcctgtacgagaacgaccttcccgaccactacccgtagagcgagcgcgggagcgctcacggctgacgagcagaaggaggcaacgtggccacgacgcgcgtcggcgtctgcttcggcggcccaagtcccgagcatgacatctccatcctcaccgggctgcaggcgctccgcgcgctggccgagagcggtgggtcaccggtcgcgatctactggtcgaaggaggggtcgttctaccgcgtcgagccctccctcgaggccgaggcctacgcgggcggggtcccggcgggggcgagaccgctcgagctcgtcgtcgggcgcgacggcggcttcgtcgagccgaggggcggcctgcgaccaaagcgcgagctgctcgagctcgacgtggtggtgaactgctgtcacggcggtccgggcgaggacggggcgctccagggggcgctcgatcttgcgggcgtgcgctacaccggccccagtgctcggaccgccgcactcgggatggacaaactcgcgttcgcgagcctgttgcgccaccacggcatcgcgtgcttgccgcgcgaggacgggcgccgcgtgaccttcgacggaccctacatcgccaagccgcgcttcggcggctcgtcgatcggtatcgaggtcctcgaggatcgggcccagctcgaggcacgcatgcagcgctcggagcatttccgcgacggcatggtcgtcgagccctatcgccccgacctcatggatgtacaggtagccctccggcgtttcccgaccccgaccctgtcggcgatcgagcgtccactgcgcagcgccccgggcgagcccatcctcacctatcgagagaagtaccagcccatcgggggcatggcgacggccccacgggagttgccggctgcgatcgctcccgagctcgccgagaccattcgctcccttgccctcagcgtgggcgaactcctcgattcgcggggagtcatgcgggtggattttctcgccagcaccgagggcgagtgctacgtcaacgaggtcaacaccatcccagggagcctgtcgcactacctgttcgtcgagccgaagatcccctttgcggcccagctcgaggccgacatccgcgaggcactcgagcgagcgacctatcggccgaacgtggccggggccgacggctcggtcctgcgctcggcggggtccatcgcggccaagctcgcctgaggaacacgacccctcgtcacgagtagggtgggccgctgtggcgaggggtcatccgacgaccggtctgcgggatcaacgcccgagcgtgcagcggcgcgtcgcggcgttgctcgtgtcgaacgagcgcctcgagcacgtcttccatccccactggtggcgactcatcgaggcgagcggcggtgggctcgtcgggctcgtcgtcgcggcgctcgtggctggcgtcggattcggaccatcgttgctcatcgcggccccggtcgcggtgggctcggtcctgtggatcgtgatcggggtagtgcgctggcggtccgaactcctgttgctcacggatcgccgggtcgtgttcacccgaggagtcttcgcccgccgcacgagcgagatcccactgaagcacgtgaacgacgtctccaccgagcaggggctcatcgggaggttgctcgacttcggcagggttcgtatcgtctcgggcaacgccaacggacaagaggtcgtgacctacctccacgggccggcgcgccttcgccaggagatttcgcgactgactcaagcgagcgagtcgacgccgactccaacggcgacatcgaccggggggagcctcgtcgagcagatccagatgctcgcgttcttgcatcgcatgggcgagatcagcgacgacgagttccagcgcgccaaggagcaggtgctctggggcgacggcgcgcgagagtccgaaggggacgtcgaaggaggaccgtgaccatactcgacccgatcgaggcgcgatggcgccgcaaccttgctgcgtgggccatcccacccgagatcgcgcgccacggcgacgcgtcgccgtggcggctcgatccggcgatgttcctgcccgatcccgacgcaccgctctcgccgtcgcatcgggcgacgcgtgcgttgctcgagcgcgccgatgaggggagcctgctcgacgtgggctccggggcgggagccgccttctggccggtcgtcgagtccgcgcggcgggtgatcgccctcgacgagcacgctggcatgatcgaggccctgctcgccgaggcgaggcgccacccgaccgtcctcgtcgagacccgggtgggacggctcgaggagctgttgccgaccatggagtccgtcgacgtcgtcacgtcacaccacgtcgcctacaacgtcgccgacctcggcctctaccttggcgagttggtgcggatcgctcacgtcgggatggtcctcgaactcaccttgcaccatccccactacggctcggccgccatgttcgaggcgctctggggcgttgcgcgcccgagcgagccgagcgcagccgacgtcatcgaggccttgtgggcgctgggcctcgagcctacggtcgaggtccactcgggcacacgacgccgagacgaccccgcggcgcgtcgtgaggcgctccggcgacgcctctgcctcggcgagcaggaggtcgcgcgcctcgacgagctgcttcgcgatccgggcgagctcgccaatccgtcggtgacgatcgtggtggacctcgatgagcgcaccgcttgagctctggtgggagcgcacggggcacggcgaacggggcgacgccgtcttgctccacggcctggccggttcgagcgacgacttcccggccgagctcgatgcaaggctcgggcgtctcgggttcgggacggtgcgcatcgatcttcgtgacagcggccggtctcctcggctcgacgccgacggtctgccgcgtgtgttcgagctgctcgccggtgatcgcgacgccgcgccgtaccggctcgtcgacatggcccgcgacgtggtgcaggtgctcgagcgagcgagcgtgtcacgcgcgttgctcgtcggcgtctccttgggtggcatggtggctcagcacgtcacggtgatcgcgccggagcgcgccgcgggtctgtgtctcgtctcgagcgcgagccagcccgacctcgcgagcctcgtcgatcccacggttctcgcacccctccttcgcgcgggtctcgcggccctcgatgccggtgacggcgactcgaggggcggtgccggcgctcttcgacagctcggcgcggtcgtcgccagcgacccgtggcgtgaggcgatcgcgcagtgcgcgccggcgacgctgatcgtccacggtgccgccgatccgctcatcggggttcgtgctgcctttgacacgtgggccgagctcgagcgggcacggctcgtcgtgatcgccgagcgcggacacgaatggacgacgtcggcgtgggaccttgtgtggccgcacctggctcgcttcggtcggagcgttcgatgagtgggccgctcgctggcgttcgggtcctcgagctcggggggatcggcccggtcccctttgccggcatggtgctcggcgacctcggcgcgacggtggtacggatcgagccaccgagcggggccggactcggtgccgatgcgttggcacgaggcaagcacgtcattcgcatcgatgccaaggaccccgagggcagggcgctcatccgtgagctcgcgagccgtgcggacgtcttcgtggaggggtttcggccaggggtggtcgagcggctcggcatcggtcctggcgagttgtgcgctgcgaacgaccgcttgatctacgttcgcacgacggggttcggccagagcgggccgctcgcggagcgggcggggcacgacatcacctacctcgccatcgggggcgccctcggagcgacgggatcggcggatgcgccgccgctgcctccgctcaatctgctggccgacttcgggagcgggggcatgctgagcgtcgtcggggcgctcgccggcctcatcgagcgcgagcgcagcggtcgggggcgtgtggtggatgcggcgatggtcgacggggtcctcctcaccgagaccatggtgctcgccatgatgagagagggtgcctggcggcccatgcgggaggcgaacctgctcgacggcggggcaccgttctaccggacctaccgctgcgccgatgggcgctggatcgccgtcggcgcgctcgagccgcagttctttcacaccctgctccgcgagctcggcctcatcgagcgcttcgacccggccgcccagtacgagcgcgctcgctggggcgagctcgcgtcgctgctcgcggatgcctttggctctgcaccacgagccgtgtgggaggagcgcttcgccggtctcgatgcctgcgtcgccccggtgctcggcctcgacgagctcgcgagtgctccccagcacgtcgagcgacgctcgttcgtcgaggtcgacggccatctcgagccggcgccggctccccgattcgatggcgaagcggtcgagagtcgtccggggccctcgcgcgacgcggtcgccgcgctcgtcgcagcagggctcgagccggagcgggcgcgcgctgtcgtggggctcggcctcgtggtgtgagatgttctacctcggctatcgcgacgagcggccggtgttcgcggccccgaccagccacgtgctcgtgctcggcccgcctcgctccggcaagaccacgcggttggtcgtgccgaacgcccgtgccttccctggtgaggtggtcgtcacctcgaccaaggccgacgtcatcgaaccactcgtcgtctcgggccggaccgtgttgctctgggaccccgagggcgacgccgtcgaggcggccggcttgcggcgcgtcgcgtggagcctcgtggacgcggccaagcgctacgaagacgcggtactcggtgtcgacgcctacgtcgaggcggcactcggtcgcgcgagcggtgccgagcgccattggcacgaccgcgcccgtgcgctgctcgcacccctcgtgcgggcagcggcgaccctgggtgggaccatcgacgacgtggtcgcctgggtggaggcgcgcgacgtctccgaggcgctcggcgaactcgacctccagggggagcgtcgggcgctgagcggacttgcgagcgtgctcgcctcggaggagcgcgagcgctcggccatcttctcgacggcccacgccgcactcgctgcgtaccgactcggagaggcgcccgcgcccgagcgtttcgaccccgaacgcttcgtcgggtccggtgccgccctcgtgctggtcgccccgagtgcgagtcagcggatcctcgccccgatcgtcgtcgcgctcctcgagcagctacgacgggtgtactacgcgcgcgctcgtcgcggggaaccagggcgactcgggctcgtgctcgacgagctcgccaacgtggcacccatcccgtcgctcggctccatcctgtccgaaggggtctcgcaggggatctggctgctcgctgcggtgcaagatctcgcgcaggttcgcgagcgctggccggccctcgagcgcggactgctcacgctgttcggtaccgtggcggtgctcggcggtgtcggcgacgcggggaccctcgcggtgctgagcacgctcctcggcagcgaggacgtgctcgaggtcgcggtccacgagggcgccaggggtcgctcgaggacggttcggcgaacgcggcaagcgagactcgaaccggccgcgctccgcagcttgccccgtgggtcggcgctgatcgtggagttggcgggatcgagcgggatggtcgcgttgcgaggtgacccgccgctctgaggggctactcggccgggggcggatcgaggacctccgggaagtcgcgctaccatgccttcgtgccgttcttgctgcggatcctcggtcgggtccgcgcgtctcaggcgcggctgctcgccacgctggccgtcgcgagcgtgctcgctggggcggtagcgttctcgctcgccgagcacgtctcgctggggatcggcctctactgggcgatcacgacggcgacgacggtgggctatggggacgtcacgccccacaacaccgcggggcgcatcatcgccgtcgcggtgatgctcacggcgatcccgctcgcgggcggcgtgttcgccgtcgtcgcggcccagatcaccgcgagtcgcctgggtaggctgctcaccgtgaccattgcggagtcggatacgggattcgtcgcgctcgtcggttcgcaccgagccctcggccgtatcgccgaagagctggttcgagcgggcgagcgggttcgcatcgtcgcctcccagccgatcgcgggtctcgggatccgcgccgagcagatccaggccgatccgaccgacgagggatcgctccggcgtgtccacctcgagcgagcatcgcgcatcatcgtcgcaggcagcgacgacgccgagtcgctgctcgtcgcggtcctcgtccgcgagctcgcgccgacggtgccggtgctcgtcgcggcggcatcggccaaggtccgcgaggcgctcggtgggctcggcgtccaagcgagcatcgcggtcgatgagctgctcgcccacacgctggccaaaggggccgagacgccgcacgccgggaacctgctgctcgagctcgtggcgagcgagcgcgtgcggctcgtcgaactcccggtgaccgatgcgctggtggggatgaccctcgacgacgcgggcgatcgactgggggggctcgtcatcggtcgcgtacgcggcgatcgggtcgagctcgccgtcgggatcggctccgagtcgcttgccgctggcgatcgcgtcgtggtggtgagcgagcgtcagccctccgctccgagcgaacctggcgcgtagaagcgctgccagttcgccgtcgagggcgcgacgagaccggtggggccttcaccgaagaggcgcaagatgttgcgcgtcatggtggtgaggatcggagcgggacagccgctcgtgtccgccccacacggagcgagcgctgggatccagttgttcgtgccgctctcgaagacccccgccttcgaggtggggctcgtcacgtaggtcgtgtcggcgtagtaatgcgccccggagaagccgatcacgaccggtgagtgggcgaggatctcgacgcccggtgggttcggccgcgcagggatgtagccgtcgaagtcggtgaagagcacgttgggcaccgtggcaccgttcgtgaggccggtgcccgcatacagccacgacgatgcgtccgtcacgacgagcgggaaatgctgggtgttgttgaaaccgatgtaggagtccccgacgatctcggaggccggtgcgtccgccggggcttgtccccaccagttctgggtgacacgggcgttgtcgacgccatagagcgggtcctcctgcgggtcgcgatagttgacgacctcgaggttgggtccgagcgggctcgcggcgaggcggaccttgcggaggatggggctcgccccgaagaacaccaggttgacccctcgtccctcggcctggagcaccgcctcgcgcatgcgcagcgaccactcctcgtcgtggccgagcgagaggagaacgcgatggttggtgagcagggctccgtgggtggccagggtgatgtcggtccagtaggtcacgtcgaggccgtggcgctccatgagctcgatgagggggagttcgttggtgatgaaggtcgccgcgccgttgccgtagccgtagggccggtcgaacgagactacgcgtgagcgatcaggaggggggtagcccggcgcggtcgacgcgccctgctggtagaggtcgtagccaccgaaggggttgaagacctgccaggtgaagaccgcgttcatgaccacgtaggcggccttcgacgatggatcccagaccgtgagggggacgtagctcgcagctccgttggaggcgaccagcttgaggaggtagtcgccctgcacgaaggcgggggtgatcgcgaactgggtcgctcgttgccaggagcactgcaccatgtagaggggcgcactcacgggacaggcgggctcgacgtggccggcgaggaccccagagtgccacaccaggcgagcgccggtcccgtggtaccagcccatccggaacgcctcgacggtgaacgtgggcgcgttcgtcgacacgtacaggtcgaccatttggccgagacgggcttggggacggttggagtagccctcgatgaaggtgttggcgggttggaggccgatccgccacgccgtggtaccgggcttgtcgttctcctggatcacccagcgagcctcgacgccccaggggccgaggaaggtggccggctgcgcatgtcgtcggcgatgtggcgtggtcggcgtggtgtggggggccgtccgtggatgggcaacgagcgcgatcgcgccaccgacgagcgccgcgatgaccacgacgatcgtcgcgatgacgaacggattgcgccctgctgatcgcgggcgtcgatccgagcggctgtgcatcccaggcatgcaacctccccggggctcccctggggggccaaggctagccgagccaacctgtggggccctcggcgcctcaggtggcgggtatggccatgagtcgcttgaggacctcgggcccgagaccggtgacgatgatcgaggggtcgtcctcgacgtcgccgcgctcgagccggtagtgcacgaggaggcgttcgcgcccctcgacgagggcgatgctggtgccgacctcccgatagccgaccttctcgctcacgcgacggctcgcgaggttgtcggcgtgggcggtggtctcggcccgagcggcgccgaggtggcgaaaggcgagcgtgagcaccgcgcggcgcatccaggtgccgatgccgcgtccctgcgcagctgcggtgagccatgagcccgtcgagacggtggcaaggctcggccaccctcgggcgaggacgaggtcctggacgccgatcggcccctcggtcgggtggaaaacgacgaagggcagcgttgcgatcggcgtcgcctcgttcgcaccgacggtccggagccagtggcgaacgacacggctcgccacttcgtcagcgctgccccgggtccacgcggtcgagaagggcatggcgtcaggtgcgtggatgccctcaccggctcgctcggcgaggcgggcgagttcgtccatggtgggggatgcgagtgtgacgacgggggtgcggatcgccacgccgagctccggcgcgaagtgcaccaggggatggttcggatcgatgggcacgtcgccagcctagggtacggctaggttgaggctcgggaggaggcgacatgctcatcggagtcactgccggcctgatcggtgaggcaaagccgcgctacgtcggtctgcacgacggctatctccgtggcctcgcgcgagcaggcgcggccgcggtcgtgtggccgagcacgctcggggtcggcgatccggccgacgtggcggcacgggccaaggagctcgtccagagcgtcgcagggatcgtgctcaccggtggcggcgacgtcgggcccgagcgctatggcgagtctgcgcgcaccgagcggctctacggcgtcgagccggcgcgtgacgagctcgagatcgcgttggtccacgcggcgctcgatgcgggtgtcgcgctgctcgcggtgtgtcggggagtgcagatcctgaacgtggccctcggcggcacgctggtccaggacctcgaggaggcgggctatcgtcgccacagcgtgcccgagcacgagtacgacgtcgcccacgacgtgctcgtcgagccagacagcgtgctcgcgagcctggtcggaacgcactacggcgtcaactcgctccaccaccaagcggtggagcgtccggccgaaggggcccgcgtcgtcgctcgctccgaggacggggtcatcgaggcgctcgagggacgggggttcctcgcggtccagtggcatccggagcgcatgctcgacagcgatgagcgggctcaaggcttgttcgagtggctggtcgctcacgggagccggtcatgagtctgcgagccgtgatcttcgacgtcgacggtacgctcgccgagaccgaacgcgacgggcatcgagtcgcctacaaccaggcgttcgcgcagttcggtctcgacattcactggagcgtcgaggagtacgggcggtggctccaggtcgctggcggcaaggagcgggtcgaggcctacctcgccgagcatcccgacgccgctcccaacggggtcgatctcgatgcgctccacgaggccaagaacgccgcctacgccgcgatcgtcgccgctggcggcatctcgttgcggcctggagtgcgtcgactgctcgacgagctcgcgagcgcgaaggtcgccgtggcggcggcgtcgacgacgacgttccccagcctcgacgcgctgttacgagccgagctcgggccggactggcaggatcgtttcgccgcgctcgccctcggcgacgtggtggtgcgcaagaagcccgatccggggatctaccactgggcgctcggtgcgctcgggtcaagctacgacacggtcgtcgcgatcgaggacaaccgtaacggtttgctcgccgccaagggtgcgggccttgcggtggtggtgacccgatctctctatgcgaaggacgaggatctgcacgaggcggacgtgctcgccagctcgctcggagagccagcgtcccccgcaacgatcgttgtcgacggcgccccgcacgagggtgtcgtggacctcgcactgctggagcgactcgtcgagcgtgggtaggtgcgcagcgcgcgagcagcgcgcgtggctgctcgggtcgtgaggggccggctgcggatcgctggatgcctgggtgtctcacccaggcggtgtgcgtgccgactgcaagggtggcacgggctcgtgggccttgtcatgctggctgttctcgtggtcgggtggatgctccggcctcggcgcgtcgtggtcgacggcctctccatgcgcccggccctcgaacctggcgatcgtctcgtcgtggggcccgggcgcgctcgggtggggaggatcgtcgtcgtcgacttaggcggtggacggcccctcgccgtcaagcgcgttgcggctcgagtacgaggtgccgtgtgggtggtcggggacgatctcgctcactcgaccgattcgcggagcctcggatggatcgcacgaggacgcatccacggcgtggtctggtggcgctacgggccgagcgatcggcggggccgggtcgcgcctgcgccatccagcgactccacagctgggctaccaaccatccccagcacgattacctaaggtgaagatcaccaaccccccacacccatccaacgaggcccgcagctgcgggcctcgttggcgttgcgggccagcgtggatgcccgactcctacgcactccacaggttccgtgcctgccatccccagagcacgggcctaggttgaccattacaacccccccacacccacccgaggaggcccgcagctgcgggcctcctcggcgtctggcgacgatgtctcctggcgacgatgctgcgtgcgggtgtgactgttgtgaccagatcggactcttgacggctcgggcgagtagctgactcgcaggtggcgtccgagcggagagagcccctcgatcaccccgatcgtcgcctctcgaggaggttgtggacgagagcgccggcgagtccggcgccggcgaaggcgcccgcggctccgatgacgagcaggagtggcccggcgccggctccgagcccagcgatggcggcgctgacgcgagctgcgccaaggaccggtccgttggtggcgacgacggcgaggtccacgagccagccgatgagccccgcaagaccggcgagccacccgcccaccacgaggccgagggcagccccgacgacgatcgagagccaccacgcgccgacgaggttgccgagggcacagatgacgatgcccgcagcgaagatgacgatgcccgcagcgaaggggagggggcgacgcgtcatcgcaggcccaccaaggtccaggtcgcgatgggatgggtcaggctcgcggtggtgaagctgaggtagcgaccgttccaccacagcgggatcaggttctcgtaccacgcagacagggggttctcgctctcgccaccagggaggatgccgagcgacgctcgtccgaaggcgacgatcatcctccagctcggtccttgctccgacaagagcccgccgtcggcggcgttgacggtccaggcgtcgccggacgatccgcgtggcccgtaggcgagcgaggccacgcccgtcagcgaggggaactcgcggcggtggatgcgacgccactgccaatggccgacgctcccgaggtggctggtgagccaggtcgcggtctgggcgagggcggccgtggcgatcgcagagggtgaggggtgaggatcgccgggcgtcgcgatcgcggtgggtgtcatggtcccggtgtcgatcgcctggaggtcctcgagcagtggatcgttgagctggttgatgacaaggatgctgcccgtgggttggtcgagccgagcgctgcgccagagcggaccgaacaggtcacggatgtcatagccgagccaggtccaccagacgctcgccgcttgcgacgaggctcccatctggtcgttccaggaggcgaggaggtggagcgccgcggctgcactcgtgccaggcgcggcgtgggcgtggtgcacgatccacggtacgagctgggtggcgaggtagtccgtgaccgaggtttgcaggtgctcgaccgcacgcacaccgagatgcggggtagtcgagagtacatgggcgatctcgtcggctcgaaagccgttcgcgtagaagtcggcactcgtgccgaggtagtaggggtagccaggacccacggggcgctggttcgccgagaagacgaagcctcgtgccgggttgttggactccgggacggcatcgaaggggatggcaccgatgggctgttcggtgccgttgccgttcatcacgagccaggggatggcgcgacggaactggaggtattccccggctgcgatgatgccgatctgcccttgggcatcggcgaaggcgaagttctgcgcgggtgccttccatccgcgaagtgcctgttcgaactcgccgagcgtctgcgccttgatggccttgaggagggccgggaagtccagcgagacctggtcgccgagccagtccaccgcgacgggggtgccgcggagcgagatcactgggccatcgacggtgaccggcaccgtgatggtcaccggctggcctccgtggatggcgatggtgtagtgccggtaggtgtaggggcgccacgtgccgtcgaagcgataggcgccggggtgtgagggggaggtggtcatgcggtagaagtacgtcgcctgtgtctcggcgtcggtgaggctccacgcggtcgtcggggtgcgcccgatcaggacgatgggcaggcctggcgccgcgacccctgcgaagtggtagccaggtgcattggcactcagccagagccagatcgacgggagtgtctggggcaggtgcgggtcgccagcgaggatcggcgcgccggtcgtggtgtgcgtggctgcgatggcccagttgttcgagtcaccggcttggtggcgggcccacgcgggcacgccgctccaggcccgctcgatgctgccaagggccgatgtgagttggtgtgagacggggaccggcgggtcgagcggcgtgatgccgcttgccggatagggcccggtgtcgaaggggctctggggatcggcggcgagcgtggggaacaatgccttcacgcgagcgagcccgaggcgcgcgaccgcacgcgtgaggtcgacgggctgctgggtgtagtcgagctcttcggcgaggaactcttggacgagcatgctgtcgacgggctgccagggcgctggcgtcgtaccgaggaggaggtagggcgtcgacagggcatgatgggcgatctcccagctgcgtgcggcgttcacgccggccgtgaactcgtcgaggatcgcgcgatcggcgggaggcagcgccgcgaggttcgcctcggccgcggctcgcaccccgaggcgtagctggaactcgtccgatgcaaggtaggtgtgtccgagcagcgctgcgagcgtgccgcccgcctctcgtcgcagcaggtccatctcgaacaggcgtgtacgaccctcggcataccccatcgcgtaccagaggctcgcatcgctcgtggcactgaccccgatgaaacccgtcgacgtaaagccgatccgcgcggtgcccgggaccgccatctggaacgaggccgacgtgggcatccctgcccgtgtggcgagggcgagtacccctgtcgagggatcgagcacgctgccgagcgcgggaacgcccgcgaccccaaccgcctcgatgccgacgaccccagcgagcacgaccgctgccgcaacgacgcgtccgatccgcacgtgacctccccccgcgtgcgacagtagcagtcgaacgccaagggggctcgtcagctcacgagctcggtagcaggggtcccgacgccgcgttcgggtgtgcgcattcttgctggagggctcggacgaggtggtcctcgctcacccgtcccacctcgccgagggtcgcagcgagcggctgataaccgctgttcgcgccggccgcgatgttggcgaggggttcggcacgttcgaggagcacctcggcttgcgaggcgagcgcgctgcgcgtcgcacccgaggccgtgttcgcccgttgccagagggcgatggaggagcgcacgagtcggcacgccgctgtcgcgttcgatccggcgctcgcgccgcaggccgcaaggagcgctccaccggcgaccgcgaccgccgctaggcgcagtgccttggtgggtcccacgagcccagcctaccgagacctgctggcggtgctgggccccgggtaggctcggacccatggcgaccctgttcggtccttcatcggcggtgtgggtgctccatggtgatgctgccggcctgatcgggggtttgcgcgcactcgcggtccaagcgctcgagcctcgagcactcgcgggcgtcgatcagttctcgaggttccagaacgatcccgatcgccgactggccgagaccgtcgacttcgtcgacgtcatcacctacggcacgctcgaggaggtcgacgccgccatcgagagggtccgacggctccatgagggggtgcgcggcgtcgaccctgtctcggggatgcccttcgacgcgaacgaccccgagcttctcgccttcgtgcacgattcgctcgtcgcctcggtcagcgtggcgtatcgaaccttgcaccctggcgctccgacgtcactgctggatacctacaccaccgagatgcggcgcttcgccgagcgcatgggcgcggacctcggtctcgtgccagccgacttcgcggggtgcgtccgtctcgtcgagtcgtggccgaccctgaccgtgtcgcccgccttccgccgcgcgttcgaggtcctcgaggcgctgcacgtcgaggggcccgtgcagatggtgtggccagccgtgatgcactgggttcgccactcgctgcccacgtgggtgcgggtcgcgctcgaggtggaggaggatccggtcggtgatgcggtcgcgtgggtcctgctcgagctcgccacgcggatcgggcgggtgatcgtgccgccgtcgcctcggcgtctcgcggcgctcggggtcgcctaggtggacgacgccctcttcgcgacggacttcgacggcacgctcctcgactcgaccggcgagccggtccgacggagcgcggacgccttcgccgcggcccgacgcgggggcctcgccgtcgtcccggtcacggcgcgagggccgcggtcgtcgctcgcgatcgcgcggacgttgcacctcgggcctgtgtgcgtctgttcgaacggcgtgctggggctcgacgtgcgcacgggtgacgtcatctggcgccacggtctcccgccgggcagcgtcgccgagatcatctctgcggtggcgagggagatccccgaggctcggttcgccgtcgagacgcgggagcagttcctcgtggaaccggcgttcttcgagccgcagtggcgacggttcgcggtcgcgacggtcgtcgctcggcggggcctcgccgccgccgaggtcctcaaggtcgtcgtgcgcgcgccccaccggcgtggggacgagctgcagggtcaactgcgtggcgtccttggaggcctgtcgctgatcccgggctccagcgactggctcgacatcatcgcccatggggtgtcgaagggctcaggcatcggtctcggtgccgaggtcctcggcgtcgacctcgagcgggtgggtgctgtcggcgaccatctcaacgacgtcgcgatgttccatacggtgggccgcgcttacgcggtcgccgacggtcatccgcgcgccttggaagcggcggatgagatcgtgtccgcctgtggtgacggtggggccggcgaggcgctcaggcgcttcgttgacaccattgacctgccaatgtctcagcgccttccaaggcgcgaacggtagcgtgacgccgaacaggagggtgttcgggtgctgtcgcgcatgatcgatacgatgctcgccgatcgctcaccggctgaggagtacggcgcatcgcggcgagtgcgggccgtggcgcgcatcatgtcgctgctcggggtcgtcctcttcgtcggcctcgccatcgagggtgtcaccattctcttcatcggtcagctgatctccatccacatcctgatcggcatggtgctcatcccggtgatgggctacaagatcatcgtcgccacgtatcgttttgcgatgtactacctgggtgtgagcgatttcaagcgcgccggacctcccgagccgctgcttcgtgccatcgggccgttcgtggtgctctcgacgatcgtgctgatggggtcgggtgtggtgctcgcgctgctgcctcctcagtcggtcgaggtcgcgacgtggcgagcactacatcaagagtccttcatcgtgtggtttgcgttgatgaccatccacgtgctcgcctatgcgcgacgagccttcgggaccgcgaaggacgacgtaacggagcggcgctatcggtcgctcgtgggtcggcgagggcggctcgtgagcgtcgtcatcgcgctcgcgctcggcgtcgtgcttgccgtcgtgatgatccctgcgatcggcccgtggtcgcactacctcgcatcgttgggcgttcgctgagcggcgcctagcgtggagacgtgccagaagccgctggtggtgtcgaccaactcctgacgctcgcgagggaaaccgccgaggcctgtctcgcaagtgtcgaggcgacctcgaccgactggtcgtccacgggggatcgtcggggacagcatcgcggtgacgtcgttgcggaccaggcagcgctcgaactgctcgatcgcccctggctcaacgtcgtttcggaggagtcgggggtgctcgatcgaggagccgcgctgacggcgatcgtcgatcccatcgatggctcgaccaacgcgtcgcggggtctcttcccgtgggcgagttcggttgcgatcgcggacgacaagggccctctggtgggggtcgtgagcctgtgccgaggcggcgggacctactgggccgtgcgcggggcgggagctcgcagggatcggcggccggtcagctcgagtgccgcatcgagcgtgcgcggcaagctcgtcgcctgcaacgggacgccacgggcgtggctcgggtggggacagttgcgcgcgtttggctcggcagcctctgagctggccttcgtcgcagaaggcagtatcgacgctctggtggacttctcggaagggcttgcgatctgggacatcgcagctggcgtcctcatcgcgcgtgaggccggcgcggctgtcgtgagggcgaacggtaacgaggtggacctcagcccgacggcgccgcgacagcgaatcgtcgctggagcgtcgacttcgctcgcgaccgagcttgtcgccgcccttgctggggtcggcttggagcggcgatgacgctggcatgggtcgatcgggacgacgatctcgccctcgcgctcgacgcgatccgtcgttatcaggccgaacttggcgaggacctgtgcttccaagcacctgacgacacgatcgaagctctgcgtgggcattacggtcctcctggcggtgtggcgctgtggttcgacgggggacgggcggtcggcgtggtgtgcgtgcgcaagctcgacgagcatcgagccgagctgaagcggctgtgggtcgtgcccgagtatcggggtcgcggttggggccgagcgctcgtggaggcggcgctcgagcgcgcgcgggcagctggctttcgcgagatcgtcctcgattcgctcgatcgtttgcagcctgcactcgagctctatcgaagccttggattcgtctcggtcgagccgtacacgaccaatccgcttcccggagccgtcttcctcggccgtacgcttttcgagcgctagggtgaccaagccgagctcgtgcgaagacgttgcggctggctctctcctcgcaaccaggtcaacaggccgagatgttgggcggatccgaccggtgccgcgtggcggacaagggaccgacttcttgggcgaagcgtggagcgctccgcgcgcgaatcgagcgatgcgtcgtcgatcggcgtgagctcaggtcgcttcgtgagcgcagctggctctcggaggacgtcgaggaggaccgtcggagcgaggctgaggtggctgatgaggatgtcatccgcacgcgcgagctctgcttcgaggaccgtcagtgttcgtcgtgcgaggcgtgcgcagggcgccgttcgcgccaccggaactgatgccgtgtctccagctgggcttggcaggagggttcacgtgactggcgccccaatggggagctggcgatggacgctcattgtcggagcgtgtcgcgcactcggtcgaggcgatgcgcggcggtggagactggcggcacgacggacgcacctgccaacgattcctcgagtgcatccggggagcgtggcaccgacggtgtgccaatacgaatccatcatgaactgagcccttccatgtccacgatgttcgtgctcgcgagcggcgagtgcttacgacgaaggttcttcgagtagttgttgtacgtctcggctctgccattcgccgtaggtgatgcccagtccctcaactttccagctggtgcgtccattgtcagcgcggcccgctaccatcgatgatgctgccgaaggggaggaaaacacgcagttacgggtgaaggtacgagtcgtgccgtcggggctcagcgccagtgttccatcgtccacgagcctctggtgcagcggcttgtaggagctatcgtctgcgccttgccaatccttccgcgcggtcgagccagccaggaccgtgaactcgccgtcgatctcctgcgcggtcgcactgatacccgcgcgcttcagggtgtagtgcaacaatggcgatgccgggtagggcgcttcgatcgtcgcctgaccggcatgatcggctgccgccatgaccgaacggctcgcagttgatcggaggaggttgactccgaggaccggcagcacgatcatggcttgggctatgaagtactccatgtccgagacatcggcttcgggtagttggggcggtggcggcgcggtggcattgtccaaagctgctcgatgtgcctgttgagcgagcgtgatcagtcgtgactcgaggtagcgggcgtgagccttcgtgaggtttgtgtccttgctcgtcaggacgatgactcggtcccagaagtccttgccgccttggctctcggggcgagcatgttgggcgagccgcttgctgacgtcgtcgccctcgccgatgtaggcgacggtgcctccgagacgcttgggatcgtcccccagcaagatgtagatgccggttcgccccgtctcgggtcggcgaagaaggttcgccaggtccgagcggggtgcagcgacgacgtgccccgtccagttcatgatctcggcggtgagtaaccctcctggcgtcccgtcggccaagaagatgcgaatcgacttcccggcggtcacgtgagggcctcgtgtgctggttgtcgagtacgtcgtgcaagcagtgtctgggcgaacacgaccggtagcgtagcattcctcgcgctctgtgaggaggtggcgtgatcggctgagatggtgagcaatgacgccgtgtcggtgcgtgcgatacggccgctcgtggttcactgtggcatggccggcgaccggtgcggtgcgtgcggtgggtatcgcgcgtgcgcagcgtcgcagtgcatgaggggcccgacgacgacatcgcggcgtcgcccaggagtcagaagttctccgcgctcagcctcatcagcgctcgacgggaccagcgagcagtagcgtgaggaggtcgggtctcacgttgagggtgggctcggtttctttgtccggccagagcctgtcgagcaaacgaggcaagcccgtagggctgagatccgcgagaaggagctcaggtggacgaatcaatctttgtcattggatcagacggtaggctcacttcaatccagaagaatacctatgaacgtgaggctgaactccagcagcttatcaaggatcatccggaactcatacctgcgatgggtggtagcggagaaggcgaacccatccgctggctactggtgcgacgggaagcggggataccgcgagaggatggcggctcagattggtgggccatcgaccacatcctcgttgatcaattcgcaatcccaaccttcgtcgaggtgaagcgagcaagcgacacgagggttcgtcgtgaggttgtagctcagatgctcgactacgttgccaatgctaccgtttattggcagcccggcaccctcgaggggtggttcaatgctcagcatgacgatcccgagcagcggctcttggatttcttggacggatcggaactcagctccggcaagttctggtcgagagtcgacgacaacctccggtctggtcgagtaaggtgtgtcttcgtcgccgattctgttccagactcactgattcgtctcgtcgagttcttgaacgaacacctgcgacgtaccgaggtgtacgccgtcgagttgcctcagtatgtaagcaccgaccaactccctggagtgagggtcattgtcccaagggtgatcggcgataccgtccgtgcgagtgcgaacaagcgggagggacaatcggttccgaagcggcagtgggatgaggagagtttccttgccgccctccgagagcgtagcgatgcggccagcgtgacactctctcgtgagatcctcgaatgggcacgcgcccatggtgtccgagtgatctacggtaatggcaaggttgatgcttcaatgatgctcgtcgtcggacccaagccgaacgggtatgtctttgcgacggtctggagttatggctcgatcgagatcgatctccagtacatgaggcgttcgccagcgtttcgggaagacgagagtcgacgagaggtgatccgcagactgaatcacattccaggtgtcgcgatcgacgagttccgttactcccggcgtccgaatgttccgctaactgtgttcgctggggatccggcgcgaaacgagctcttcgatatcctctcttggatcgtggagcagctgagatctcctcttctgtagagacgcgccgtcgcgagctgtcaggtagtgaggcgagccacccttgtgtggtggtttgatggcaagtgttctgcagggcgggtcacgtcgggtccgttgcttgcggatcaaggcaagccggctgcctcgataggacggcggatggctcggactttcgctctggcgggcgctgccgtcggagatcccagaacgggccgacataggagcgaacccgtacgcaggtcgacgtggtgagggtccgaggaagaggacagagctctgtggtgggcgctaagggactcgaacccctgacctgctggttgtaagccagctgctctgaccacctgagctaagcgcccgagagacgtcagcgtagcgggcgttcgggttcggaggcggagtgccgggggcggtgtcccacccgagtgagcgccgtggcgatcacgctcgcgacgacgagggcgacgccgatgcccatcgatagcgaagccactgcgagtccgagcgccaccgagaccaccgccgcaaccaccggctccaaggtcccgatgatgttcgcctggagcgcgacgacgcggtcgagcgcggtgagatacagggcgaagggcagtgcggtcccagcgatcgcgacgaatgcgacctctgcccagccggtcccatcgagcgagcgaggccacgccatgatcaggaccggggccatggggatcgcgccgagcacgaacgcccgtgtcacgacgcgcggggccggctcggctctatacaggggcgctggcgcgaggttgtagagcgcggtgaccactgcggaagcaagcccccatgcgatggcggtgagaccgacgtgctcacccgggctgatgccgacgaccaagccgaccccgccgacggcggcgatcacgatcacgacctcgatcaggctgggtcgttgccaggcgcggagggttccccagagcaggatcaacacggggctcgtgaactgcagcagcgtcgcggtcacggccgagccggtcgcgaccgcgaggaagtaggtcgcttggacgccgagcaggccgaccagcgcgaacacgaggagccgacctcggagcgctcgggggccgaggctgaagctgtgccggatcgggtcgtgacggagggcctgccaggcgaccagcaacgctgccgagacgatgatcctgctcgcgaccagccacagcgcggtgacgtcggtcgtgtcgaacaggcgctgcgcgacgacaccggagatcccccacagcgtcgcggcagcgaccacgctggccagcgctcgacggtcttcggtcgtcacgaccccaaggctaggtcgtgggtatggacgcttgcctcgcgtgccgtacgatagggcgagccggacgaggaggaaggatgccccaaccgagcgcgtcgttctcggtgacggtgcgagtcgagctcgacgatcctcgagggatcgccgaggtgacccgcgttctcaccgagcgtggtgcggtgatcactgcgctcgacacgatcgagtcgcgcgcgggccacctcgtggtcgacgtgacctgcaacgcggtcgacgaggtccatgccgacgaactccacaaggcgctcgatgccctcgagggtacgagggtgcgcgcgatgagcgatcgcaccctcctgctccacctcggtggcgtcctccaagtggcctcgaaagtcccgcttcgcacgcgtgacgacctgtcgatggcctacaccccgggcgtggctcgagtctcggaggcgattcgcaacgatcctgctgccgcgcgcaacctcaccattcggcgtaacgccgtcgcggtcgtcacggacggatcggcggtcctcgggctcggcaacattggtccggcggctgcgttgccggtgatggaaggcaaggcgatcctgttcaagcgcttcgccgacgtcgacgcttggccgctctgtctcgcgacacaggatccggacgagatcgtgcgggccgtcgagatcatcgccccggtcttcggcggcatcaacctcgaggacatcgccgctccgcgatgcttcgagatcgagcgccggcttcgcgagcggctcgatatcccagtgttccacgacgaccagcacggtacggcgatcgtggtgctcgcggcactgctgaacgcgttgcgcgtcgtgggcaagcggctcgaggacgtgcggatcgtcatcgtcggactcggtgcggcgggggtggcgatcgcccgactgctgctggccgagggcgtgcgcgatctcatcgccgtcgacgtcgacggcatcgtgactccagacgatcccggcctcgatccggctcgacgtgagatcgccgaggcctcgaatcctcgcaacatccgtggtgacctccctgaggcgatggagggtgccgacgccgtgatcggagtctcacgacgcggcgtgctgaaggcggagcacctcgagcgcatggcgccgcgttcggtcgtgttcgccctcgccaaccctgaaccagaggtggatccagagatcgcgcgccgcttcgccgaggtcgtcgcgaccggtcggagcgacgagccgaaccagatcaacaatgtgctcgtgttccctggcttcttccgcggcctcctcgacgcgaacgcgcgcgagatcacgctcgccatggagcgagccgccgcgcacgcgctggcggccatcgtggcgcccgacgagctctcaccggcctacatcgtcccaacggtgttcaacccgagggtggcccccgccatcgcgaaggcggtggccggggcgatcacggacagctaaagcgttcgacgcccttcgatgccgcgaaggcgagccgtggcgtgccgttcgtgagtcgaaagcccagcgacaccatctcgctgggcggattgtcggaggcctggaggttcggatcagtgaggccgacgaccgtgaagccctggttcggggacgtaaaggtcgggttggagctctcgcatccgaccgtcgcgatgaccgggcctgcgatggtgtacggcgtactcgtggtcgtcccgggcggactcgggatcgcctcggcgtggcggaggccgctcagcaccgtctcgaagtagaagatggtgttcggcggatccttgacgagcggtgatggcggcaccgaggcgaggatcgcgacgagctggggcccggccgtacctggtttgaaggcgtacacgccgttcgggacgttgccgaccatgttggcacacgacgccgaaacgatggcgagtggtgtcgtgccggtcacgtagccgacgaccgttccctgctgcgtgggcgggccgctcaatgggtggcagtgcggggccaaccccgggtaggtgagcttcgaccacgctacgtctgcgaacgcagcctcggccgctcggtcggacggtgtgaggacgaccggggcctcgcgaggggcgcgaggggtgggacgtgcgctgatgccgacgctcgactggccacaggccgcgagcgccacactcgtgcctaggaggctgatcaccgctcggctcctgcgtcgattcatggtgcatgtcagcgtagtcaacgggtgctgagcgagcgcgaggctcccgggtgcgcgacccgaccatgggcctggctcggctaccgggcgaattggaggggagtgcctgcgacaggtgccgatcggcggtagcctgggcccagatggttgtgcctgcaccagagacacgagcgagaggctggagtccgagcgagccgcggtggcggatcgacgagttcctcgccgagaacgtgcagcttcgacccgcgacgaggcgacgctaccgcgtcgtcctttccaacatccaggctcgagcggcgtcgctcggggcggcatcgccggctcagctggacgctcacgtgttgcggcggctccttgccgctcctgggtcgaacgggccgtacgcgccggcgactcgcgatctcgagcgggtcgtgctgcggcgctacctcgtttgggagggaagtgaaggggcactcgctctcgcggcgcagctcgctgcgtttgccaggcggcgcccacggcccttgccgcgcggcatcgacgagacgacgctcggatcgaccctcgacggtctcgatgctcgggcggatgcgcgtgcgatggcgatcctcgagctggcctatgcgacggggttgcgggcgagcgaactgtgtgcgctcgatcggagcgacctcggtccgggcgaccggtggctggtcgtgcgggccggcaagggaggtcggacccgccgggttccgatcggcgaggctgcccggacggcgctccgggcctacctcgccacgcgcgacgacgatgccccggcactgttgctcggagcccgcggggctcgactctcgccgcgggggctacagcggttgacccggcgctatctcgatgtccacccgcaccagctgcgccatgccttcgccacgcacctgctcgatcacggcgccgatgtgcgatcgatccaggagctgctggggcatgcgcgactggcgactacggagatctacacccacgtgtcgcgcgagacgctgacgcgcgtctacgatgcgacgcaccctcgagcagggcgaggagaggcatgagcgacgacgaggtgatcgagtcggcgtggcgccgcttcaagcacgacggtgacctcgaggcgcgcaatcgcctgctcgagcactacgcgtccctcgttcgcttcgtcgcctcgcgcgtcgcggtcgggttaccggcgagcgtcgaccccaacgacctcgccagctacggcaccttcgggctgatcgacgcgctcgagaagttcgagccggagcggggcatcaagttcgagacctatgccatcacacggatcaagggcgccatcatcgacgagcttcgcgcgatcgactgggtgccgcggtcggtgcgggccaaggcgaagtcggtcgagcaggcctacgccgcgctcgaggcacggctgcatcggccccccaccgatgccgaggtcgccagcgagctcggcatgagcgaggacgaactgctggcgatctactccaagatctcgttcctcggactcgtcggtctcgacgaggtggtgatgtcgggcgagcgcggtgagggtatgacgctcggggacacgcttgccgatcgtcgtcaatcggccggtggcgcattcgaggagcaggagcgccgtcgcatgctcgccgattccatcaatcagctggccgatcgcgagaagaccgtcctcgtgctctactactacgaaggtttcaccctggcggagatcggccggatcctcggcgtgaccgagagtcggatctgtcagatccactccaaggccgttctggctctgcgaggcaagctcggcgacctgatcggctagggagccttgccgaggcgcctaagctgtggggccgcacgttcgtcgtcgatactcgggcactcgaacccacggtcggccacctgagccgcatggagtgcccgctgatccaaccgttgggaggttgaaccgtggctgagcgcccgttggtaacgatgtcgcagctgctcgaggccggtgtccacttcggtcaccaaactcgtcgctggaacccgaagatgcgtgagcacatctacgagcggcgtgggggcatccacctcatcgacctacgtcacaccctggagggcatcgatcgctcgttccgcttcgttcgcgatctcagtgctcgtggcggcaccatcttgttcgtcggtacgaagaagcaagcccaagacgccgtgagtcagtacgcgcgccttgctggggttccctacgtgagccaccgctggctcggcgggatgctgacgaacttcggcacgatctcgcggcgcgtcgcgaagatggcagagtacgagcgcatgcgtgaccagggcgacttcgaggcgatgccgaagaaggaggcgcttctcttgtcgcgcgagctcgccaagctggagctcaaccttggaggcattcgcaacctgacgcgcttgcccgatgcgatcttcgtgatcgatacgcccaaggagcacatcgcggtcaccgaggcgaatcggctcggaatcccggtggtggccgtggtggacaccaacgccgaccccgacctcgtgacctacccgatgcccgggaacgacgacgcgatccgcgcgtgcgagctgttcacccgcttgatggcgaccgccgtcatcgaaggccggcagcgtcagcaggccaagccggctgcctagagaccgcggccacgaacgaaggaggagaccaggtggtcagtgcgagcgatgtgcaggccctgcgccgtgcgacgggcgcaggcatgctcgatgccaagaaggcgctcgaggaggccgatggcgacgtcgagcgagcgacgcgcctgttgcgagaacgaggcctcgcctcggctgccaagcgcgtcgatcgagacaacgccgagggagcggttgcgctgtcgctgctcgaggaccgggcgggtgcgatcgtcgagcttcgctgcgagacggatttcgtcgccaaggcgcaggatttcgtcaacaccgccaacgagctggcggcgaccgtcgcgaccgatggggagcaggccgttgccaagttcgagagcatcatcgaagacttgcgcctgagcctcaaggagaacattgcgctcggtcgggtggtgcacttcgcggccggtgacggcgacgtcgtctcgggttatctccacgtccaggcagaccgcggcgtgaacgccgtgctcgttcagctgcacggcggcacggccgagctcgcccacgacatcgcactgcacatcgccttcgcccggccgcggtacctgtcgcgcgccgacgtcccagccgaggaggtcgagcgcgagcgtgagaccttcgaggtgcaggcgcgcaacagtggcaagcccgaggctgcgctcgccaagatcgtcgagggtcgcctcgacggcttcttcaaggagatctgcctgctcgaccaggccttcgtgaaggacgagaagcgcaagatccacgacgtgctcgcaggtgcgtcagtcgttcggtttgcgcaggtggagatcggtcgctgatcgtgggggcctcctggcgacgggtgctgctgaagatctccggcgagtcgctggccggcgaggatcgagctcaatcgatcgacccggcgatcttgcagcagctcgccgaggaactcgtcgagctgcgcacggtgcacggcgtcgaggtcgccgtcgtcgtcggcggcgggaacttgtggcgcgggaccgacggtacccagatcggcatcgatccgccgacgtcggacaacatgggcatgctcgccacggtgatgaacgcgcttgcgctgcagagcgcgatcgagcggctcggtcagccggtgcggctccagagcgccatcacgatggccgagctcgcagagccctacattcgccgtcgggcggtgcggcacctcgagaaggggcgcatcgtcgtgttcgccgccggcaccggcaatccgttcttcaccactgacaccgcagccgcgctgcgggccgccgagatcggcgcgagcgtcgtgctgaagggcacgcactcgggtgtgagcgggatttattcgtccgatccccgggtcgacccgtcggcggtgcagctggagcgggtcggctacatggaggtcatcgagcgcaacctcgccgtgatggacatgaccgctatcaccttgtgcaaggagcgggccatcaaggtcgtcgtcttcgacgtctcgttgcggggtaacatcacgaaggcctggcgtggccagatcggaacgttggtggagtaatggctgatccagtcgatatcgatgcggagcttgcggccttcgaggatcgcatggccaaggcagtgcgccacaccgaggaggagttcgcgaccgtccgtacgggtcgggcgcaggcggccctgctcgatgggatcgtcgtcgagtactacggcgagcgcgttccgttgcggcagttggcgtcggtgacgacgcccgatccccacagcctgctcatcgcgccctatgaccgcaacgcgatgggcgccatggagcgagccattcgcgattcagacctcggcgtcaacccgacgaacgatggctcggtgatccgtatcgcgatcgcgccgctcacggaggagcgtcgtcgagagctcgtcaaggtggtgcgcaagcgcgccgaggaggggcgggtggcgatccgaggcgtgcgccggcaggccaagcagcacttcgagtcgctccagcgccaaggctcgctcacgacggacgacctcgccgacatcgagcgcagtctcgatcgcctgacggcccgctttgtgggcgagctggatcgagcgctcgaggtcaaggagcacgacctcctcgaggtctaggccggccggtgagcgaacacgacgaccgggccccgcagtcggagcctacgagcgagcctcgaggcctgtcgcccgagcccgaacgacagcgagagcgcggggcccacgcagggcctgagaacggtacgcctcgcgagggcgcgagttcgacggatgcgggcgtgacagaacccctcgcatccgcggtgccacctggccccgttcggtcgtcgggccgtgacgaggggagcgacgacgacaccgtggccctccccgattggcgagagccaccgaccggtgacgttcctcgggtcctcgaagaactctcgggcatcccggtgcgcgatctcggaggacctcgtaccggtgagttgccctcgatcgacgacgaaacagttccgtggtcgccaccgtcctcgacccaaggtgagcgatccaagctcgacgacgacgcgcgtccacgccgagaaccgtccgaggctgcgactccccgagcgcctcgccatcatcggcgcaggcgcgatggcggcgagggcgaggccacgactcaggacgcgggcgtcgagcggcgcacggcggccggctcgcgtcgtcgagggggcgttcgcggcgcgacgcccggcgacgagcgatcccacggcggccccgcccggtccaaggcgctcagcaccctcaccggcattgcgctcgctgcgatcgtggtcgtagccctcgtcctggggcggatcccgttgctcgtcgtcgtcgcgctcgcgctcgagctggctgcttcggaggccttcagcgtgctgcaccgcggcgggctcctcgaggcgcgcttcctcgggctcgccggggtcggggcactcatcggagtcgcttacgcctacggtccggccggtgatggcggcgtcgtcgttgcagctttcgtcctgggcgcagcgtggtatgtcctcggaccactgcggcgtcctgcctacgaggggctctcgcacacgctgggcgtggttgtgtgggtcgggctccttggctcctatgcagcggtcctgctccgaccggcgacgttccacgggcacggcgagctcgtcctcgtcgtcgccatcgcgacgacggtggccgacgacaccgcggctttcttcgtcggatcggtgctcggtcgccatcggctggcgccgcggatctcgcccaacaagacgatcgaagggcttatcggcggtacggtcgcagccatcgtggccggcgcgctgctcgggatgatcgccccgctcagcgtcgtggaaggagcgatactcggactggtcgtcgcggtggtggctccgctcggcgatctgctcgagagtgccttcaagcgccagtttcatgtcaaggactcgggggcgctgctgcctggccacggaggggttctcgatcgcatcgacgcgatgctcgtcgtgctcccagccagctactacctcttcgcggtgatgcatctcaggtagcctgcctaggctgactgtcgtgccgagcgtcgccatcgccggggtcaccggttccgtcggccgccaagccggtgcggtcgtctctcgcgacccggaacgttttcatgtcgagaccatcgtcgctgggagcgatgcgggcgggctcatcgagctcgccaaggagctacgccctcgggtcgtcggtctcgcggtcggtggtgaccgcgagcgagtgcgccagagcctcgatgcgtccgtggaggtggtcgtcggtcgcgaagcgctcgaggcgagcgcagcggccgacatcgtcgtgaacgccgtgagcggcttcgcgggtctcgccgtgactcgagctgcgctgctcgctggacgcaggctcgcgctggcgaacaaggagtcgctggttgcagcgggggaccttgtggccggatggctcgacggtggcgacggcgaactcgtgccggtggactccgagcactctgccatcttccagtgcctcggaggctcgcgcgatggcgcagaccgtgtcgcgtcgctggtgctcacgagctctggcggacccttccgtacgcgatcggcggaggcgctgcgtgacgtgagcctggaggaggcgctcgcccacccgacgtggtcgatggggccgaagatcaccgtggactcgtcgaccctgttcaacaagggcctcgaggtcatcgaggcacactacctcttcgaggttccctacgaccgaatcgaggtggtggtgcatcccgagagtgtcgtgcactcgatggtgcgctttcgggacgggtcggtgatcgcgcagctgtcggagccgaccatggagttgcccgtggcggtggcgctctatcaccccgagcgcgcgccgtacgcgatcggctcgctcgatctcacccgacctcggtcgttcggcttcgagcccgtcgacgacgctcggttccccgcgttgcgcctcgcctatgacgccggtcgactcggaggggccgcaccgtgttggttgaacgcagcgaacgaggtcgcggtggccgcgtttctcggaggtgcgctgcgctggatcgacatctatcgcgtggtcgcctcgacgctggagcggttcgagccgacgacgttcgcatccgaggaggacgtcatcgaggccgatgcgaccgcgcgtgaccacgctcgacgcatcgtggaggaggtaactcgtggctgaggagatggaggcgccaaccctccaggaggctcgaagcttctccggtcgcaggctcgccgagctcgtcgtcgtgctcgtcgccatcatcgcgatcgcccagcacgcccatgcactcggcaccctcgccgtcgtggcggcgatcgtcgcgatggtcgtgctgcacgaacttgggcactacctggtcgcgcggtggtcgcgcatggaggtgaccgagttcttcgtcgggttcgggccgcggatcttctcgtggcaccgcaaggggatcgagtacggcctgaaggcgatcctcgtcggtggctacgtccgcatcaccggcatgacgagcgcggaagaggtcccgcccgagcgtgaggcgcgcacctatcgctcgtcgaccttcccccgacgagtcgcggtcagcgtggcgggctcggtcatgcacttcgtcgtggcatttggcatgctgtggtacctgttcagtggggtcgggacctacgcgagtcggggcgtggtcatcgagggggtcgcacacatcccaggggtggtgaccccggccgagcggatcggactgcgtgctggcgatacgatcctcgccgtcgacgggcatcggaaccctacccttgctgccttcgcgtcgtcgatctctcaccatcccggcacccctgtgcgcctcgttgtcgagacgcccggcggtcgagtcgtctcgcgcacggcggtgccgatccccgcgaccatggtggcgagatacgatgcggcctatcactccctgggttcccaaggcgtgctcggcgtggtggttgcgcctccagtcgaacgatccagtctcgtcggtggggtcgtgccgtcggcgcgcgcgctctggtcgctcgctggtgcgagcgtgagtgggctcgtgtcgcacttcacgccccatgggatcgcgacctacgtgtcggaggtgacgcacccctcggcgaaccccacctcggcaaagtccgcgtctcgcttcgagtcccccgtggggatcgtgcagctcgcgtccgacgcggtcgcggccggaaccggcgccgtgctcgagctcctcgtgctgatcaacgtcttcgtcgggatcttcaacatggtgccgttgctgccgctcgacggcggacacgtcgccatcgcgatctacgaacgcatccgatcgcggcgaggtcgtgcgtaccacgccgatgtcctcaagctgatgccgatcacctacgctgtgatagcggtgatcctctttctgggtgtcaccgcgctgtatctggacatcacgcatccggtgcccaacccgttctcgtagcgaggaggagagcaatggcgcgtcctcagatcgccctcgccccacgacggcccacccgccaggtcatggttgggtcggtacctgtcggcggaggggcgcccatctcggtgcagtcgatgacgaccacccagaccgccgacgtcgagggcaccctgacgcagatctacgccctcgccgctgctggcgcagacatcgttcgggtgacgtgcaacacccgtgacgcagccgatgggctcgcgcgcatcgtgccccgctcgcccgtgccgatcgtcgcggacatccacttccacgtggagatggccctcgcggcactcgatgcaggggtggccgccctcaggctcaaccccggcaacctgcgcaagcgcgaggagatccagctggtggcgcgcgaggcgaaggatcgcgccatcccgatccgcatcggcgtcaacgccggttcgttgcacccggagtttgcggagcgcttcgggggcgcaactccggaggcactcgtggagagcgcgctctacgagctcgcgctcttcgaggaggtcggtttcgacgacgtcgcgttctcggtgaaggcctccaacgtgccgctgatgatcgcggcctatcggctgctcgccgagcgtaccgatcatcccttgcaccttggcgtgaccgaggccgggccgccgccggcggggctcgtgaaggccaccgccggcatcgcgacgctgctcgccgagggcatcggtgacacgattcgctactcgctcaccgctgaccccgtcgaggaggcgcgggcaggacggcagttgctcgaggcactcggcctgcgagaacgcaagaacctcgacctcatcgcgtgtccgagctgcgggcgcgcccaggtggacgtgatcgggatcgccaaggacgcccaggcacggctcgaggagctcggcctgccgatccaggtggccgtcatgggttgcgtggtgaatggtccgggagaagccagggaggcggatctcggtattgcgggcggtcggcacaagggacatctgttcatccgtgggcagatcgtgcgggtggtccccgagcaggagatggttgacgcgctcgtcgaggaagccaagcgactcgttgccgagggcgtcgaggcacggctcgcggccgcagctcccggagcggccgaggaggcagcccgcgatcgcatggccgaactcggtggcgaggagggctcggccaagcgctagccttgggcgccatgcgcgcctccgacctcgtcttcgccacccaacgggaggacccacgcgacgccgaggtcgcctcgcaccgtctgctcgtacgcggtggctacatgcgggcgctggcgagtggggtctggagcctgttgcccctcggctttcgggtcctcgagcgcatcggcgcgatcgtggccgaggagttcgaccgcgcgggcggcaaccagctgctccttccggcgctgcacccggtggagctctggcaggagaccggtcgcaacgtcaccatggacgacgtgctcatgcgggtggattcgaagctcggctccttggtgctcggtccgacgcacgaggaggcggtcatcgccgccgtcgggccggacctcgcgagctaccggagcctgccagccttcgtctaccagatccagaccaagttccgtgacgagccgagagcgcggttcggcttgatgcgcacccgtgagttcgtcatggccgacggctacacgttcgatgtggaccgcgagcacatgcgtgtctcctaccagcgcgtctacgaggcttacctgcgcgtgtatcgccgactgggcttgaaggccgtgccggtcgaggcggacgcgggcgcgatcggcggggacgtgaaccacgagttcatggtgccctcggccatcggggaggatcacttcgcgtcctgtcgtgcgtgcgggtaccaggccaacgtggaggcggctcggcgtggccgggggcccgatcgagtgctgccccccatcgagcagccgagggtgtatgcgacgccgggggctccaggggtgcgcgaggcgatcgcggcactgcgcgccgagggggcacccgtcgacgatgacgggatgctcaagtgcatggtcgcctacgacgacgcgggccggacgacgctcgtgctcgtgcccgggcagcgcagcgtgaggctgccacggggttggcggcttgccggtgaggaagcgttccggcccgaaggtccgttcttcctcggctacgtggggccggtcgggatgcgagaagccggcgtgcggatcgtcgccgacccgatgatccgagagcgtccgtggtgggcgaccggtaacaacgccgagggcgagcacgtcgtcggtgtgcgcgtcggcgtggacttcgaggtcgacgactggatcgaggtggtcgaggtcgtcgacggggatccctgcccgcgctgtggcgctcccctggcgctggttcgcgcggtcgaggtggggcacaccttccaactcgggcagctctattcgtcgcgcatgagccgggggaccttcgtcggcgaggacggggcgacccatccgttctggatgggctgctacggcatcggcgtgagtcgtctcatcgccgtcatcgccgaggagtaccagcgagacggtggcctggcgtggccgctcgagatcgccccgttccaggtcgccgtcgtgcctgccggcagcagtgacgacgtcgcggcgaccgctgcgaacatcgccgaagagctcgaacggatggggcgccgggtgctgctcgaggatcgggggctgagcttcggcgtggcggccagggatcaagaactcgtcggtgcgcccctgtgggtggtcgtcggtgcgcgttcgctggcgcgtggcgaggtcgagcttcgcaaccgcgtcgatgggcggacgctcaccgttcagcttcgcgatgtggcccaggcggtcgacgccgaggccggtcgcatcggcgagcgcgccgactgagcgctatactccctccgggctcgttgcaggggccggggtgacgtgggcttcggcccacgttttttcgtcacctgcgcggctcgctcggcgaggggaggggacatggcggacagccacgcactatggacggcgctcgacgagcgactcgccggtgcggcgctccaggtcgccgacctcgtggtgcggccaggttccgtcgcggtcttcgtcgaacacgacgatgcgagcgcgccgagcctggacgaactcgagcaggtgtcacgggacgtggtcaccgtcgttcgctccgagcttggagacgtggcggtcgaggtgtcgagcccgggcctggaacggcgactgcgcaggatcgagcaggcgcgtgccgtgctcggccgaagcgtcgcgatccgacgcgagggcggtcggctcgggggtgtgctcgtgggggtcgagggcgacgagctgatcgtcgaggtcgacggcgagccgcagcgcatcgcgtggggcgaggtgcgcgaggcccagacgacgtggtcgttggggaccgatggtgcagacgagctggatccggagcgcagcgggaggaacgatggccgttgagaacccagaggtgatggacgcgctcgaggtgatcgctcgggagaagggcctgtcggtcgagacgctcctcgagtcgctcgccaacgcgctcgctgccgcctacaagcggcggcccggcgctgccgaggaggcctacgtcgagatcgatcccgcgagcgggacgatccgggtgatctgccaggagctcgacgagaacggtaccgtcgttcgcgagtgggaggacacgcctcgcgacttcgggcgcatcgcggcccaggctgccaagcaggtcatgctgcagaagatccgcgaggccgaacgcgagcagaagtacgaggagtacgccgggcgcgagggggacgtggtcacggggatcgtgtcccagatcgacccgcggttcacgctgctcgacctcggcaagatcgaggcgatcatgccgcactccgagagcccgtcgaacgagcgctactcggtgaaccagcgtttgaaggcctacatcgtcgaggtgcgacggtccatcaagggtccacagatcgtcgtgtcgagaacgcaccccggcttggtccggcgcctcttcgaggtggaggtgcccgagatcgcgagtggtgtcgtcgaggtcaaggccatcgcgcgcgagcctggtcatcggaccaagatcgcggtgtggtcgaacgatcgctcggtcgatccggtcggagcctgtgtcggtgctcggggatcacgcgtccacaccgtggtgaacgagctcttgggggagaaggtcgacatcgtcccgttctccgaggatctcgcggagttcgtcgagcgggcgatcgtaccagcgcacgccctctctgcgaccgtcgagggtcgcgatgcgctcgtggtcgtgcctgacgatcagctgtcgctcgccatcggccgcgagggccagaacgcgcgccttgccgctcgtctcaccggcacccacctcgagattcggccccagagcgaggtcgagggccgccaggagggtcagccatagcgcccccgcaacggatgtgcgtgggttgtcgggcccggcgttctgcgtcggacctcgtgcgggtgcacgtggtggaggggcgcctcgcggtcggggcggggcctgggcgcggtgcgtggatctgtccgcgggaggcgtgcctcgagcgcgcgctcgcgcatggacggctccgacgagcgctgcgactcgccccgtcggacggcgagctcgtcgacgagggcgtgcgccaggcctggcgagcggcgatcgctgggcacggcgcgtcgagcgcctaggctcgaagtgactcacgtagtgctgtcggcgctcgtgggcagacaggtgcgcgggcgtgggtccgcatcggttcggaggcaagggcaaccagttggcgcgcaagctcagagtgtacgaaatcgcgaaggaactcggtctctccaacaaggaggcgctggatctgtgcctcgcgttgggcgtggacgtgaagaaccactcctcgagcgtcgaggaggcccatgcagaccggatccgacgtcgcgcgcagcgagatcatctcggcatctacgccgaggcaacgaccccccaggtggccccgccgagcgcgccgaccacgccaccgagcgttcgtgagcccgagccggtggcggctcccgagatatcggagccggtcgtggcgagcgcacccgagcggcgccccgacctcgccgcggtgatcgccgaagaggcggccaagcgcgaagaggccgagcaggctgccatcgagaacgcgggtcgagcgccggagcaggcggcgccgcgacgtcagggcccgctctcgccatcggggaatccgatcccaccacccccgggcgggcgaccgctgtcgccgtcgggtaagccgatccctccgccaccacgtccacaaggtccacgcgacggacgcggccgaccggctcgcgaggggtccgggcgccctgtgggcgggtcgcgtccgggtgccgggcgccccggaaccggtggcgggcgccccccgatggggggtgggatccggccgccggcccgcggtggcggcggcgtcagcacgccccgattcgggggcgcagccggtgcgttcgctggccgtcccggtggcggtcggggccgtggcgtgcgtccgaacaagagtcggcggcgcatctcgcgcaaggagttcgaggagctcgagccgacccgagcgacggcctatgtcccgtcgaacgatccggtccctgactacgaggtcatcatcgagcggggctcgacggcccaagaggttgcccccaagctcaaccgctcgccgggcgacctcgtgcgcttcttgctcatgcagggcgagatggtcacggcgacccagagcctcaccgacgagatgatcgagctgtacgcggcggagctgggcgcgaaggtgcgcctcgtcgatcccgggcaagagcaagaagcgcagctcgccgccaagtatctcgatgtcgatgagaccctcgatccgacggccgaggtggtccgccctcccgtcgtcacggtcatggggcacgtcgaccacggcaagacgttgctgctcgatcgcattcgccacacgaacgtcgtggcgggcgaggccggtggcatcacccagcacatcggtgcctaccaggtcgatgtcgaggggggtcgcatcaccttcatcgacacccctggtcacgaggccttcacggcgatgcgtgcgcgtggcgcgagcgtcacggacatcgtcatcttggtcgtcgcggccgacgacggtgtcatgccccagaccgtggaggccatcaaccacgccaaggcggcgggcgtgccgatcatcgtcgcgatcaacaagatcgaccgtcctgacgcggatccgaatcgggtcatgcagcagctctccgagcacggcctcgtgcccgaggcctggggtggcgacaccatcacggtgcaggtgtcggcgctgcagagtctcgggatcgacgagctgctcgagcaggtgctcgtgctggccgaggtcctcgagctgcgtgccaacccgacgggtcgggctcgcggtgtggtgctcgagggacacctcgacgtcggtcgtggtccggtcgcaaccgtgttggtgcagggcggcaccctgcacgtcggtgatcccgtggtcgccggccaggcatggggcaaggccaaggcgctcatcagcgatcggggagagaaggtctccgatgccggcccgtcgacgccggtccaggtcctcgggttctcggaggtgccgagcgcgggtgatccgttccgcgtgacggccgagatctcgcacgccagggagatcggcgaagcgcgcgagcagcggctgcggttggcggcgaacgccaaccgggcggtcggcgcacagggcgtgcggctcgaggacatcttcgaacagatccaacaaggcgaggtccctaccctcaacctcatcgtcaaggccgacgtccagggcagcctcgaggcgctctcggatgcgctcgcgaagctctcgcgcgacgaggtgcgactcgagatcatccacaaggccgtcggtgggatcaccgagaacgacgtcacgctcgcggcggcgtcgcacgcactcatcatcgggttcaacgtccggccggatcgccgagcgcgtgaggccgccgaggtccgtcacgtggagatccgtacctacgagatcatctaccaggtgatcgaggacatcgaggcggccgtggtcggcatgctcaagccggagttcgaggaggtggtcgtcggcgaggccgaggttcgcgaggtcttccggatcccgcgcgtcggtgccgtcgcagggtgctacgtgcgcaacggaaccttgacccgtggtggccgcgtgcgattcctccgagacggggtcgtgctgtggaaggggacgatctcctcgctgcgccgcttcaaggaggacgtgcgcgaggtccaggccgggttcgagtgcggcgttgggctctccgatttccaggacctccatgcaggcgacatcatcgaggcgttcgagctgcgtgaaatcccgcgggggtgagcgtgggcagacgcgcaacccatccgtacgcgcggaccgaacgggtcgccgccgtcctccaagaggtgatcgctgaggcgctggagcgcctcgtcgatcgcgacgagcggctcgccttcgtcacggtgacccacgtcgtcgtgagcagcgatctgcgccacgccgacgtgctgatcgcgtcgggaacggcggagacgctcgaggcgctggacgacgctcgcggagagctccagcgtgcggtggcacgggaggtgcgcctcaagcgcacgcccgccctgcgcttcggccttgacgcgcaacttgccgccgtcgaggagctcgaggcggtgttccgccgcgtccacgaggcagcgacggatgatccagggcatctacctcgtcgataagccgagcggcccgacctcccacgacgtcgtggctcgagctcggcgtgcgttcggcacgcggcgcgtcggtcacgccgggacgctcgatccgatggcgagcggactgctcgtgctcggtgtcgatcgcgcgacccggctgctccgctacctcgaggcccagacgaagcgctatcgggccgtcgcgctcctcggcgttgcgaccgataccgacgatctcgacggtgtcgtcgtcgatcggcgaccggtcgaggagccgacccgcgaggccgtggtgacggcgtgccgtcgcttcgtgccgggttacgaccaggtgccaccggcctacagcgcgctgcacctcgacggcgagcgtgcctacgtgcgggctcgccggggtgaggacgtcacgttgcctcgtcggcgggttcgcatcgacgagatcgaggtgggtgcgatctggcgcgatggcggcccaggggagccccagggcgttcgcgtcgagctcaccgtcacctgtggccccggaacctacctccgctcgctggtacgtgacctcggtgaggcgctcggcacgcccgcgacgctcgcgtcgcttcggcgcgagcgtgtcggtcggctggaggtcgcccaggcggtggggctcgaggacctcgagcgagcgacaccggtcccgcttccgctggcgctcgctggtctcggccgtgtcgaactcgacggggtcgacgccacgaggttcctccatggtcagcgcatcgaggcgccgtcgggtctcgacgagggcgacgtgctcgtcggtgccgagggttcgtggttgggggtggcgagctgtgacggccacgtgctcgcaccgcgcgtggtgctcgtcgatgcgggagttgcgcgggcatgatcgtggttcgagagctcgatgaccctgccttcgtcgtccccagttccgtcgtgaccatcgggaccttcgatggtctgcacctcggacaccagcgactcatccgcgtcgcacgcgacgtcgcgcgtcgagcacgcctgcccttggtcgtggtgagtttcgatcgccaccccctgcgcttgctcgcacccgagcgagtgccgccgctcatcatgacgccactgcagcgcgatcgtgtgctcgcgtctcagggcgtcggcgtgctgtatctgctgcacttcggacccgaacgcgctcagcaggcgcccgcgtccttcgccgccgaggtgctcgcgtccaggctcggtgcgacccacgtcgtcgtcggcgccaacttcaccttcggtgcccgaggggcgggtcgccctgccgacctcgtcgccatgggtcgcgacctcggcttctcggtcgacgtcgaggagttggtcgacgacgacggcgaggtggtgtcctcgagtcggatccgtgcgacggtcgcctcgggggacctcgtcgaggcctcgcgcctgctgggccgtgcttacgcggtcgaaggtgtcgtcgtcgcgggggatggccgcggtcgagaactcggcttcccgacggccaacgtcgtcgtctcttcgtcctatgcgagtccgcccgatggcgtctatgccggatgggcgtggaacgactcgggtcgctgggctgctgcgatctcgctcgggacgaggccgacgttctacccgaccgacggcctccggctcctcgaggtccacctgctggacgccgacgtcgacctctatggtcagtcgttggaggtggcgttcgactcccggctccgagggcaagtcgccttcgcgggtgtggaggagctgatcgcgcagatgcacgccgacgtcgccgaggtccgtgtgcgcgtgggagacctcgagggcaggtaggctactgcctggctgtagcatcatcacgtacgcctggagcgtccaggcacgacacacgaagggacagtgaccaacccatgggttccaaggcggagacgatcgcgaagttcgggcgcagcgagcacgacaccggttcaccggaggttcaagtcgcgctgctgaccgagcgcatcgcccacctgaccgagcatctgaaggttcacaagggtgatcaccacacccgtcgcggcctcatgatgatgatcggtcgccgccgccgactgctcaactacctgcgttcgcaggacgtcgagcggtatcggaccctgatcgcggaactcggcatccgccgctaggcgccgcacgagcgacgaggcgactgcagccggtccctgtctctcccacaaggagcatccatgtcattcatctcggttgagcgtcagctgaccggggtaccctcgccgttgcgcttcgagacgggcaagcttgccctccaggccaacggagctgtggtcgcgcgcctcggcggcaccaccgtgctcgtgaccgccactggggccaagcacgtgcgcgagggtatcgacttctttccgttgaccgtcgacgtcgaagagcgcatgtacgccgcgggcaagatccccggttcgttcttccgccgcgagggtcgtgccacggaccaggcgatcctgacggcacgcctcatcgaccgtccactgcgaccatcgttcgccgatggctttcgcaacgaggtgcacgtggtggcgaccgtgctcggtgccgacctcgtcaatccacacgacgtgctcgccatcaacgcggcctcggccgcgctcatggtgtcggggctgcccttcgaggggccgatcggcgcggtgcgcgtcgcgctcgcagccgatgggagctggattccgttcccgacgttccagcagggcgatgcctcgagcttcgagctcgtcgtcgccgggcgcaagacctcggacggtaccgacatcgcgatcatgatggtcgaggcgggtggcaccgaggcgacctggggcgcattcgaggcgaacgccgccatcccgaccgaagcgacggtcgcggaggggctcgtcgctgcgaagcagtggatccgcgagagcatcgagctgcaagaggagctggtcgccaagctcgatcatcggccgacctttgcgtggacgccgatgcgcgactacgaagaggacgtgctcgtccgcgtgaacgaggtcggtcgcgagcgactggccgcggccaacgcgcacaccgacaaggtgacgcgccaagatgccctcgacgccgctggcgatgccatctgggctgaactcgccgacgagttccccgagcgcgagcgagaggtgcgggctgcgatccgtcgggtcaccaaggagatcgtgcgcgagcgcatcacgcgcgagggcgtgcggatcgacggacgcgacacgacgaccatccgtccgctcctcatcgaagtgggactcatcccgacggcgcatggttcgggcctcttccagcggggcgagacccaagtgctcaacatctgcacgctcggcatgccgcgcatgaaccagcaactcgacaccctcggggtcgacgaggaaaagcgctacatgcaccactacaacatgccgccgtttgcgaccggcgagacgggcttcatgcgaggacccaagcgtcgcgagatcggtcatggcctgctcgccgagcgcgcgctcgtgccggtgctgccgccggagtccgagttcccgtatgcccttcgcctcgtgtcggaggtgctgagttccaacggttcgacctccatggcgtccgtgtgcggctcgacgttgtcgctgatggacgcgggcgtgccgatccgggcggccgtggggggcatcgcgatgggcctcatcgcccacgacggtgtctacacgaccctgacggacattctgggtgccgaggatgccttcggtgacatggacttcaaggtggcaggtacccgggagttcgtgaccgcactgcagctcgacaccaagatcgacgggatcccctcggaggtgctcgcggccgccctcgagcaggcgcgccaggcccgcgtgtcgatcctcgatcagatgctcgccgtcatcccggcgccgcgttcggaggtggccgagaccgctccgcggctcatcaccttccaggtgccgctcgacaaggtcggtgagatcatcggcccgaagggcaagaccatcaacacgctgcagcaagagacgggtgccgacgtctcgatcgacgacgacggcgtggtcggaaccgtggtcatcggtgcgcgtgacatcgaggcagcgcgcgaggcggagcggcggatccagctgatcctcaacccgccgcaggccaccctcggcgaggtctacgagggcaaggtcgtcggcatgaccaagttcggcgccttcgtcaacgtcctccccggcaaggatggcctcgtgcacatctcgaagctcggacgcggcaagcgcgtcgagcgcgtcgaagacgtcctcgagatgggccaggtgctcaaggtgcgcgtcgacgacatcgatccgtcgggcaagctctcgctctcgatcgtcgacgacgagaacggtgagactccagcccacgctggcgcgtcccatgccggctcgtcgcacgccggcgcgtcgcggacctcggggcgtgagggctccgatcgtcgccatcggcgtgacgagcgccccggcaacgaccgtcgtggatcgtcgtcggctccggccaacgccgtgtcgttcgaggaccgcttcgagtcggagatccagcgcgaactcggcgacctccagtaggtgagccccttcggggcgactcgtcgtgtgtccgagcgccggccagcagcagctggccggcgctctggcgtctgggggcgccatcggcggcagtaccgatcatgacgttctcgcggagggcagcgactggggtgtgggacgggcacggtcctctcgggtgggtccgctagggtccagcccatggcccctcccatcgaccacccggttctcgacgtcgccctcgccgcgctcgatgcggggaggcaggccctgtggcgcacggattcgcgagcggtgctggcgacgaagtcgagccggtcggacccggtgaccgcgacggatcgagcgatcgagcgcgccgtgcgagatgccatcctcggcgtgcgtccccacgatctcgtcgtcggcgaggagttcggttcggccggtgagccggggcggctcaggtggctcgtcgacccgatcgacggcacggtcaacttcacctacgcgatcccgtatgcagccatctcgatcgccgcgctcgacgcatccggcgcactggtgggggtggtgtgggaccttgggtcagacgagacgttcatcgcggttcgcgggcagggcgcctggctcggcgacacacgcctcgccgtgcgaccatcggtgccgctggccgacgccctcgtcggcaccggcttcgcctacgacgcttcggtccgcgccgtccagggccgagtgctggcggcgatgatcgatcaggtgcgcgacgtgcgccgcttcggggcggctgcgctcgatctgtgctggacggcggctggcaggttggatgcctacttcgagaccggcttgaagccatgggacgaggctgccggtgctttggtggtgcgcgaggcgggaggcctcgtggcgaccgacctcgtgggcatcggcgacgacgcgctgaccgttgcgggtccgccagggctgttcgaagagctcagcgagcgcctcggcgaggttctcgccgacgtcagagggccggtcggggacgtgtccgcctcctaggctttgcgccatgcgtgtcggggtcctcggtgctggcggtcgagtcggtcaggtgctgtgtcgggagattctggaccagccggacctcgagctcgccgtcgccgtcgatccgaggttggccggcatcgacctcggtcaggtgatcggtcggccggccggtggcttggtggtcgtgggcgacctcgaggcgtgcctgcgtgctggggtggacgccgtcgtggacttctcggtcgcggaggctgcgcgacccgcactcgtgcgcctggccgaggccgccatcccggctgtggtcgggacgaccggcttcacgcccgaggacatcgaggtcatcggtcgggcgtacgaggcgtccggagccggctgcatcatcgcggccaatttctcgatcggtgccgtcctgctcgagcgctgcgtgcgcctcgtggcaccgtacgtggactcgatcgagatcgtcgaggcgcaccacagtgccaagcgcgacgctccttcgggaacctcccgcgagctcgctcgggtggctcgtgaggctcgcgaggcagccgaggcggggcccctcgtcgcggatccgaccacgcacgaggtcctcgctggcgcacgaggtgcgctcgggcctggcgacatccgcatccatgcgctgcgcgtcgagggtgcgatcgcccatcacgaggtgatcttcggccttcgcggacaaacgctggccgtgcgtcacgatacgctggatcgcagttcgttcgtccccggtgtgctgctcgcgctgcgccgtgtcggtgaggttcgggggctggtgctcgggatcgacgagctgctctgagaggaacgggaggttggccgtggcaccaacggtggcgttcggaccggagatcacggcgatggcgacgccatttggcaccgatggcgcgctcgacctcgcggccgcagagcgcgttgccagatggctcgtggaccagggatcgagcgcgatcgtcgtgaccggctcgacgggtgagtcggcaacgctcagcgacgacgaacgggccacgctgtggcgggtggttgcagccgcggtcgacgtgccggtcatcgcgggggcgaccaccaacgacacggcgcactcgctccggctcgtcgacgccgccgagcgggccggggccaagggaatccttgccgtcgttccctactacaaccgtcctccccaggccggtctcgtgcgtcacttcggccagatcgcccgagcgacgagcttgcccgtgctgctctacgacgtgcccgcgcgcaccgggcgtcgactcgagcccgagacgacgcgtgagctcgctcggacgtcgacgaacgtggtcggcctgaaggatgcctccggcgacctcgcggcagctgccgcactggtggccgaggcgcccgatgggttcgtgctctactgcggcgacgatgccctcgtcttgccctacctcgcgatcggggcggtgggcgtggtctcggttgcgggtcactgggccggcccgctccagcgggtgatgatcgaggctgcgcgctcgggggactgggagcgagcccggcggctgaacgcggcgctcgaggcgtcctatcgcttcgagaaccagctcgcctacccgaaccccatcccgaccaaggcgatgctcgccgcattgggtcttgccgagccggtctgtcgatcgccgctcatcgatccgacgcccacgctgatcgacgaggcgcgcagcgtcctcgccgatctccacgcacaggccgacaaggaaggcatcgagcttcgtgtcaaggcctgagctgcacattcgcttcctcggagggctgggtgagatcggccgcaacgccgcactcgtgagtgtggacggacggggggtgctcatcgacttcggcgtgatgttccccaaggccgacatgccgggggtcgacctcgtgctgccgaacctcgcgggcctcgacgacgtcgagctcgaggcggtgatcgtcacccacggtcacgaggatcacatcggcggcttgcccttcttgctcgccgagcatcgtgtgccggtgtggggctccgaggtgaccctgggcttcgttcgcaatcgactgcgcgagcacgacctcggggatgtggaccttcgcatcctcgccgatggggcgcgcgtgtcggtggggtccttcgaggccgaagccatcccggtgacccactcgatccctggtgccgtcgccgtcgcgctcacgacgccagccggggtcgtgctccataccggggacttcaagatcgaccacaccccgctcgatggtcgtcacatggggctcgctcgtatcgcggcgctcggttctgatcctgggatccgcgtgctgctgtcggactcgacgaacgccgacgaagacgggtatgcccgttcggagcgagcggtcggaccggcgctcgaggacctgttcaaccgccacggcgcggctcgtgtgatcgtggcctgcttctcgtcgcacctgcaccgtatccagcaggtcgccacgctggcacgcgagcatggtcgacggctcgtgctgctcggtcgctcactccagcgcaacgtccagctcggcatcgatctcggtctgctcgatgcccgactcttcgagcgcacgctcgatccgcgcgaggtgcgcgagctcgaccccgcgagcgtggcggtgatcgcgaccggatcgcagggggagcgcatggcggcgctccaccacctcgcgttcgatcccgctcgctggttcgccgtcggtggcgacgacgtggtcgtgttctcctccgacgtgatcccgggcaacgaggcagccgtcaacttgctcgtgaaccagttcacgaggctcggcgcaaccgtcgtcacctcggcacgcgagctcgtgcacgcgaccggtcacgccaagcaggaggagctcgccctcgtcgtcgagctcgcccgccccgactacttcgtgccggtgcacggcgagtatcggcacctctccgctcacgcggcgctcgcgcaacgcaccggtgccgtcggtcgtggggtgatcctcgcccgggacggggccgaggtcgtcatcggcgacgacggtgccgagctggctgacaccccatggggcgagtacctctacgtcgacggtgtcgtcggggacgtctcgcgcggggtgctccgtgagcggcgcaacctgtcggaggagggcgtcgtgatcgtcggggtgacgctcggccccgacggggtcgcgctcggtgagcccgagctgacctcggtcgggtggatccacgacgagcgcgaggaggagctcctcgcggaggttcgggcgatgctggtcggagcgctcggtgacgagaagccgcgttccgaggacgcggtcgccgagctcatccgcacccgggtccgcgcactcgtgcgcgagcgcacgcggcgacgccccctcgtggtgcccatggtgacgaggatcgacgagggctagggcgtggctcctcgatcgcggcgcccctcatccaccaagggccgttcccatggcgcgggtgctcgtggctccggcgcgcgtgcgcgggacgcgaaggcgactcggcgacgtacgagtcccgaggcactcgcgctcggggcggtcgtcgtgggtctcgcgggcctcgtcgtcggctactcggggctcttcggggtcgtcggcacgggcgtcttcctcgcgggccgagcggcactcggtcgcgcggcgtggcttggttggctcgcggtgatcgtggcaggcctgcgcgtgctcgtgcggcgcgagcggccgagacggcgtgcgggcgtcggcctcgccctggtcgtggttgcggtcgcagcgctggttggcgaggcgatgcgggtccaccccgaagcgtctcgggcaggtgggctgttcggcggcgtggtcgctcgagccctcatggcgctcgagggtcgcaccggggcgatcgtgacgacgctcgtcgtcatggccgctggtgccgccctcgccggtgagctccgctggcacgtggtcgccgagcgggtcgccgagcgtctgcgccacgtgcccgacgaggagccgtcgaggaccacccgtgtggctcgtcagcgacccgagcgtgccgcgggctccgtcatcgaagccaccttctcggagctaccctccgatcccgtcgaagccgtccccgagcgccaccccgacctcgacgaggatgcggggatcgctgtggctgatgcgtcgtcgtccgcatcgctcggtgaacccgaagcgttcggctcgccggacgacacggcgacaccgacaccgatcgagctcgtggcgccgcgggcttcggcctgggagcgtcctcggcgatccatcctgcgccgaggcgcgcgcgccaacctcgaccgcggtgagctcatccggggaggccaagtcctccagagcgcactggccagccacggcgtcgcggtgagcgtggtcggtatgaccacgggtccgacggtgacacgctacgagctcgagttggccgagggcgtcaaggtggcgagagtgcttgccctccagcgcgacatcgcctacgccatggcctcggctgacgtgcgcatcctcgcgccgattccggggcgcagcgccatcggtatcgaagtcccgaaccgggtacgcgaagtggtgaccctcggcgacgtcctcggtgacgtgccctcgagtgctccggtgctcgccgtgccgctcggtcgcgacatcgccggtcgcagcgaggtggtcgaccttgcccgcatgccgcatctgttgatcgcgggcacgacgggttcgggcaagtcgtcgctcgtgaactcgttgctcgtctccttgctcatgcgcgacacacccgacgatctgcgcctcatcttgatcgatccgaagcgggtggagctctcgcagtacgcgggcctcccgcacctgctcacccaggtcgtggtggatcctcggcgcgcggcagccgcgttgtcgtgggcggtggccgagatggagcgacgctacgacgtgctcgcgcactggggggtgcgcgacctcgatggctatcgcgatctcgtggctcgcgtccaggggaacgccgaggccgtcggggacgatgaggacgcgcccgcgccgctgccctacatcctcgtcgtcatcgacgagctgaacgacctcatgatggctgcgccgagggaggtcgaggacgcgatctgtcggatcgcgcagaaggcgagggcggtcgggatccacctcgtggtcgcgacccagcggccctccgtggacgtcatcaccggggtgatcaagaccaacatcccgtcgcgcatcgcctttgcggtggcatcccagacggattctcgtgtcatcctcgaccagccaggtgccgagaagctcgtgggcaagggcgacctgctcctcgtcacggccgacagttcgcaaccgcaccggctccaggctccctgggtgtccgagaccgagatcgctcacgtcgtcggggcctggcgccgccaggggcgccccgagctggtgggcgagctcgagcagggcacccccggcagtcgtgagagcgtcgtcggcgacgaggacgtgctcttgcccgaggcgatccgtctcgtcgtggagtcccagagcggctcgacgtcgatgctccagcggcgactcaaggtcggcttcgcgcgcgctggtcgtctgatggacctcctcgaggcgaggggcatcgtcgggccggccgaagggtcgaaggcgcgccaggtcttggtcgggttggacgagctcgacgcgaccgccggccgcgtcgacgaccccacctctcaggttccacctagcccaccacggtaggctgctcagcatccccgctacgtgcgcgctcgtgctgtgcgcgcgtgagtggcgggtctggctgagagcggaggacagcggatggcgtcgcggaatcggaggaggctcggagcccgcagtcgaggttacggtcgacggcggagcgtgcgcctcggacgcgtcctcatcgtggtcgtggtcgtgattgtgctcgccggggtggtgcagatcgtgcgtggggtcccacagccgagctacagcgccgtggtgccggcgacggcgaccatccccggctccgcaccgaacgtgccgtggccgagcggcggcgaggcggcggcggagatcgttggcgtcggcaggatcggcacctacgggccgacgaccccgcagacgatcgcgtcggtggccaagatgatgacggccctcttgacgatccgtgatcacccgctctccctcgggcagcaagggccctccatcacgatcacgcccgaggactaccagatctacctcacggacaaggcccagaacgactcggtgatggccgtcgcgccgggcgagcagctcagcgagtaccaggccctcgaggcgctcctcatcccctcggccgacaacatggccacggtgcttgcgacgtgggacgccgggagtgagtcggccttcgtggcccagatgaaccacgaagccaaggtgctcggtctcaccgatacgcactatggcgatccgagcggtctgtcggcggcgacgtactcgaacgccagctcgcagctgcgtgtcgcgaggctcgtcatggcgaacccggtgctcgcgagcatcgtgtccaagccccaggcgacgctgccggttgcgggtgtggtctacaacgtcaatggcgaggtgacccaccacgggatcatcggcgtcaagacgggctccatcttgacgggaaacttcgcgatggcctgtgcggtgcacgtagggacatcgacctacaccgggctcggtgtcgtgctcgaccaaggcggcgtcgcaccacttgagaccgcgctccacaacggcgtgcggctcgccgagttcgaggagcagctcctccggccggtcacggtgctcagggccggtgaggaggtcgggtcgctcgcggtccccggtcacggctccgtggccgtgacggcgactcgaggggtgacgctggtcgggtggccaggcctgctcgtgcaggtcacggtccatctccaccagcacctctacggcgcggccgcgcacgccgtggtcggcagtgcaacggtcaccttgggtgaacagcgcatgacggtcccgttggtggcgagttcggcggtggcgtcgccgtcgctcctgtggcgcctgacgcatctgtaatggtcgcaccccatggcccgtggcgcttcgcacgggcgcccggctcgaccgccaacctgggccccgggttcgacgcgctcggactcgcgatcccgttcgagactcgtgtctgggcgcggccgaactcgcgcttcgtcgttcgactcgccggtaccggagggagcgagcggctcgacagcggtcacctgatcgcgcgggcactgtcgcaggtcgcccgcgagccggtggagctcgtcgtcgcctccgacatcccgctcgcacgcggcctcggctcgtcgggatcgctcgcgctcgccctcgcggccgcgctcggtgcgaccgatccgctcgccgcggcgatcgtgctcgaggggcacccggagaatgcggcggcctccgccctcgggggcgcggtggtggcggtcggagggggtggggacgagctcgtgctccggcgtgtggcgctcgatgctcggctgcggctcgtgctcgtcgtgcctgagcgtcgcctcgcgaccgccgaggcgagagcggtcgtggcgcgcaccctctcgctcgaggacgccgtcttcaacctgcagcgcgtcgccgctctcgtcgcgagcctcggtgatgtggaggcgctcgcgccgttgctcttcgaggatcgactccaccagccctggcgcgagcggctcttcccggaagccgtggtggtccgcgacgcgctcatcgaggcgggttgtcgcggtgcggcctggtctggggctgggccgagcctcgtggggttcgtcgaggaggagcgagccccccaggccgccgaggccgtccgggcttcgttggtgcgcgtcgcgatcggcgccagcgtgcacgtggtcgcccccgatctccggggcctcgtcgtcgggagcgagccgccgccaccggcactcgcggaagggcctgcggtacccttcgaggcttccggactcggctagcatggactcgatgtcctctcctcagcgcgtggccgtctatggtccgagtgcgctcgcaacaccagcgaacgcggtcagcgtggtgcggttgctgctcgccccggtcatcgtggtcgtgctgctcggggcaccggacggctgggttccgctcgcgctgtgggctggggtcgccttgtcggacaaggtcgatggcgtcctcgcacggcgccagggcgtgacccgagcgggcgcgttcctcgacccactcgccgacaaggtgctggtgttctcggtgctcggtgcgctgtggctcctccatcgggtgccggcgctgcccatcgtcatcatgggcacgcgcgagatcgccgtgagcgtctatcggacccaggtactcgccgggggccagagtctgccggctcggttgccgggcaagctgaagatgctggtgcaggtgatcgcggttggcgtggcgctcgtacccgggtttgcgctgcacgacgagagcgtggtcacgaccctgttgtggggcgccacggttctcgccgtggtgagcggcgtgcagtacttcgtcgacgcccgctcgatccagtcctgagcgcgggtcccgtggacgtctgtatcgtctcgatcggcacggagctcttgctcgggcagatcacggacacgaacgcccggctgctcgcggagcgactcgcttctgcaggacatacgagccgcctacgtgtgaccgtcggcgacaaccatgcccagatcgtgtgggcgctcgcggagggacttgcgcgggccgacgccgtcatcacgacgggtggtctcgggccgacccaggacgacatcactcgcgaggcggtggctgcggtcgcgggggtgccgctcgagcgcgacgagcgcgtcgcggcgaggatcgaggcgatctttcgcgatcgagggcgtcccatgcccgagaacaactaccgccaagcgctggtgccacgtggcgcccaggtcatcgagcagcgcaagggaaccgcccctggtctcgtcgtccccgtgggatccaagctcatcgcgtgcgtccctggcgttccctacgaggcggaggacatggtcgacgaggtgctcgccgccttcgccgctcacgatccgagcccgggcgtgctcgcatcgcgcgtgctgcggacctggggtctcggtgagtcgcgcttggccgagctcgtggccccacggttcgatgcgctgtgggggacgcccacgacgctcgcgtttctcgcctcgggcatcgagggtatcaaggtgcgtatcaccacacgcggcagcgaccccgacggcgtcagggcgaccctcgatgccgaggagcgtaccctcagagcgatcctcggcgactacgtgttcggtgtcgacgacgactcgctcgagcgggtcgtcgcgcgtgcggtcaccggccgacaggcccgagtcgcggttgccgagtccctgaccggagggatgctcgcgagtcggctggtctcggtccctggtgcctcggcgtggtttcgcggtggtgtggtcgcctacgattccgccatcaagcacgaggtgctcggggtccgggccgaacgtgtggtgagcgaggctgcggccgtcgagatggcgctcggtgcggcgcgggtgctcggcgccgacatcggggtggcgacgacgggcgtcgccgggccggatccgctcgagggcgagcccccgggaacggtctggatcggggttgcgatcgggcagcgtgccgcggcgcgtcaggtccgtctgctcggcgaccgcgagcgggtgcggacgtatgcggtcgcgagcgcgttggacctcgtgcggctcacgctggaggggtcgccccgaggtctgtcgctggaggagcactcggcatagccgatcatgcgttcgcatgtcgtcggctcgtgctacgctacgcatgtatccacgaggggaggccgtatggatcgcgacaaggcgctcgagaccgccatcgcacagatcgagaagcagttcggcaagggctccatcatgcgcatgggggagcaccccgagatggcgatcgagtccatcccgaccggcgcgatggcgctcgacctcgcgctcggcgtgggcggactgccccgtggccggatcgtcgagatctacgggccggagagctcgggcaagtcgaccctcgcactccacgtcgtcgccgaagcgcagcgtcagggaggtcggtgcgcctacatcgacgcggagcacgcactcgacccggtctatgcccaggccatcggtgtcgacgtcgaccagctgctcatcagccagcccgactacggtgagcaggccctcgagatcgcggacctgttgatccgttcgggttcgatcgacgtcgtcatcgtcgactcggtcgccgctctgacgcccaaggccgagatcgagggcgatatcggcgattcgcacgtcgggctccaggcgcgactcatgtcgcaggcgctccgcaagctcaccgccaacctctcgaagaccaacacgctcgcggtcttcatcaaccagctgcgcgagaagatcggtgtgatgtacggctcgcccgaggtcaccccgggtggtcgtgcgctcaagttctacagctcggtgcggctcgacatccggcgtgtggagtccatcaaggacggcgcggagatcgtcggctcccgtgcgcgggtgaaggtggtcaagaacaagtgtgcgccgccgttccgccaggcggagttcgacatcgcctacggcaaggggatctcgcgcgagggatcgctgctggacgttgcggtcgagatggggctcgtgaagaaggccggagcctggtacacctacgacggtgagcagctcggccaggggcgcgagaacgtcaaggccttcctcgctgcgaacccgcagctcatggccgaactcgacgtcaaggtgcgcgagcgggtggctgtggaccgtggagtcgccctgacgcacggcatcgtcgccgaggccgaggcgatcatcgaggactagcccctcctggggcggtggtcgggcgcgtagactcgtccccgcgatgccaagcagctacgtagtgcgcaccttcgggtgccagatgaacgagcacgactccgagcgcattgcgggcgtgctcgaggggctcgggctgacgcgtggcgacgatcccgcggacgcctcggtcgtggtcttcaacacctgcaccattcgggccaacgccgacgagcgtttcttcggtcaggtgaaccagctgcgagaggcacgtcgtcgcaatccgtcgatgcgcatcgtggtcgccgggtgcttggcgcaaggagaaggcgcaggactgctggagcgcgcgccccacgtcgacgtgatcgtcggcacgcaccaggttggccgcctcgctgagctcctcggtgcagccgatggggcggaggcggtggtggacgtccgtgagcccgagccgggcagcgtcggtctcgacgaccccacgccgtggggcgaggcggtgagcgaggagccctggcgagcgtgggtcacgatccaggtggggtgcgacaatcgctgcgcgttctgcatcgtgccgagggtgcgcggaccggaggcctcacgcccattcgatgcgatcgtcgccgaggtgcgcgaactggccgcacggggcgtgagcgaggtcaccttgctgggtcagaacgtgaactcgtacgggcgcgatctcgtgctcgcgatgcgtcgggccgaggacgagcgcgagcgggctcaggttgcgagtcgttcgggggtcgccttcctcggccagggcgtgcccagggtgcgtccgctgttcgcggatctcgtgcgcgcggtcggggcggtgccagggattcggcgggttcggttcacgtcgccgcaccccaaggacatgcgtaccgagaccttccaggccatggccgagaccccgacggtgtgcgagagcctgcactttccgctccagtcggggtcggatcggatccttgccgccatgcaccgcggctacagtgcggatcgcttcctcgccaagctcgccgaggctcgtgccacgatcgacgatctcgccgtctcgaccgacatcatcgtcggctttccgggcgagacagacgccgacttcgaggcgacgctcgaggtcgcggccgaggcggcgttcgatctcgcctacacgttcatctactctccccgcccgggtaccgaggcagcggccctcgtcgatcggttcgtcgacccggacgtggtgcacgagcgcttcgaccgcttggtgcgcgtcacggagcgctcggcggcagcggcccatcgtgccagggtcgggcgagacgaagagatcctcatcgaaggtccgagccgcaaggatccccggacggccaccgcgaggacgcgtcagcacaagctcgtccacattccggggctcgatgcgcgcgcgctcggggggcgctatgggcgcgcgaggatcgtcgacgcgcgggcacactatctgatcggcgagatcatcgacgtcgagcccggggagtcatcgctcgtcgtgccgtgagcgaaggtccgctcgaagaggagttcgccgcgtaccaggtctcgaccgatcccagcctcggtccacagccggaaggcaccatcggtagcctcgagtggcgtcgtgggctcgtcggcgccgtagtgcgacgagggtgcgagatcgcctggtcgatcgacgccaggcaggcttgccagggcgacggcgtgagctcggccgaccgcggtctcgtacatgccgccgaccagggcgtcgagtccttccgagcgggccctggcgaggatggcgagcgtcggctcccaaccgccgaggcgcgcgagcttgagattgagcgtcacccgtgcgccgagcgcgagcatcgtcgtgaggtcgcccggcccccgcagcgactcgtccaggcacaccggcgtgagggccgagcgagcgaactgggccaccgcgaccggatcgtcagggtcgatgggctgttcgagcagactgaagccgagccgatcgatggccgagagcgtgggatccgaggggtcgtcgaaggcaccgttcgcatcggcgacgaggtcgatcgtggtcggggtgagggtacgcgcctcggcgagcaggccgagcgacgtgtcgcgctcgatcttgagcttgatgcgccgatagccggcggcgatggcgcgctcgatcgcgccgaggacggcgtcgggctcgtcgatcccgagcgcgatccccgtcgggacggggtcgtctcggccgccgagcagcgcccagagcgggcggccggctcgacgagccgcgaggtcgtgggccgcttgcgacagggcggcgcgagccgcgcgatgcccgcgaatggtgtgcacgctccgtgcgaccgcctccggccggactctctcgaggcggggggcgagaaagcgctcgagcgcgaggagctcggtggcgagcgtctcggagtcgtaggttggctcctcgagcgcggcgagctcgccgagaccgtggacaccctcgtcgtcgacgagctcgaccagcacgcgcgccccgacgtggacgaccccatgggcgctgcggtgggggtcgcgttccagggagacgcgccagatgcgcagtccttcgctcatgcccggagcctacgtggccgacgtggctagcctgacaggagtgccgggacgtctcgcgatcgtcggcccgaccgggtcgggcaagaccagcctcgtcacgcgtgcggttcgtgacggactgctgcgcggtgtcgccgtcgtgtcggccgacgcgttcgccgtgtatcgaggactcgagatcacggcctgggctccgggtgacgatgaccgcgctgggatcgactaccacctcctcggcacggtcgacgtcgccgaggaggtctcgctcgcgtggttcctcggtgcactcagtgtgatcgaggccgagcgggccggtggcggggtccttctcgtcggcgggacgtcgctgtgggtccggagcgcggtgaacggcctcgcaccgccgccccaggcgcctggtcttcggcggtggttggaggctcgcgcgaccgatccccacggcgtcgccgcgctcgtgtccttgctcagagtcgtcgatcccgccgcggcctcggggatcgacggacccaacgcacgccgtgtggtccgcgcgctcgaggtggcgctcgcgagcggcggtgcgcgcagcgtggctggagaggcgctccgcgccacggcgccggcgcgctacgtgcagatcgggcttcgccgtggcgaagcagcgctgcgtcgggccatcgaggctcgtgtggaggcccagctcgccgcgggctggctggccgagatcgaacggatcgggccgatcgcctcgcgcacggctcgtcaggcgatcggcgttcgcgagctcaccgaggtcatcgagggccgacggacgctcgctgaagctcgagcggccatcgtccgacgcacctggcggctcgtacgacgtcagcgggcctggctcgagcgcgatccgcgcattcgctgggccgacagcgtcgacgaggccctctcggcgatcgcgggagcggtggaggaggcggcgtgaggctgaccaagctcgtcggggcgggcaacgacttcctcgtgaccaccgatccggacgagacggcgcggctcgagccgagcgtcgtcgtggccctgtgcgatcgccgcaacggcgtcggtgccgacggggtgattggtctggatgcgcacgacgccatggtgctctacaacgccgatgggtcgagggccgagatgagcgggaacggcctgcgctgtctcgggcacctcgtcaccgaggagcgaggcgtgggcgaggtggcgttcgagaccgacgctggccggcggatctatcggcgcgtcgggcgtgagggaggcagcgtcctcggggcgaccaccatgggtccggtcagcgtgcgggcgaacgagcgcggttggttcgtcgacgccggcaacccgcacgaggtgcgccagctcgcgagcccgcaggagcttgcgagcctcgacgtggcgagcctcggtcgttgcgcccaggcgcactaccctcagggggtgaacgtggagtgggccgtggtgctcgcgccggacgaggtggtgatgcgggtgttcgagcgtggcgtcggtgagacggaggcctgtggtaccggatcgacggccgtcgcggtggcgctcgcgtccgcagggctcgtcgagcgcacgtcggtgcgggtgcgcaacccgggcggggcactcacggtcgaggtcaccgagccagagcctgtcctcgtgggtccgagccgcctcgtcgcctccgtcgacgtcgacgtggaggcgcttcgcgcgtgacgctgatcgagcgctcgttccgcgagcgcatcttgctcgtcggcgtcgtccaccatggcgagcgtcgcgaagcggtcgaggactcccttgccgagctcgccgcgttggtcgacaccgcgggcgctgacgtcgtggatcgagagctcgtgcgtcgtgacgcggtggatccggcgacctacgtgggctcgggcaaggctgctgaactcgcggagcgctccgaggccctcgacgtcgacaccgtcgtctttgacgacccactctcgccggcccaacagcgcaacctcgagcggatcctcggacgcacggcgatcgaccgcacggccgtcatcctggacgtgttcgcgcagaacgcccgcagcgaggaaggacgtcgccaggtggagctcgccctgctctcgtaccggttgccacggcttcgcggtcggggggtggcgctgtcgcagcaggtcgggcgcatcgggactcgaggtcctggcgagaccaagctcgaggaggatcgtcgtcgtatccaggctcgtatggcgcaactacgccgtgagctcgaccagctcgccaggcgtcggttggtgcagcggcgagcgcggctcgcgtcgcgccaggcgcaggttgccctcgtcggctacaccaacgtcggcaagtcggccttgttgcgggcgctgtcgggtgcggacgtgctcgtcgagaaccggctgttcgccaccttggatccccggacccgtcgggtggcgctcccgggaggcgagacgatcctcgtcaccgacaccgtgggcttcatccgcaagctgccccacgagctcatcgagtcgttccgttcgacgctcgaacaggtggccgaggccgatctgctcctgcacgtcgccgacgcatccagtcctgacgtcgcggcccagatcgctgaggtcgaacgcaccctcgccgagatcggtgccgatcgcgtgccgcggctcgtcgtctacaacaaggtcgaccttcggccgatcgacacgctcgctgctggcgtccccgaaggagtcgcgatctcggccgagcacgacatcggcctcgacgacctgcgtgctgccatcgccgcggcgctcgatgcgatgcggcgtccgcgtcgctacgtggttccggctgggcggggtgacgtgctcgcgctcatccatcgcgagggtgccgtcgtgcgagaggaggtggatgcggagcgggtgctcatcgacgcggtgctcgacgatgcctccgatcggctggtccgccgggcgctcggagaggcgccacctgagccgctagggtgaggcggtgtcgcagcgcccctcccgcgtcgagctcaccgcgctcgcagccgatcggcacccgttcgtcgtcgatgcgtccatcggctcgcccgtcgatccgcccccagcgttcgtcccgcacctgctcgcgtgccagggggaggagcgtgcgtacccgccagcggcagggacgcccgcactcgtggagtcggcgacgcgctggttccacgcgctgcggggggtgacgctccccgacggcgcggtcgcgccgaccatggggtccaaggaggccatcggtacgctggcgtggttgcttcgggagcgccgacccgatcggggggtcgtgctcatccccgggcgcgcctaccccacctacgccgagggagcgcgggcggccggctgtgagatcgtgcgggtcccggacgactgctcgggtgctcctgccttcgacgccgtggctgcgtccgtgtgggatcgcacgttggtcgcgtgggtcaactcgccgtcgaatccgaccggtgcggtctatgacccggggccggtcgtcgccctcgcccgcgagcacggtgcggtgctggcctcggacgaggcctacggcgacttcgtgtggtcgggggaggccccgagcgcgctgcgcgcggggctcgagggcacgctcgcgctcgtgtcgctctcgaagcgctccaacctggccgggctgcggctcggtctcgtggcgggcgaccccatgctcgtggacgaggtggtcgcgcgccgacgcgcgctcggcctcttggcctcagggccctcccaagcagtggcggccgaggcgctcgccgacgagggtcacgtcgccgagcagcgctcgcgctacgctgggcggctgcgccgcttggcccgggtcatcgaggcggtcgccgacgtcccggtgcgcgtacccgatggcggcatctacctctgggtccgcgctcccgacgacgacggggcggcgttcgccaggtggctcgcgacgcgcctcgggatcgtcgtcgccgacggtgccgactacggcgatcgtgcgttcgtgcgcattgcggcgacggtgaaggatcgggcgatcgatgccctgtgggagcggggaggagtgcgatgaccgaggacgcgcgtgcggccagcgtgcatggcgcgttcgcacatggcgaaccgatcgataccgcggtgctcgtctcggtgttcgaggacctcgagcgcggcgcgctgcgggtggcctccgtcgactgggacgagggccgggtggtggtgcacgagtgggtcaaggaggcgatcctgctctcgttcggccactggccactcgtggagtccgaggccggcccgctcacctgggtcgatcgcatcccgctgcggcgcgatctcgccgaagcgcgggtacgtgcggtgcccggggcgatcgtgcggcgagggacctatctcggcgcgggtgtcacgctcatgccgagcttcgtgaacgtcggcgcctcggtcggtgagtcgacgatggtggacacctgggccacggtgggctcgtgtgcccagatcggcgcccgtgtccacctctcgggaggcgtgggcatcggcggggtcctcgagccgccgcaggccgctcccgtcgtggtgggtgacgacgccttcgtcggctcgcgcgcgatcgtggtcgagggctcgatcgtcgggcggggcgcggtggtggccgccggggcggtggtgaccccgacgattccgatcatcgacgtcgccaccggcgacgagcttgagcgcggcagggtgcccgactggtcggtcgttgtgcccggcacgcgagagcgccgttggcccggtgggaccttcggcctcgcggctctgctcgtgatcgcgcggctgcccgagggggagcgccacgagaaggccgcgctgaacgacctcctgcgcgcgcacggcggagccctgtgagggacccggtcgagctcgcggcggcctacctcgaggttccctccgtcaccggcgacgaggcggcgctcgctcggctcgtcggtgagcacctcgatgcggcggggcttcgagtcgaggtggtggcgggctgcgtcgtggctcgcaaccacggcggggactcctcggcgacgctgctcgtcggccatctcgacaccgttcccggtgagctccctgtcgccgtcgacgaactggtgttgcgtggacggggtgccgtcgacatgaaggcagggctcgcggtcgcggtggcgctggcgtgctcggagccctccgtgcccgtgaccgtcgtcgcctatccgggcgaggagggtccgatcacaggcaacgggctcgcgcacctcgtggccgagcgccccgaactcctcgcgggtgctcgcggcgtgctcctcgaacccacgggtgggttcctcgagctggggtgccaaggggtcgtgcgcgcgacgctccgactgcgtgggcgtcgagcccacgttgctcgagcctggatgggccgcaacgccatcgatcgggtcggcgaggcgctcgggacgcttcgcgccctggaacgtcgcgaaccccagatcggcccggtgcgctaccgcgaggcgatcgaggtcgtcggggtgcgtgggggcgttgcatggaacgtcgtgccggacctcgtcgagatcgacgtgagctatcggttcgcccccgacctcgatgctgcccgggcgcgccagcgcctcgaggaggccgtgcgtcccgtgatggacgacggtgatgacctcgaggtcgccgaggccgtgccgggcgcggtgagtgacctcggtcggttcggcgcactgcgcagcggcgcgttcggcgtgcgtgccaagctcggctggaccgacgtcgcccaactcgtcgcggcgggcgtgccggcggtgaacttcggaccgggggatccagaacttgcccacacggatcaggagatggtcgaggtggccgaggtgcgccacgtcgcccaggcgctgtggcggtggttgcacgcctaggacgatggttcgcctcttccgatggcgagtgaggccagacctcggactcgcgatgcgggtcgaggtggaggtgaggaggcccatccctgggcgaagggtcgctctcgagcacctccgatgcagtgtctgagcgcagccggtctggcccgccgtgtgctcgggcgtggtggggcaggcagatgggcgtgggcctgtggcgcccgacgccgtaggtcggggtgaggtgccccagatttcgtagacacccaggttacttcacgcgagcctcctccgcgacgaggtgctcgaagacgactggggcaaggtagccgatcttcgagcagctgcgctggtggttgtagaactggatgtagctctgtatgccgcggcgcagctcggcgaggtcgccaaaggcgtggcggtagaagaactcgtgtttgaagatcgaccagaaggactccgcgctcgcgtggtcgtagcaggtgccggttcgccccatggagcgcgtgatcccgtgtcgggcacagaaggccacaactcgatggtcgctgaactgactccctcggtcggtgtgccagatgaccccctgcgcgtgggacccacgcaccgcgacggcctggccgagggcctcgagcacgagcgtggtctccatgcgctccgcgacgctccatccgagcacccgccgcgagtgctcgtcgcgcaccacacacaggtatgccatcgcgccggcgagagcgaggtaggtgatgtccgaggtccagagggcgtgcaggcgccccgggtcgaacttcctggcaacgaggtctggtgggtagatcgccttcggatcggcgtgggtggtcgctgggcggaacctcctggggctgataccggcgatgccgcgcctggccatcgctgctgccaccgtgttgtggctcgtcaccacgccagcggcgaggagtgccgccgtgatccgtcgtgcgccgtaggtgccagaggatgcctggtggaccgcgaccactcggttctcgaggtcgcgtcttgcacatgcccgacgcgacggtgctacctgggtgcgtcgccatcggtagtagccagcccgggagacctcgagtaagcgtgccatccgtttgatctcgaagcgagcgtactccgcctccatcagcgcgaatctctcttgcttggtggcttcgcggcgaagtacgcggctgcttttcccaggaactcgttgtccttgcgcagctcctcgagctccctgcgcagcctgatgagctcggtgcgctcctgcgccgtgaggggcgggctgccagtggcgtttgctgcttcgatccgcctgcgctcctcccgcacccatcgatagaggttgtgctccccgatcgcgagctcacgggccacctctgggacgctccggccgctgtcgatgacccggtgggccgcctcggtccggtactccagggtgaacttccttctcgacgtccccatcgacctccccttccctctgccatggtacgtgtgacttacgacgtgtcaacggaatctggggcggctcaggggaccaatgtgcgcgctggtcgggtcgaggtggcggcaggcatgaggttgcgatggccacgactggatcgagggggacgagatcgtctgtcagttgcgctgcttcgaacgcctcgagcgcgttcacggtgaccttcggcgcctcggtccccgttgcgtgctgtggaggtgctcgaggacgcgatcggcgccgtccacggcttcacgatgccggggacgcgcatcccgtgggtcgattgcgcgccgtggtgatcggtgtcgcaaccgagtccgccgttgccgtgagctcggcaccctcgtgtgagtgctcgctgctcatcgcgggcacctaggagaggggcgcgtgtcgccaggcgagccgggccagcgagggctgccgcgggtcggcaacgtgaggcgctcgagggggcgagtcggtcgagagcgccctggttcgtgtggcccggctgggtgtcggtcttctcgtgggggtgcgcgcctcgtgcggcgagctctggtgcttcccaaccgggagcgccggacgtggctgagcgttcgagagcccgcacaccgtgtcctacgggagctgcacgagcggcgggccagcaggtcacctcgtactcggccgcccgcgtgggcgagcgaggtggccgcgatggcaaggtcctcgcggcgattggcgccacgctcggaccccggccctctccgctcggtgccgaacccatcgaaggtcgcacgatgctgcgcgtccatccgagccgaccgccacacgggtgtggtcgtcctcctccttcggcgctccttcggcgttggctggcccagcaacggcggcgcgatcgcgaccgaggcgcgggtaacgttcgcccgaggccagaacgaggagggtcggagcgatgttggagggcacggtcgtgacggtgctcttcgaactgcacgctgaggggctcggctatcgcgagatcgcccgccgcacgggcatctcccgcaacacggtgcggcgctacctgcgcgacggcgcgagcgcgggacaggtcactcgtccccggcgccgctccaagctggatcccttcaagcccgagatcgatcgcctggtggcggacgggctcacctcggccccggccatcacggaacggctcaaggagctgggctacaccggcaaggtcaccatcgtgcgcgattacgtgcgtaccatccgtcagggtgcatcgcgcggggcgtgacccgcgccgccatgcgagccaagggtttcggcggtcgtcgtcgtatcgtgttcgcggaggggatggccggctcccgaagccgagtccatctcgcatgtgaggcccggcggtagggtcgtgcgggcgccatgtgcatctgtgggggatcctcgtctggtcgacaggccccggtggcgtgcggcatcgtgcgcttcgtcgggtgcacgcagcgggagggcggcagcccgaggcgttcggcttgcgggcgtggtccttgcagcagccgggtcggcgcagctcgcgtgtcgtcaacgctgtggtgcgggtgccgtcgcgctggtgcgagcgcgttcggatctcctcggatctcgtcgacgaacaccggtgctgggtcttgcgcccgtcggcgcgaggcgtcgtcggcccgacgcacaatcctcacggcgcggccggacgctctggcaccgctcaggcgatgggggcgttcatggggaactggagggcgaagcggcctcgtggcgcgtcgcatggactgctcgctgggcgatgggatcggttggcgatgtcctcgtggtcctcgagcaggtcggaacggtgcaaggcatgccgacccgtcggacacagcacctgcagcggcagggctaagccaggggcgcgagcacgtacctggacgctccttggcgagcagccggcggcctggtcagggtgcctggttggcgaactgtgcgtcgacgacctggctcattggcatcggcgtgtggtagtcgaggttgccggcgccgaggtagaccgactgcatggaggagagcaccgacgattggggtgcgagggttggggagaagacgttcggcggctccgagcgcagcagcgagagcgattcgccggtcgccttggcgatgatggcgaggttggcggcgctggtggcggccgacccttggaggtcttgcgcgcccttggcgagcgcgtcgaagaagcgttgggcggccgacgtgtggatgaagctgcccccgtagatgatgccggtgacggcgatcccaacgggagcccctgcaagcaccgtgccttggtgctgcgcgacggccgcttggaggaacggtgtcgccatgtaggccgcagcgacgccgccgttcgcgagagcggcgccttgttcggggaagttgacgttgaccaaggtgacgcgagcgagcgagaggtgtgccttctcgagcgcgagcgcggtgaggtaggcgcccgcggagccctggccacctgcgaccgcaatgcgctggccggcgagctgggagagcgaggtgatgtgagcggccgccgaacccaccaggccgttagcggcggcgcccggcgcctcctcggccatggagccaacgacgcggacgtcgaggccctggtggatggcgttgaagaggccggcgctgaagccgccgaggacgacctggacccggttcgtcgccgccagcgtgatcgcgctctggccgttggcgacgacttggaggttcaccttgatgtgctcggcggcgaagtagccgtgtgcttcggcgacgaagagcggtgcgaagagggggagcgggacataagccaccgtcaccgtggtgggggcggtcgatgaggtggtggtcgacgaggtgctcgtggtcgagccacacgctgccgctgtcaatccgagagccgctgtgagcgcgagagcgcgacgatggcgacgttgcatggatccccccttggtgcaagctgaggggatgctagcgtgcccgccgtctggtccagggcagcacgagccgttcgacgccaacgacgatcccggtcgcgacgacgccgaggagggcgatcacgacgaggccgacgtacatgtcggcaggttcgaacagctgccacgagttccagacgaggtagccgagccccgagttggccgcgacgaactccgtggccgtcacgaccaccagcgcgagcgcgaccgcgacgcgaagccccgtgaagatgccgggtgcggtcgcgggcacgagcacgtgcacgaagcggcgccagcgcgtggcgccgtaggcttgtccggcctcgaggagttctggcggtacgcgtcggacggcccccagcgtgttgagctcgacgacgaagaacgtcactgccgcgacggtgatgatcttcgcggtctcgcccaggccgaagatcaccagcagcaggggcaggagcgcgatctggggtaccgcgtagagcgcggcgaacagcggtgagagcgccgagcgcagcggacggacgaccccgagagcgaggccgacgacgaccccgaggaccgcgccgatgacgtagccgacggcaaggcgcgccgtcgtgatcccgagatcggcgccgagggtgccgttcgtggccaagctgccggcggtgcgcacgatgtcgctcggcggggtgaagatccgggtgtcgatcgcgtgtgtggaggcggcgatctgccacgccaccagcagcacgatgggggtggcgataccgagggccacgtcggcggcgcgagctcggcgagcactgcggcgtgcgccgcggacggcgagttcgctctgggtggtcacgagggggctcccatcgaggctcgcacctcggtctcgaggcgcgaccagagtgcgtggcgcagcgaggtgaacgcctcggtgtcgagcatcgcttcgtcgcgtggtcgtgggagtgggacgtcgaagacgtcggcgatgcggccgggcctcgcggtcatcgcgacgacgcgatcgccgagccagatcgcctcctcgagcgagtgcgtaacgagcaccatcgtgaccccggtctcctcgtagaggcgtgcgaggtcttgctggaccaccaggcgcgtctgggggtcgagggcgccgagcggctcgtccatgaggagcagcgcggggtcggtgacgagcgcccgagcgagcgagagccgttggcgcatgccgcccgagagttcgtctggccaggcatcggcgacgcccgcgaggccgaggcgctcgagccagcccatcgcccgccggcggcgctcggctcgtccgatccccgccatgcgcaggccgaaggcagcgttgtcgacgaccctgagccacggaaacagcgagtggtcctggaagacgaaggcgatgcgcgaccggaccgaggggtcgatctcgagcgttccggtcgtcgcggcggacaggcccccgatgatcctcagcagcgtggacttcccgcatcccgagggaccgatgatggagaggaatcccccggggggcacctcgaggtcgacgccaccgagggcctcacgcgcgcgtcctcggtcgtcgacgaagaccttgccgatcccggccgccttgacgagcgccgtcgctgtcgcgggcgcttcgtggggcgcctcgttgcgatgatcccccatggtggaggggatgctagcggacggcggcgccgtcgtaggagcgcagcacgccgacgacccttccatgcaggtggcaggtctcgttccacggcatcggcgcgagcgagggatcgtcctcgttggccccctcgagccacaccgagctcccgttgcgccgcaggatcttcaccgtgccgacgtcgtcaccgacggaggcgaccacgatgtcgccgtcagcggcgacatcgctcggggcgacgacgacgaggtcgccatcgaggatgccgacgtcgaccatcgagtggccacgcacccgcagtgcgaacgcaccgggcgcggccatggatgcgggcaccgcgaccgacgtctcgacctcgacctctggcaccacgtggtagccggctccgacctcggcgagcaccggtaccgcagccgatggcgcccgtcgggcaacgctcaggctgcgagccttcaacggtgagcgcacgaggcgtccgtcgcgttcgagtcgacgaaggtggtgctggacgcttgccggcgacttgagaccgaccgcatcggcgatctcgcgtaccgatggagcccaacctcgctcctcgacgacctgggtgacgtaggccagaatcgcctcgcgcacctcggggttctcgcgtgtcatgctgcgccctcctctcctgcagtgtactcaaacgcacgttcgcacgcaaccgatgagcgatcgcgcgttcggccaggtaggctcgctggaagagcccgagtgaggtggcgtgcgctgtcccttctgcggcaccaacgaagatcgcgtcgtcgagacgcgggtcgctgacgacggcgcggcgatccggcggcgacgcgagtgccttggttgcggtcgacgcttcacgacatttgagcgcatcaccgaggcgcgtgtcttggttcgcaagcgctcgggccagctcgagccgttcgaccgcgacaagctgcggcgcggggtgcaggctgcgctgaagaatcgccccatcggtgccctcgagatcgagcgcctgttggccgaggtcgaggaggcggtgcgggcggtcgacgaggtggagtcggcggagctcggtctgcgggtcctcgagggcctccgtcaactcgatccggtcgcctacgtgcgctttgcgagtgtgtaccagaacttcaccgatgccgacgactttcggcgcgtgctcgccgacctcggtccgaagcgcatcgcgaaggttcgccccgagggccaggcgcgatgacgttgatcctgacgaggaggtagtgatcatggcgggacgtatcgtcacggcggagctgaccatcgcagcccctgccgacacgatcttcgacgtgctagcgcgccctgcgctccatccggtgctcgacggctcgggcaccgtgcgcggtgtgctcaccggccctgagcgcctctcgctgggcgcccgcttcggcatgcggatgcgcctcgtcgtcccgtacgtgatgtggaatcgcgtcgtcgcgttcgacgagggccgcgagatcgcatgggcgcacctgggtcgccacatctggcgctaccgtctgacgccggagggtgagcagctcacgcgagtggtcgagtcgttcgagtgggacgatgcacccctgcgcctcgtgtacgagatgaccggcgtcccggagcggaacgcgctggcgatgcgcctctctctggcgcgtctcgaggcgctcgtcacgggagagaggcgggcggagggcggccagagcgcctgagtcgccctgatgccgctcctagcggactggggggagacggaggccgaccgctctgaccggctcgtccgcaccgaggaagagctcttcgacgtcggggccgcactcgcccgactcgaagcggcacgactcgcggcctcgactccactcggcgaccatgaggaggcgaagcgcaccgcgcgcgagcgcacccgggcgccctaccgaggcatgctggagcggctgctcgaacgggtcctcggcgagcgggtggaggtcgcgctcgacgaggaactcgacgttctggggatccgacgcccaggccgcggccaagggctcctcccctgagccagctgtgggccggcaccggggagcggtccgtgctctgcgtgcgtggtcgcgacccgcctgagcagggggcgtcggttctcctcgacggcgtgcttaccctctcggacgcccagcagggccgccggttcgtcgccgagctcgaggcctcgccgaggacggccaaggaatcgtcttcacggcgtaccccgatcgctacccggcatgggcccgcagggtcggaccgccgcccccgtcaaccacgccaccaccgcacggtcggggcgcctgtcccgctctgagctcgtcgaggcgatctggctcgagctcggcgtcgcgggccggctgctgccccagctgcgggaggagagcttcgtggcccaggagggggccggcgcggcctgcgctagcggtcaacaggggaatgttcactacactaagtcgaggacgtggcggggaatggctcgacgttgcggcaacgcgagctttccgtgccacagtgcgctcggggaagccgaacgggcccgtcttgggtgcggggaggagtgccgccatggccgagagtcgctcgttccgacggtccttcggacggtcgctggggtggtggctcgggttcgctgcggccgtcgtgggcgcaggtgcggggggctacgcgctcggggcgacgtcgcaaccaatgcgtagaggggcgcccagtacctcgcgcgcgcaccctcgtactacgacgacgccccctcctgcgcagtcggggtcctcggtgccgaagggcgtctcgggtggctcgcaggtgcctggcgcgacggggctctacgtggacggcggtgctggtaccccccactatgtcctcgcttggcacctcggtcccgacggcgcgatcagtggcgccgtcgactacgtgtaccaggatgggcagacctcggttgtcttcaccttcacgggccagctcgatggctccgacaccgtcgcgacgctgacgccccacacgatcccccaggggaccggctcggcctcccagccgcccgggacggtaccggccgcgatctcggcgaccctgtcgacgtcctcgatccagctcggggagtgcaccacctacctgcatttcgcgccgaacgaggctgcgtgcacattcctcgcatcctctagcctgcagtgaccggcaggccgtccgggttccctccctggaggcggcctcggccaggagctcgatgcccccccgtccctgagtgcggaccccctcaaggtcaccgagccgctcgaggccacgcacctgctggggccaggcggggttgcaactgttgagacgtaactgtgttctcacaagggatccgaatgtgtgcaggttcaattcgaccggtggtgaggtgccccagatttcgtagacacccaggttacttcacgcgagcctcctccgcgacgaggtgctcgaagacgactggggcaaggtagccgatcttcgagcagctgcgctggtggttgtagaactggatgtagctctgtatgccgcggcgcagctcggcgaggtcgccaaaggcgtggcggtagaagaactcgtgtttgaagatcgaccagaaggactccgcgctcgcgtggtcgtagcaggtgccggttcgccccatggagcgcgtgatcccgtgtcgggcacagaaggccacaactcgatggtcgctgaactgactccctcggtcggtgtgccagatgaccccctgcgcgtgggacccacgcaccgcgacggcctggccgagggcctcgagcacgagcgtggtctccatgcgctccgcgacgctccatccgagcacccgccgcgagtgctcgtcgcgcaccacacacaggtatgccatcgcgccggcgagagcgaggtaggtgatgtccgaggtccagagggcgtgcaggcgccccgggtcgaacttcctggcaacgaggtctggtgggtagatcgccttcggatcggcgtgggtggtcgctgggcggaacctcctggggctgataccggcgatgccgcgcctggccatcgctgctgccaccgtgttgtggctcgtcaccacgccagcggcgaggagtgccgccgtgatccgtcgtgcgccgtaggtgccagaggatgcctggtggaccgcgaccactcggttctcgaggtcgcgtcttgcacatgcccgacgcgacggtgctacctgggtgcgtcgccatcggtagtagccagcccgggagacctcgagtaagcgtgccatccgtttgatctcgaagcgagcgtactccgcctccatcagcgcgaatctctcttgcttggtggcttcgcggcgaagtacgcggctgcttttcccaggaactcgttgtccttgcgcagctcctcgagctccctgcgcagcctgatgagctcggtgcgctcctgcgccgtgaggggcgggctgccagtggcgtttgctgcttcgatccgcctgcgctcctcccgcacccatcgatagaggttgtgctccccgatcgcgagctcacgggccacctctgggacgctccggccgctgtcgatgacccggtgggccgcctcggtccggtactccagggtgaacttccttctcgacgtccccatcgacctccccttccctctgccatggtacgtgtgacttacgacgtgtcaacggaatctggggcggctcatggcgaggcctactaagcgagtcgcagatccccgttactccctaggggatcgatgtgtgggaagcggcttgcgtagggtgaccgccccccaaatcgagtccactctcaatgtgagaccccatatcttcaggctgccgctcgctcgtcctctcgggcgccgatcatctcgagcgcgtagaacttccggctcctcgccgaggccgcgaggatccgcggctccggtggcgacgtcgagctcgattgagcttccccccatttgcttgacagtctgaatttaggccacggccgcctccgcacgggcccaggagagctcgtactcgacgggcggtaggtacccgaggctcgagtgcagccacagggacaacaggtgttgcgacgatcgattgcaatcacccaccacagccatcgatgccactccgcaagcggaacggcctagggacggcgtcgacgggccgcgagccgcaacttgatccgatgtccggaagcggatcctcggctgcggctgccgactcaggtggccacgacctcaaccgatggtgcaccgcggagtcggcggtcggtcgtcaccagcggtacgccgcgggagacggccagttcgatatagatcgcgtcgaccagccgaagctcttggcgacgggcccaggtcccgaggaggagatcgtggacgggatgccgctcgatcggtgctgcggccagctcgcgaagcttgacctcgacggtgcctgcatcgaggctgtctgctcgatgcaggcgtcccagggccgacaagacttctgcgtcgacgtgcgccggtgcgtgcaaggcgtgaccagcgatgcgacgccgcaccgcacgaccgagctcattgtccagcagaagatcgaccagagcggatgcgtcgacgacggcctcagccatgccgcgtcggtgcttcgtccctcgcggcgtcgagcgctgcaagcgcgcgctcatgtgacactcgcgcaatcgggctcgccagcgttgcaagccaggcatctgtcgagcgcgacgccaggcttcgccggaccgcctcctgggtcaccgcagacaaattcaagccggccttcctcgcttgtgccgcaagatcgtccggcaggtacacgttcactcgagccacaccacacaatatacacacttgcgctacggtgcgctccgcaagccgatcggtcaccgacccgactacccgcgacgcttcgcctgctacgacgacgcacgagcctggtgcgagcgcttccttcgctggtaccaccacgagcaccggtcacgtgcgggatcggactccacgccgtggccgacgcgcaccacgggcgtgccgtggagctccgagcacaccgggcagcggtgccgttgaccgcctcccagatggctcggagctcgctgacgagcaccaggtgctctgggtcctcgcttcggtctttgcggtgtcgccaggggtcgtacgcctggcgagagactcgatgactcgtgctagcgctgctatcgagaagccattggcctcctggcgggcaatcggagtggtagcggctcactgccccccctccctcaccgagtgggcgatccctcgctccgccagctcgagttccatgatgagctgtgtgacctgacggcgcagccgggtcagctcttcgcgctcggcgcctgtgagaccttcgagctcacctcggtcgatccgctcctgacgcacccagttgccaagggtctgctcattcacgccgagttcgcgggcaacgtcagcgatggttcggtgctggtcgagcaccaacgctgcggcatccttgcggaactggctcgggtaacggcctcgtcgtcgacgaacgggggcctcgcgcggtggtggattcggtgtctggctcatcccttcctcctagagcaggtgtcgctttggagggggaggccacaccgtcctgccgcactcgacgcttgagtacctaccgccgttcgagtacgagctcacctgggcccgcgaggaggtggccgaggcctcaacccagactgtcaagcaaatgggcgaaacccagagggccgtcgagggggccctggacgggcgcgcggcgtagcctggcacctgtgtccatcgacctgcgctccgatacggtgacccagcccacagacgctatgcgtcgtgccatggcctctgctcgttgtggggacgacggctacggcgaggacccgacggtccgcgaactggaggagcgtgcggcggggctcctcgggatggaggcggcgctcttcgtggcttccggcacgatggccaatcaagtggcgctgcgaaccctcacgacgccaggttcggtggtcgtggtcggggcccgggcccacctgtgccagttcgagcgtggcgcgagcgctcgtaatgcgctcgtgcagctccacaccctggccgacgacgacggagcgccgacggccgatgcggtggccgatgcggtggcgacctatcgtgcgattggggttcagccagccctcatcgcgatcgagaacacgcacatgccctcaggcggaacccctctcgatccggtgcgcaccggcgctcttgccgatgcggcgacggcgacgccgctctacatcgacggcgcacgactctggaatgcttcggtggcgctcggggtcgagccgagtgtgctcaccgagcgcgccaccgcggtgtcgacgtgcttctcgaagggtctgggggcgccgatgggttcggtcgtggccggatcggctgacctcgtcgagcgtgcgcggtgggagcgccaggcgctcggcggtcgcctgcgccaagctgggatcatcgccgccgcagccctcgtcgccctcgacgagtggcgaagcgtccttgcccgagaccatgagcgagcggccgtgctgcgcgaccgtgtggcggcagagctcggtgatgcccgcgtgcgctggggcgggacgaacatggtgctcgtcgatgccgatcgcccggtcgagatgctcgcccgccttcgtgaagcgggcgtcttggccaacgccatcggacctcggacgctgcgcttcgtcgtccatcgggatctcagcgatgccgaggtgaccgtcgccggtaccacgatcgcccaggtcgtgtcgtgatggagcctcagcgaccatgacggtagagatctacgagccggcggcgagcgtcgccctcgcctgctttgcccacccggacgacgccgaggtgctctgcggggggacgctcgcgcgactcgcggcccagggagcacgggtcgtgctggtcgtggcgacccgcggcgacaaggggctcgcgcgggtggacgacgccgaggagcgccgcaccggtgaactgctcgaagcggccgccatccttgccatcgccgacgtcgtccagctgcgctatggtgacggcgatctctccaacgacctcgagctgcgtcggcggctcgtgaccgtgctccggtccttcgctccgcagctcgtcctcggtcccgaccccacgacggtcttctacggcggacggctctacaaccatcgtgaccaccgcgagctcggctgggcactcctcgacgccgccttgccggccgcgagtcagccgggttacttccccgaagcgggcgagccgatcggaccgctcgaggtcctccttgccggttcggaggagcccaacagcgcggtcgacgtctcggcgtacctcgaacgcaaggtggaggcggtacgtcaataccggagtcgcctcggcgccgccgacggcgtcctcgccgatgcggtggtcggccgtgccgtggacgcggcgcgcagcgtcggcattccgggcgcggcggaactgtttcgcagggtcgagggcgcaggttgaggggaggggcgatggtcgagatcgaggttcgaggcccgggtcaccacgagcgcagcacactggcggctcgagcggtcgcggtgctcgcgggcgcggggctcgacgtgggtgtggtcgtcgacgttcgtccgcggctcgccgcggacatcgaggcccagctcgaggcaggtgcggcacgcgtcgtgctcactggccccggcttctcggcggtggcacgtaccggtcgtgagggcgtggaggaggcactctccgaaggcgacgtgctgatccgactgcgtgccaccgccgacgaactcggggtctacggggtcgacgatgcgctcgggcaggaatgggtccgtcgcctccgcgatgcgggtgtgccctgtatggggcctgagatcggggtctgagcgtcccggaatcggcggtggaacgggagcgttggggttttcgacgacgagccgaggcactagaatcatgacagatcaagcctcggtttggtctgtcggcgtcgaggaggacggatggcgctgaacgaagaggagcaacggattcttcaggaaatcgagcgctccttctacgagagtgaccccgccttcgccgatcgcgtccgctcggagaccgtgtaccggcatgctggacgcaacctcaagtgggcgatcgcggcgttcgtcgtgggactcgccttcaccatcctcaccttcacaacgtcggtgatcctcggcgcagtcggcttcttggtcatgctgggagccgcgtacgccttcgagcgcaacgtccgtcgtatcggtcgggcgtccctgagcgacatggcgcgctctggtcgcggcccgttcgggtccatcggtcggcgtttcaaccgcccggacgactcgcaatgagcgctgctcgcgctgcggacggggtcgttcgaggcctccgtgtgtccgtggcgcgagaggcactccgacaggtctgggcgctgaccttcggctctcgtgggaacccgtggcgcccgggagccgttcgcacgtacctcggcatgcggcacgaggcctttggggcgcgaccgtcgttgcgccagatcgtgcgctatctcgcgtgggccgcggaggagcgtcgcgcctggaggatgcggtgagcgcgcgtgtccatctgagagcggccagaggctgaggctcgcatgactgccggggtcctcgtgctcaacgcctcgtatgaggccctcggtgtcgtcagtgtcgagcgtgcggtcgggatggtggtcgacggggacgtcgacgtcgtggacgtcaccgacctcgtgctccactcgccgtcgacggcgattcgtgttccttcgatcctgcgtctccagcgctacgtgcggataccggcgacgcgtcggatcgcaccaacgcggcgcgccatcttcgcacgcgatggttatcgctgtcagtactgcggggggcctgccgagaacgtcgaccacgtcatcccgcgcagccgtggcggccgacacgtctgggagaacgtggtcgccgcgtgccgtgcctgcaacgctgccaagagcgatcggctgccggccgaggcggggatgcaccctcgacgcgagcctcgtgcgccggccgcgcgtactggttggttgctcaccgttggggtgcgtcggcccgagtgggagccgtaccttcgagcggcctggggagactcagctcgggatctcttgcttggcggcggcgacgatggccgtgagcttgctcgccgggaagagcggactcacgctcactcgcgcgctgcccggtagggcgtttgcgatggtcacgacacctcgagcggtgtcgtaggcgcgcgggacatcagtgccgaccacgaggaaggccgcccgggcacgtgggccgagccgcagtgaggtcgatgcgaggaggatctgatggttcgaggtcccgacccgcacgatctcgttgggcagcggcgctccgaccggcaggtagaagcccccgaccgagcagctcgtcgcgctcgtgttctcaaccgagacgacggcgaggtcgtcacctgtgcgggtgcgcgagagctcgatcacgcttccgtggaggaccgatgcagggcaggtcgcgtcgtaggcctggcggtgggctcgctggccgaggacgacgccgagcaccggcccgccgatgagcgcgatcgctgcgagcgcaatgggcacgcggagcgcacgaacgggcgcgcgcacgccttgtgccatgggtccctccctgtgtgtaagccccgacgagcgctcgtgcgcgacccgcatgtcgctcgccatggtcgataggctaggcccgtggagcgagtaccgcctcctgtcgtcctccccatcggcgtcgcggtcgcctctgggctcgcgcgcgtcgatcggctgccctcccgtctgcggcgatcgatcggcggcgccttgctcgtggctggggccggtctggctggttgggcggcgttgaccatggaggcgagcggaacgtccccggatcctcgcaagcccccggaggcactggtcagttctgggccgtatcggtttacgaggaacccgatctatctcggcatgctgagtgcgcaggccggcgcggcgttcatcaccgctcgcccatcgctggtgttcggggccctcgtcgcgggcgtgttcctcgaccagttcgtcattgcacgcgaggaacgtgaactcgccgagcgcttcggcgatgcctacgccgaggtcgtcgctcggacgcctcggtggctcgtgcgccggtgatctgccaccacgaatggcagtgtcaagatcgagaacaacaacagtgcgaccgggacggcgctcacgatgtaccagggccaggggccgagcagcgacagcatggtgtgctcggcgggtggtcgacgcaggaacatatagtccgcgccggttgcccagtcgatgaggccgtcgaaggccgtgtaggcgatcgagatggcaaggacacgccagggagcgctcggtcgaggatggatgccacgaccgatcgtcaggtagaaggccgccacgacgacaccgacatggccgacgaggtactcgaagaacacgaggtgggggaagcgaaccgcaaggtctggggtgatgatcgcctgcagcgtgccggcgatgccccagagccagaccacttcgacgagccagcgtcggggtacgacgcacgcgatcgcagcgatgaacgcagccgcgtcacacagcgagagcggcagattcgctgccagggaggcgtgcggtgcgagggcgacggcgaccgcgtcgctcgcggcgtccgctgcgatggcgatggcgatgatccatcccacccagtgggcggcgcgtggtgatcgacgcgaggccgcgatgccgatggcgccggcgacgccaagcacgccaaccgtggcgagatacggacctgtggtaggtgcgatcggcgtgctcatcgtggtgctcgtgccattctcgtcaccttcgatgctactcatcgtggcccttggtgtcggagaggctcgttcgcttcgccgcgctcgctttcaggcttgccgatcatgctcatgggccttcagtaggcgtcgctggtgggatgccgagggatcctccaatggctgtggtgacgccatcgccacggttagcccagcgacgggagcctgtgcgtcggttgatcgcgcatacagatgcaggtgccgctggcgcacaacgccgggagtcagtcgttgcccctcgatgctggtggccacctgggcttccccccatttgcttgacagtctgaatttaggccacggccacctcccggcaggcccaggagagctcgtactcgacgggcggtaggtacccgaggctcgagtgcaggcggacggtgttgtagcgctgaatccaggtagcgatggcagagcgagcctcggcgaggttcgcgaagcggtagcgacccaccagctcgcgcttcaggctcccgaagaaagcttcggcgacggcgttgtcgtagcaggtcgcgaccctgcccaccgactggcgaagcccgagcgttgcgcacagctggcgaaccttccgggagaggtactgactgcccctgtcgctgtggaagatcgccccagccaggctgccccgagtcccgagtgctccgcagatcgcctcgaccaccaggtcatcgggcatgcgacgcccaagtgaccagcccacgatccgcctcgagccaaggtctgccaccgtggcgaggtagcagaacccctcgtcgcttcggacgtcggtgatgtcgctcacatacctgcgcttcggttcaccaggggcgaagttctggctcacgaggtccggcagtggcgcttcctcttcccgcctcgtggtacgcacgaagcgccggggtgggcacgctgccatctcgagctcgcgcatcaggcgttccacccgcttgtggttcacgcagtaaccacttcgtcgcagctcatgggtcaccctggggctgccataggtgccgtcgctcgcctcccagatggcgcgaagctcgctcgcgagcaccaggtgctcttggtcagggccgcgctcgcgccagcgtcgccaggcgtagtacgcctggcgagagaccctcgctactcggcatggcgccgctactgggacgccctcggcctcctggtgagcgatccagcggtagcgggtcactggttgccctcgcaggatccgcaaaggccaggcaacgtttcgccaggtctcgttccatggtgagctgcttgacctggcggcgcagccgggtcatctcctcgcgctcggcgctcgtcaggccttctcgctcaccgcggtcgatgcgttcctgacggacccagttgccgagggtctgctcgttgatgccgagttcgcgagcgacctcagcgatggtgcggtgctggtcgagcaccaacgctgcggcgtcctttgcggaactggctcgggtagcggccgcgtcgtcgtcgagcggggctatcgcccgggggcgggttcggtgtctggctcgtcccttcctcctatagcaggtgtcaacctggaggggggaaggccacagagccgctcacgcgaccgttactgcccagccctgacgcgacgcggcgaccagcgacgtggctagcgtgcggtggtgcgcgacagcggcactcaaggcgccccggggcttcgcgtgagggatgcgctcaccaatgttcgcccgacgacggtgtcggtgaacgctcgccgacgtgtcgaggccttcgtccgtccgagctcaagcgcgacgatcacacgaaggtctgtgtgttgcaaaccacgaactatcgcaaccatgagccgggcgcgcggtgctcggtccgcgtcggggacatcggggccccagggggtcgaggtggcgtcgtcgaccggtcggggtgggtgggccgacgtgtgcgttcagcgtgcgtgggagggagttgtcaccttgacaccgtcgccaggcacgtggcacggtcaggcccgaggcgagacaagctcgcaggtctgcagctaccgcgctcgagaggagtttgcgcgtcgccgtggctgcgacggcggtggttcggttcgagtgttccgagccatcaccaacgctctgcgcgggtgcgtgataggcggtcggtggccatagccgatgtgaaccgggcctgcggttcgcgcagggatcgcgaccgaggccgctcccggcagatcctgctgaggtgagcatcagggcctcatgctcggtcctcgccgtcgtcgaactgcaccgcttcgaggcgctgacggcgcgcttcgagcgtctctccaccgtacatccagtaggccccaccctgtgccgacgttgtccgcagaccgatccgctgtagagccttgacggccgccgcggacaggctcaggttctcgccctcgaactccactcgattgccaggcaggacggtcacgtccattgtctcgtctcgcgagaacgtcagtaccgcgcccaccgggatgtcgagcgcctcgatgcgcagattcgatcgacgctgcctcatgctgttaagcgcgacctggtcgtcggcatcgagttctggctccgtcacctggatcggcgtgtgcggtgcgatggagatggccaggacgactcgttctggctcaattcggaagaactcgcgcttcggattgacccgcgcctcggagaacaactggtggagcttgcgttccaatgtgcttgcgtcggcgacctctgcggcgaagtggcactcgaagggcagtgggacgccggtcgtgtaaaggtcgttcatccgtgaggctacatcgccgttcgacttgccgattgagccgccccagattccgttgacacgtcgtaagtcacacgtaccatggcagagggaaggggaggtcgatggggacgtcgagaaggaagttcaccctggagtaccggaccgaggcggcccaccgggtcatcgacagcggccggagcgtcccagaggtggcccgtgagctcgcgatcggggagcacaacctctatcgatgggtgcgggaggagcgcaggcggatcgaagcagcaaacgccactggcagcccgcccctcacggcgcaggagcgcaccgagctcatcaggctgcgcagggagctcgaggagctgcgcaaggacaacgagttcctgggaaaagcagccgcgtacttcgccgcgaagccaccaagcaagagagattcgcgctgatggaggcggagtacgctcgcttcgagatcaaacggatggcacgcttactcgaggtctcccgggctggctactaccgatggcgacgcacccaggtagcaccgtcgcgtcgggcatgtgcaagacgcgacctcgagaaccgagtggtcgcggtccaccaggcatcctctggcacctacggcgcacgacggatcacggcggcactcctcgccgctggcgtggtgacgagccacaacacggtggcagcagcgatggccaggcgcggcatcgccggtatcagccccaggaggttccgcccagcgaccacccacgccgatccgaaggcgatctacccaccagacctcgttgccaggaagttcgacccggggcgcctgcacgccctctggacctcggacatcacctacctcgctctcgccggcgcgatggcatacctgtgtgtggtgcgcgacgagcactcgcggcgggtgctcggatggagcgtcgcggagcgcatggagaccacgctcgtgctcgaggccctcggccaggccgtcgcggtgcgtgggtcccacgcgcagggggtcatctggcacaccgaccgagggagtcagttcagcgaccatcgagttgtggccttctgtgcccgacacgggatcacgcgctccatggggcgaaccggcacctgctacgaccacgcgagcgcggagtccttctggtcgatcttcaaacacgagttcttctaccgccacgcctttggcgacctcgccgagctgcgccgcggcatacagagctacatccagttctacaaccaccagcgcagctgctcgaagatcggctaccttgccccagtcgtcttcgagcacctcgtcgcggaggaggctcgcgtgaagtaacctgggtgtctacgaaatctggggcacctcagatcttgacgatccctggcattgcctcgttggtgaggacatagatgatctcggccacacggcaacgttagccaacggccgtgccgtcgaggctcgaggacgcgcgaggaggctcgggagcacgccgggcgtggcgttcgccgactcgcgaatccaggtgctgcgcaggagcgttaccgcgtgatgtcgggcgagctcgcgccatggatccagcctctgggcgcgagtggctcgccgccaagggtgcgctgtctcgcgtcggcgacgatgcgtcccacgacgatcggttcgcgcaggcctgcggctcgacaggcgtcgatcaaggcggagggatcgtggatcgcgatgacgagctcgtagtcctcgccacctccgagcgcgtcggcgagcgtggcgtcgggcgcgatcggaacgtgatcgagctcgaagccgacgccggatcggtcggcgagccggtgcaggtcgagcgagaagccgtcggacacatcgatcgcggcgctcgcgccgtagctggctgcaagctggccgtgagcgaggcgtggttgaggggcaaagagggcatcgtggaggtggcgcgggagtgcctcgggggcctctcctgcgagcacgcgtcgtaggcccgccgaggccgcaccgagcggaccggtgacgagcaggtggtcacctgagcgggcgccacgtctcgtgagcggggtgccatcgacctgaccgagcgcggtcacgcacagcgtcagcgtggctccccgtgtggtgtctccaccgacgaggggcgcgccgaggcgatctgctgcctccgcgaccgcgacggcgatggcgcgggcatcgatcgctggtgggcaggcgagcgcgagcagggttgcctccggtgttgcaccagcggccgcgagatccgagaggttcaccgcgaccgccttgtgtgcgatcgccgcgaggggccaccggtcgacctcgacgtggacaccgtcgacgacgaggtcggagcaccacacgcgcgacttggacgagggagcgatggttgccgtgtcgtcgccgatcgccagcgaagccgatccggcgccgatgacggcctcgatgacctcgtcttcgcgccagttcgtgtccacttcagctatctaagctgcctggtttgcgcattcggtccggatgctggcagcatggaggatcctgttcgagcaacgagcgagcaacttgacccttcgggaggagaccatggggatcgcggatgcgaaccaggacgtccagcgttggatcgatgagtgggtgcgcgtgctcgagcccgcgcgtgtggagctctacctcggcgagcgggaggagaccgatcgactcatcgacggtctcatcgcccagggcacccttcgaccgttggacccctcgcggcgtcctcggagctacgtggcggcctccgacccgagggacgtcgcccgcctcgagtcgcgcacggtgatctcgaccgacgatcccgatgatgcgggcccgaccaaccattggcaggacccgaccgccatgcgcgagcgtctcggcaagctcttcgcggggtcgatgcgcgggcgcacgatgtacgtcatcccgtttgcgatgggggtggtgggatcaccgttcgcggtctacgcgatcgaactgaccgactcggcctatgtcgccgtgtcgatggcgaagatggcccgtgtcggccgcgcggcctgggatgcgatcctcggcggtgcgcccttcgtgccggcggtccactcggtgggagcgccgctggcaccaagccagcgagacgtcgcgtggccctgcgatccggacaacacctggattgcacacttcccggccaccagcgagatctggtcgtacgggtcgggctatggcggcaacgcgctcctcggcaagaagtgcttggccctgcgcatcgcgagcgtgcacgcgcgtgaagaggggtggctcgctgagcacatgctcatcttgaagctcacctcgcccgagcagcgcacctactacatcgctgcggcgttcccgagcgcgtgcggcaagacgaacctagccatgctccagccttccgtgccagggtggcgagccgagaccatcggcgacgacatcgcctggatccgtccgggccccgacgggcgcctccgggcggtgaaccccgagtacggcttcttcggtgtggcaccagggacctcgcgccgcacgaacccggtcgcgatggcgacgatcagccacgacaccatcttcaccaacgtcgccgtcacgcccgatggcgacgtgtggtgggagggcatggacgaaccggcgccgagcggcctcatcacctggcgaggcgagccctatgaccccgcgaagggacctgcagcgcatcccaacgcgcgcttcaccgtggaggccaggcagtgccccacgatcgcgcccgagtgggaggatccgaacggtgtgcctctcgacgccatcgtgttcggtgggcgacgccgcgacaccgtgcctctcgtcgccgaggcgaggtcgtgggagcacggtgtgtggctgggcgccacgatggcgtccgagaccaccgcggcagccgaagggtcggtgggccgggtacggcgtgatcccttcgcgatgcttcccttctgcggctaccacatgggcgactacgtcgcgcactggctcgaggtcggtgcccgtgccggcgccaaggcaccccgtctctacgtcgtgaactggttccgccgcgacgacgagggggccttcgtgtggcctgggtacggcgagaacgcgcgggtgctcgcctggatcgtcgatcgcctcgagggccgggcccagggggtgtcgcatccctacggcacggtgccggcaccaggggaactcgacctcgcgggcatggcggaggcgccgtcgtgggacgcgctcttcggcatcggtgacgaggagtggtcacgcgaactcgaggatgctcgagcgttcgtcgccaccctcgctccgcggttcccggcctcgctcctcgacgtcgccgaggcagcggaccgagcagcagacaccgacaggggctgaggcaccccggcgatcagatcatcaggagcccgtggaggcgctcacccggcctgcgcgagtcgtcccggcgacgacgagaagagcggctatgcagaacgtggcggccatgatggcaaaggcccagcggaacccgaggtcggtgaccgcgagcccgatgagggcgacccaggccgcgccgatggtttgtgagacggtgaagaacacgccgaaaccctgccgttccaggtcgcggggcatgtgatcggcgaagacggtctggcggagcggcagttcggagtaggagaagatcccgatcgcgagcccgaccagcgcgagtaggagtggctcggcgccgaccaccacgaagcctacgagcgcagccgcaccaagcacgtagttgatgagcagggtgcggcgatgggccgtgcggtcggcgagctggcccatcgctaccggcccgatgaccgcgccgacgtagatcacggtcaggatcaccgtgatggccgcggtggaggtgtggatgccgtcgtggaggtaggcgggtgcgtagaggccgatgatcccgatgccctggccgcccgctgcgatcgtgccggcgaggaggagggtccacacgggtcgggcacgaaggagcgtccacagcgacacggacgagcgggcggacgacgtggtctgcgcctgggggatcggacgacgccagggactgcgaatcccgacagcggtcaccaccgcggtggtggcgaggagcgcagccagcacccacagcgcactgcgccagccgccgatcgcgatggcgaggccggtgatgctgggcgcgatcagcgtgccgatgttgccggcggtgacgtgccacgacaggacggtgccgcgccgcttgggatgtcgggaggagaggaacgacgaccccaccgggtgctgtggccagccggcagcggcttggatcagccgtccgctcgcgaagatcaccacgttcggcgcgagcgccgagaccgcggctcccacgacggagccgatgttctggagcgtgagcagcagcctcgcaccggcgcgcttgacgacgacggccaagccctggagtgctgacccagcaatcgcggccaccgagagcagcgctccgatgaccgcatacgaggtgtggaaggcggtgagggcataggggatcacgatgccgatgccggcgacataggcgtgttggcccgcgtgcgaccacccgacgcttgcgaggtcaccgaggaaggaatgtcgagtgggtttgggttcgccggcgttggtggaagaggactctggcatcgatcagctcccctcccaccctaaccggaggtgccagcctgggtgcgattagccctgtcggcgctggcgctcgggctcgatgacgagcaggacgcgctcggaggtgatcggagcggcgtagggtccgccggtgtagcgctcggagagccgatcgatgtgctcgcgagcgcgagcgccgccctcggtggcgatcacgcggccgcgaacctccacgtagcgataggggttggcatggtcccacaccaccaacgcgaccctcgggtcgcgttggacgttgcggtacttcagccgatggacctcggtgttgatgaggacgtggtcgtcgtcgatgtcgaaccacatcaccgacgactgtggcgacccgtcggggagcagcgtggtgaaggttgcgaagttcgctccggtcgcgagctccacgaggagtggatctagcatgcacgtaggttagcccaacccgggctgggcccgcgagtgcgctcgctcgtccaccgtgaccggatcgacgggcgcaagcgcggccacggcgcccaagtggcacactcggacggaggcgacctcgtaggcgacggtacgggagggtaggcatggcggttgcgtggatcgacggggccctggtggacgaggccgatgcccgggtcccggtgttcgatcatggcctcgtcgttggcgacggggtcttcgagactctcgtcgtcgtcggagggcgggcctttgcaatccgacgtcacctcgagcgtctggcgcgcagtgcgcaggggatggggatcacgctccccgacctcgatgcgttgcgcggcgcgatcgaggccgtcgtctcgaccaacggttacgaacgagccaaggtgcgggtgacctacaccgccggtgacggcgaactcggctcgggtcgtgtcggtggtccgacgagggcgatcgtcgccgaggcgccgatcgagctcgaacctgcgacctgtgcggtcgcggtggccccgtggcctcgcaacgaacgtggcgtgctcgccggcatcaagacgacctcctatgccgagaacgtggtcgggctcgcgtgggcgcgagcgcgcggcgcatccgaggtgctcttcgggaaccttgcgggcaacctgtgcgaaggatcgggctccaacgtcttcgtggtccgtgacggcgacgtgctcacgccgccgctcgacgccggtccgctcgccggagtgacgcgtgcgctgctcatcgagcgcttcgccgtcaaggagaccaacatccccctcgacgatctcttcgacgagcgggtgtcggaggtcttcgtcacctccacgctgcgcttcgtccaaggcgtgcaccggctcgacgaccgcgagttcgagcaggctccgggtccggtgacggccagggcacaggcgctcttggctgatctcgttgcctctgacatcgacccctgaggagtcctcgtgcgcttcgacgatcttgctcgcgtcagtgagctggccgcgcggttcccggacgccgctgtggtccggctcgtcgcgttgcacggtttcgggggtggcgagcgtgcggcggacctcgcgatcatggctcccgaaggaacggtcggggcgatcgtcggcccgggggtcgtcgatcgcctcggatccgacccgacgccacgacttgctcgtgtcgaggtgagcgatcccgacgccgaggcgcatggcctcgcctgcggtggctgggcggaggtgctcgtgcatcccgcctcgtggctgccgccacttggcgaggtcgccggtcggcgtgtcccgttcgtgttgaccaccgtcgttggtgacgacggaccggtggcaccgatcgcgatcgaggtcgatccgctcgtgcgtccaggcgtgacggtgcgcgatggcgtccatcggcaggcgttcgtcccgaggccgcgtttcgtcgtggtcggcgatgggcccctcgtcgacgagctgggatccctcgggacctggctcgacgtcgaggtcgacacaggggacgtcactgggctcggcccgctcgacggcgtgctcgtgctcacccacgatcatgaacgggccaccccggtgctcgcgtccgcgttcggtgcaggggtcggctacgtggcggcgctcggatcgcgagccacccaacacgagcgtgtggagcggctgcgagccgtcggtgtcgacgcgcgccgactcttcggcccggcaggtctcgacctcggatctcgaagcgtccgcgagacggcgctgtcgattctcgctgagtggcttgccgtgacgcgagggcgctccggtgcgcacctcgccgccggcgacggaccgatcaacggctagtcgatcgcgtccagcttgagcggagggatgtcgccgagcggtgggggcgacgacggctcgccctcgagcgctcggtcgcagagccacgcccgcgaggggctcttggtcgatgccgggcaggtcgagtcgagcaaccgcagctgcttcgctgagcgcgccgaggtgggtgaggaggtggcgcgcgttggtcggcgcttcggcgagctcggccgccgtcctccggaccgcgtccccaaggcgcttgcctacgctcccatcgagggctgcggtgatgcgttcgacgaagccatcgcgcacaactcggtcggcgagcacctcagcggcgtcgagggcgtggacgtggggggttccctcccagatcgggagcacgagtgcttcgcggtgccatcgtgcgatcggcgcgtcctcgacgaagccaagcccgccgaacgcctccatggcccgctgggtgacgaaggcggcctgctcggcggtccggaccttggcgacgtgcgaccgtgcgcgaaggatctggtaggcacggtcgccgtggtgcgatccgagcgagctctgcgtctcctcggcgagctcgaacgcgagcaacgaggtggcgagctgagaggcgcggaggcgagcgagctcgtcggcgaacaaggcatgggcgagcagcggtcgaccgaacgcgacgcggcgctgcccacggatggtcgcctcggcgagcgcgatgcgtgcgatgccggcggcgctcatggcgttggcgacccgcgcgatcgtgagcgattcgaggatgcgatggattccgtcggggggagctgcgaggagttcggcgggcgcgtcggcgagatccacctcgccggtcgggacggcgcgggtggcgagcttgtccttcagccggcgaacggagaaggcgagcgagccatcgggctgctcgcgacgcacgaggaagagcccgagcgaacggaccccgcgaacctcaccgacgtgggccgcgacgagcgcaacgtcggcgagtccggcgttcgaggcgaagaacttctcggccgtgccgatccgccactcgccgttgggcgtctgggtcgcacgggcacggagcgacccaaggtccgagccggcgtgggtctcggtgaaccacgtcgcgccgaaccatggcccctcgcgcaagcgtgcggtggcgctgtggtggggggcgagatccgcgagtgcgagcgagacctgcgtggtgagcgtgatcgtgcagtagaggccgggatcggcgaggaggtagccagcggcgagcgcggcgaggaggccgtcgggctctgtcgtggcgagcgcgaccatgggacgcagtcgctcgagcagggccacgtgggtcggggcgagctgggcgcggtcgatgcggttgccgtcgaggtcgtgggcgaccagccgtggcggcgcgtcacggtcgacgtggcgcgcgacctcgagggcgtcggccgagatggtgcgattgaggtgctcgagctcggatcgtcgagccgcagagagtcgagcggcgagccagcgctcgaccacgggatcgagcgcgagctgatcgagtccactcgcgtagccgccctcccgtggcatcaccatccgatcgcgctcccgtcctcggcccgggggtccgagcagctgatgacgtcgtgctcgcgaaccatcgcgatatggcacacgccggcggccgtggtgaggccgggctcgagggtgagcggcccgatgcgctcggcgagctcgccgaggacggacggatccacgtggtcctcgatcacccacgtgcgcttcccgtcgtggtggtgggtgtcgaaaccggggtgtggaccggacgatgcggcggtctcggcgagtcgggcgcgagcgagggcagtgcgcgggtcgatgccctcgcgcagcgtcgcagagaccacctgggcgatgaccgtcggctgacgatcgcctcccatcgtccccgcgacgaggcgcaacgtgccggtacgcggatcggtggccatgagcggcgcgagggtgtggcgcgggcggcggcgcgggccgagctggttcggactcgcgggatcgagatcgaacccgaccgcgcctcgcgagtgcacgaagaccccggtctcgtgggtcgtgagtcgggtgccgaacgcattcgcgttcgactggacgaggacgcaagcgccccctgcgtggtcgacgacgacgatcgccgtggtgtcgggtgcgttcgggcgtcggagggtcgcgggcggagacgacggagccggggcggcgagggcggcggcgacgtcggccccgtcgtagtggagctcatggagccagcgggtctgctcgatggcgtcgaccatctcgagataggcctgcgtgagcgacgtcggtcgttcgggcgggagcgccgcgaggaggccgagggtgagaaagctcgccgacggagccggtgtccccatcatgcgcagcccgagggcgtcgacggcgatcggctcgacgagctcggcttggggtcgggcgaggtcttctgctcgcagtgcgccttgggtgagcgccatgagctcggctccgacctcgcctgcgtaaaagccctcgcgtccgagacgcgtgatggcctcgagggtgcgggcgatgccgtggtgacggatccgctggccagggacgaagcgacccttgaacgccgccgtgagctccgagcgaaagccgaggtccgagagctcgcgtgcgccagcggcgagacgggcgggcgcggcgaagccgttgcgcgcgtagtcgatcgcgtcggcgaggatggtatcgagggcaaggcggccgaagcgttcgtgggcgaggagccaaccgtcgacggcccctggcaccgtgatcgccgctggatggtcgcggggaatggtgcgaaacccttgctctcgcaggatctcggcgttcgcgttcgagccggcgcgcccgatgccgaccagcgcgtggacacgaggtggcgtgcggggtgtgcgaggttgatagacaagtccgacgacgtcgccaccgaggccgcacgcgtcaggggcgacgacggcgagcaccgcgttcgccgcgatcgcagcgtcgacgctactgccgccgcgacgcagcaccgtgagggccgcctgcgaggcgagcgggtcgatgctcgagacggccgcatgggggaaaccgtgacacgcgacgacaggtggctccacatcgcgcaaggctactccacacgtcgcttcggcgcgcagggccgtgagaaatgcgcgattgcgtggtcgacgagctcttgtgcggcggattcgtgagatttactcgtgtggtcatacggaatcggcttgcctcggggagcgagatgcgctagcgtacacaacggttccgcgctccgcgttgccacagcgcgaccgcggcgtacgtccagggcacacgaggccagcaccgagagggcacggccgagagggcaaggccgagaacacggccaagaaggagcagagcatgattcgcacgatcgggctgccggcggagacgaaggatggcgagcgacgggtagcgctcgagccgagcgcggtcaagagctgtgtccaggccgggcacgatgtcctcgtgcaggccggtgccggccgtggcgctggctttggtgatgccgactacgaggcggtcggcgcgaagatcgtggccagtgcccaggaggcctggagtgcggatctcgtcgtgaaggtgaaggagccccagcgtcacgagtgggcctacttccggcgcgacctcgtcctctttgcgtacttgcatctggcggccgagcccgaactggcgcgggcgctcatggacgctggggtgcgcgcgtatgcgttcgagacgctcgaggagcgaggcggcttgccgctgctcgcgccgatgagcgaggtcgccggacgcaccgccgccatcgtgggcgctcattacctggcccaagggtcgggcgtgctccttggcggctcggcaggcgttccgccggctcgtgtcgtggtcgtcgggctcggtgtcgcaggaacgatggcggcgcgtggtgcgcgcggcatggatgcggaggtcaccgggatcgacatcgacctgcaccgcttgatggaggcccacgagcgcgggatcgtcacggcgacgctcgcgagttccgagcacgcgatcggtgaggccgtcgccgatgccgatctcgtcgtcggtgccgccctggtgaccggggcgaaggcgcccaagctcgtcctcgaggagcacgtgcgatcgatgcgaccggggtcggtgatcgtggacctcgccatcgaccagggcgggtgcgtcgagaccgcccgaccgacctcccactcgaacccgatctacgagacccacggggtgatccactactgcgtgacgaacgtgccgggccagtacccgcgcaccgcgtctcgcgcgctcagcgccgcgatcgctccgaagctcgtccgcctggccgcgaacctggatgaccccctcctcgcgaccgcgctcaacgtcgctgacggtcgggtggtgcacccgacggtcgccgatgcccttgggctctagtgtcgctgcccgcacccagcctctggctgcgtgagctcggtcgcgaccgttggcgtccgcagctcgatggatccctcgaggcggacgtcgccatcgtcggcggtggcttgagcggcctgtggaccgcacacgcggtgctcgacgctcgtccgggcgcctccgtggtggtgctcgaggccgagcgggtcggctggggcgcatccgggcgcaacggtggctgggcgtcggcactgttcccggtgagctggggtacggtggcgcgcagcttcgggccggagggggcacgggcgttgcgcacacgtctcgtcgagaacctcgacgagatcgaagccgccctcggcgatgacgccgcggacgtggagtggcaccgagccggcaccgtcgtggcggcccgaagcgaggagcagtggcggcagctggtggccgatgtccgggaggagcaggcgctcggccttcgggaccctggggtgctcctcgacgcgcgaggcgtgcgggctcggttggcgatcgacggcgctgtcggcggagtcttcgagcccgtgtgtgcctcggtgcaccctgccaagctggtcgagttgctggctcggcgcctcgagcagcgtggaggtctcgtgctcgagcggagtcgggtccactcgggtgcacccggcgtgctcgtgggtgtcggcggtcgcgtccgggcatcgcaggtggtgtgggcgacggagtcctacagcgccgccgaaccgcgctggcatcgggcgctcgccccggtggcatcccagatcatcgcgacggcaccgctctcggcggcgcagcgtgagcgcctgggcaaccccgaggcagggctcaccttctccgatggtcggcgtctcgtgatctatggtcaactgcgagccgacggtcgggtgatcttcggcggacgaggcgcgccgtatcggttcggctctggcgtcgagttcgcgaccgaggtcggcgcgaggatgcgcctcggcctcgccgcgacactcgcggagctgctgcgtgaggccgggcccatcgagatcgaggcgtcgtggggcggtaccatcggtgtctcgcgcgattggtatcctcgggtgctgcacgatccgagcgagcgcatcgtcttcgtcggcgggtatgcaggcgacggcgtcgcgatgacgcgcctcgcgggccagctcgcggcggcgtacgcgactggggtgcggctcgatccggacctcgccgtgatcctcggccgaccggtgcggcggtgggagccggagccgatgcggtggcttggcgtgaacgttgggctcggactcacgcgactcggcgatgcgctggagggtcggccgcacgcgcagcgcgcagtggacgtgctccgaggagcagtgctcggtcgttagcgttcgctgcgatggtacgtcgtaaggtggagcgagaccgcccaggtgcggtcaagacgagaaggaggcaaggcgatgggccgcttggcaccggtgtggagcaaggtgtcgccgatcacggtcacgcatggccgaggcgcgcgtgtgtgggatacgaacggtcaggcatggcttgacatgacggctgggatcgccgtgacctcgacgggtcacgcgcatcccaaggtcgccgaagccatcgctcgtcaggccgagcgcttcatccacgcgcaggtgaacatctacactcacgacctcttgcaaccgctcgccgatgccctcgatgcgatcacgcccgacggtatcgacacattcttcttctcgaactcgggtgcagaggcaaccgaggcggccgtcaagctggctcgccaggcgaccaagcgccccaacgtcatcgtgttccaggggagctttcatggccgcaccgcccaggcgatggccatgacgacctcgcgcaccgggtaccgggccggctacatgccgctgcccgctggcgtcttcgtctcgctgttccctggcttcccgcgctcgagtcgggtgggtgacgaggtgagtgtggacgaggcactcgactacctcgactacctgctcgcgtcgcagacggcgccggccgagaccgccgccgtggtgatcgagccggtgctcggcgagggaggctacatcccggcgccggcggcgttcctcaccggcgtcgtcgaacgcgcccgggcgcacggcatcgtgttcgtcgccgatgaggtgcagaccggttttggtcgtaccgggcggatgttcgccgtcgagcacgccaacgtcacgccggacatcctcgtgatggcgaagggtatcgcgtcgggatttcccttctcggggatcggagcatcgtgggagctgatggagcgctggccggtcgggagccacggaggaacctatggcggcaaccccatgggcgtcgcggcggcgctcgcgaccatccaggtgatccaggaggaggggctcgtcgacaatgcggctcgacgtggcgcccagctgcaggcgtcgatggagcgcatcgccgagaagttcgagtgcgtgagccgagttcgtggcctcgggctgatggtcggtgtcgagcttcgtgacgacgcggggcggcccgatgcggacctcgtcggccgagtgctcgccgagatgcaggcgagccaccgcgtgctcgcgatgagtgctggcaccttcggcaacatcatccgctggatgcccccgctcgtggtgagcgaggccgagatcgacgaggccgccgccgcgttcgaggcgtcgctggcccacgtgctcgcacagcggtaggagcgtcctggtcgggaggctctcggtctcccccgaccgcccccactcgaagtgctcgagcgggggcggtcggccaggtgcaggtcaccgcggtcgggcgccgtggccgcgccccgcgcgcgcggccgcgaggcgtctagccgttcgcgagtgagggacgcacctccgcgacgacgaagtcgcgagcggtgccctcgaagtagcgctgtggcggccggagcatgtcgtagaccaagcggtagccgtcggacggcgaggctgcctggccgagctggtggttgaagtagaagaagtccgtccagtcggagttgatgtccagctccatcgcgttgaccgctccgacgcgcgcgaggaggcgggcgagcgacgcgaccgacaggccgggacccgtcacgtagacgagcgcgccgttacgggtgatgccaacgccggagcgccacaccaacagctggttcccgaccgtcgcgccccagatggcgaagttggtcgagttcacgagtggattgatgcgcccgttggagatgagcgggatcaggttctgtcgaacgaccgcgatccccttgggcacatggttgccgtgcgtccaggtctcgatggtgggcacgccgctcgtcgagatcacgaagctggcggcaccgttgcgcaagggaaccgccgtgcggccataggcgtagtacccgccgttcgcgtcttgcatgcgaaagccggagttgaaggcggcgacgagatcggctgcgaccgggttcgtgatcggtgccatgtagggccaaggaccgccaccaggcggttcctgggcacccgcatactggatgaagcgcaggagccgagtgtccatccaggcgaccccggcgaccagcgaggtatggatggggtccgggcgcatgagggtgacgtagagggtagggacgccattgacgagcggcccctccggggtccaaacgccctcgttggcgagcggcggcttggcgaacgggatcacacgggccggtgccgggagcggccccgacgcggttgcgtcgacgtggccgaccggtgtgagcgcgtgacgcggtggcttcccgcccgtcggcggttggttgatggcgtaccaggtgttctcgagaaaggcgacgaagctcgcgcccccgtgtccgcggacccactcgacgaacttcacgccgagcgacgccgaaccgggcatcgtcacggtgccgatgccggcccaactcgccatggcgaggacgacgacgagcacgacggcgcgaaccagacggaacgtgcgcgagcggcgacggcgaggaagccgctcgatgcgggggcggctcggcgcggatcgttggacggtactcacgaaagctccttctgtcgcaggggggtggcgaacgaaacggctgcagtcacggtagcagtggggagttcgactcggaagcgggcgccaccgaggtcgctgtcgaggacgcgcacgcgacccccgagcccgacggcgacgcttcgtacgatggcgagcccaaggcccgtaccgccgtcatgacgggcgcgggccgtatcgagccgcgcgaagcgctcgaagacctcgtcgcggcgatcaggagggatgccgggtccgtcgtcgtccacatcgagcgtcacgccgggcccgagggagccggtcacgagcgtggacgtccgaacccgaacgcgagaggtcgcgtgtcgtgcagcattctcgagcaggttgcgaaccagcgaccggagcaactctggctcggcagcgatcgtggcatgcacatcggtagcgagcgcgaagctcaggcggggattgaggcgttcgaggcgagcgacctcgtcctcgacgacaccgaccaggtcgagctccgtggaggcggggcgtcggggtccggtctcggcgcgcgcgaggaggagcaggctctcgatcaggcgctgcatgcgatccgcctcggacagggcgatctgcgtcgattcgtcccagtcggtgatctccgggtggagcgcaccgacctcgagggtggtgcgcagcgccgagagcgggctcttcagctcgtgcgacgcgtcctggatgaactgcttctcgcggatgagcgcgtgttcgagccgtgcgagcatggcgttcatcgtctgtgccagtcgggcgatctcatcgtcgcccggcggttcggtgacgcgctggtcgagctgcgacgaggtgatctctgcgacgtcgctgatcatctggtcgaccggtgccagcgctcgcctcgccagccaccacgtggcgctggcgacgacgaggagcacgagcggatagacgacgtcgaagatgtgcaccaaggtcctcgtcgcctgatcgacactggcgagcgaggcgatggtgaacacgtagtaggtctcgacgccggagctgccgacctgggcaggtacggcgctgtgcgcgagggtcgctgctgcgcgtgtggtcagcgcgatgggctcggcgacgagcaccgatcggatgtcgatgtcgtggccgaccaggatcgaccgcgccttgctcgtcgcccgcgtgacgacgagaccggcgggtgggacgtggtgcggattgacgagtggggcgacgccacggaggttgggggtcgcagcgacgacctgcccggtgctcgagacgatctgggccgcaagatcgccgcgcgggagcgggagcggtcgaggcacgtcgccgttgcgcacgaggaggacgatgtcgtaggcctcgctacgagcggtctggacgatccccctcgtcagggcggtacggagcacgagcacggtagcgacgaggcttgcgaggagcgcgagaccgacggcgacggtggccgcgacggtggtgcggaccaccaccgacgcagcgaggcgaccgaagaaccgaacgacgcgccaacgagatcgtgcgagacgccccaggtatccgagcgagttcagccgcatgggccgcggtcactcactggcgctcgacgccatcgcctcgcttctgccaccatcctcctccaggcgatatcccacgccgcggatggtggtgattgccttcgtgccgaacgggacatcgatcttcttgcgcagatacccgatgtagacctcgacgatgttcgagtctccctcgaaatcgtagtcccacacatgggcgatgatgtcttgcttgcgcaggacgtggcccttgttgcgcagcaagagctcgaggaacgaaaactcgcgggtcgtcagatcgatggtcacgttgccgcgcgtgacacggtgactcgctgggtcgagggtcaagtcgccggcctggaggatgggtgggtggctctcgacgttacgacgcaacagcgctcggatgcgcgcgacgagcacggtgaacgagaacggcttcttcaggacatcgtcggcaccggtgtcgagcgcctcggcttcgtcgtattcaccgtccttggccgtgagcatcaagatgggtgtccagttgcgctcctcgcgcaggagttgcgtgaacttgaacccgttgacaccgggcaacatgatgtcgaggacgatgcagtcgtagggggcatggcgcgccatgtcgagccccgtcgtgccatcgctcgcggtatcgaccgcaaagccttcagcgctgagcccgcgcttcaagctggcgagcaagttttcctcgtcgtcgacgatgagcagtcgcatgacacacctcccagcactcggaccctacgaggtttgctcggggctcgcctcaagcgagtccgaaggtttcctgagagtctgccgatccgagctgctcgagacgcggcttacgtgagcgtgggtgcgtgggcaggccgagactggtgccgacgccgacgagcgcgacgatgcgttcgtggacagcgagttcaagtgcgctggcgaggaccgggtcgcgggcgaggcgccctgttcgccacatcgagccgtacccgagtgcccgcagggcgagcaggagatacccggtcgcgacgacggcggcgtcacgctgctcctcgacgctcgtgcgagcggcggcgtcggggctcgcgatcaccgcgacgaagagcggcgcacgggagaagctcactcgagcacgtgcagcgtcgtcggggcgttcgagttcgatgtcggcgacgatcgccgctgctgcgtcgggccagatcgcgaccatccgatagggcgtgagagagcgatgatcgggtgccgtcgcagccatctcgatggcgaaggcaagctcggccgccgagggcgctggcggcgcgagcttcggttcggagcgccgggtcgccatcacggtcagtgccggtgcgcgtcgagcaagctcgagcaggctgtcgtcgctcaccagccacgctcgatccaggtcgcgagggaagggcgctcggccccgacggtcgtgatgcgcccatgtcctggcagaaggacgcacggatcgggcagctgttcgaacagttcggccgagatcgagtcgatgatcgtccgaaagtcctggggtgagccggtcttgcctggaccacccgggaacagcgtgtcgcccgtggcgcacagtgacgtgccgaatgcgaagcagaccgaccctggcgtatggcccggggtgcagatcgcctcgatcgtgacgtcgtcgatgacgagctgctgcgatgtctcgatgcgatgggtgacccacggggcatcacggccgtcggccgcacccatccagacactcatgcctcgcgccgcgagtgctggagcggcgccaatgtggtctgcgtggccatgggtgatgaggagagaggtgatcgatcgttcctcggcagctcgccagagcgtgtctggatcgctcggggcgtcgatgaggacacctccgcccggccaggagcacagccaggcattgttctcgagtggtgccaggacgaagcgctcgacgaccacatcgtcgagcgtgatgaccagctctggagcgcccacgtggcgggagcctagctggttcgcctggatctgggggacgggctcgtgcgcgcctcagcgtgcggcgaacggtggtgggtacactggaaacgggtcgtcgtgacggacgagtcgtgagtgaggggaccgaaggtgagacgtgtccggcgctcgggggagtgggctgttccggtcgcgaaggacgaccgggatcgggctcgagcgattctcgtcgaacgtctgcgttcgggcgcgatgggattcgatgagtacgagcgtcggctcctcaaggtcgagcgagctgcctcggtgccggctctctacgacgcaaccttcggtcgagcgcgactccccttcgggggaacgaggtggcgccgacgacgtgtccggctctcggtggtcgggctggtgatcgcggctgcggtcggggcgctcgggttcatgtggatcgggttcctcgtcgctgccgctgtcgtgctcgtcgctgtggcgggcgtcaacctcgcggtctgggtgcaggcccgcaggtacccccaacggttcgaccagtccgtgggcggcacgtcgcgctagccgggtgcaccggagggagccggtcgacctgcgttgcgcagccgatacgccgattggatcgatgcgccgcttgggactgcgtcgatcggcccggagcgagtcggtgaggttggcttcggcgtcgcggccagatagcgtgcggtcggtgccatcgacgcacgaggtggctggccagaagggagcggtcaatgagccaacactggcatgaggtgcaagacgagcttcgcgacccggtcaaggagctccgtgcccagatcccagagacgtggcacgcctatgcgacgttgcaccgccatgcactcgaggccggccacatcgacgccaagaccaaggagctgatcgcgctcgcggttgcggtgacgacccagtgtgacggctgtatcgcgtcgcacgcgcgcggtgcggcacggcaaggcgcgaccgctgaagaggtcgcggaggcgctcggcgtcgtggtcttgctcaccggcggccccgggaccgtctatggcccacgcgcctatcaggcattcctcgagtttcgcgaggactatcgaaccgctgagtgagccacggcctggacgacgagatcgacgacgtcgatcccagcgcgagcgagtgttcgtgctccgacgacatcttcgatctcattgaccaccacgtcgtcgtcgtgctcgaagaggtcgatgccgtagtagccaggtccgatcagacccatgacacgggtagcgaggcgatgggactcgcgagtcggtgtggcgaggtgtcccgatgctccacggctcaggttcgcagccaccccgtcggccgcgcgtcgctcggtccatgctgcgatcgtgctcccgacgacgtaggcgcgcaggacgcgctcaccgccttggacgaaggcttgggtgatccacgcgtcgagatcgcacctgggtggtgcggctgccgggacgatgcgcacgccgtggccgccgtggcccgctcgaggtttgacgacgagatcagtggccgagaaggcgcggtgtgcgagccacgagggcgtcgttggtggtccggggagctcgtgctcggcgagccaccgggcggtcgccagcttgtcgttgccgatgagggccagaagcggtgggttcaccacgaccgggagccggtcggcgagccagcgacgcagctcgcgatcgcgcgagcgggcgatcgcgatggcggtgtcggcagccaacgccgggcgatcaccgggcccgaccatgcggagcgagcacgagccgaagtgtcgctcgagcccgtcgcggagcgcgcgtgcaaagtgcacgttgcgcgccagggaccatggatcgtaacagaggaggacgcggctcatcggctggggccgaggagctggtcgagcaccgcggctgcgacatcgatgccggtgatggcactgaggcgccagatgtgtgcgttggcgttcacctcgcagacgatcgagccctcgccgtcgtcgtcgatgagcaggtccacgcctgcgttctcggcgcccacggctctcgcagcttcgatggcgagcgtctgttcgcgccgggagggccagtacggatagcccgcgccacctgccgagagattggctcggaagtcgtggcgctggcggcgctccatcgcagccaccacgcggtcgcgagcgacctggagccgtcgatcgcgaccacgcgacgatgcgatgaagcgctgcaccaggaggcgacggtccgcgagtgccgaggcgatgtcgatgagatcgtcgagcgtctcggcgaggtggacctgcgatccgaacgagcccttggcctccttgacgacgagggggaggcccacgtggcgcaccgtggcctcgagtacacccgggtcgatgggctgcttgggatagagcggcggtaggagtacggacctcgggaccgtgaggccggcgccgacgagacgtgcatcggtgcggcgcttgtcgtcgcaggcgaggatggcctctggcgagttgaccacctgcgcgccgtcagtgcggagcgcctcggcggtggaggcgtccttgtcgagcatcagcacgaagcgtgcatgcggcgggtcgtcgagccagatggcctcgcgcgagagatcgaggacgccgacatgcggtgttcgctgacgcgcagcgtggaggtagaggccagcgttcgcgcggaatgctgggccgagtccaaggttcgccacgaccaggatgtccagcgggcgcgtacgatggcttggcgccgggtgcacgcgcagagtctacgggtcgcggtgacgggaggacgtgtgggggtggtgagccgagacgacatcctcgacggacgtgtcgtcctcacggcctcgggagggctcgacgacgtcgaggaaggcgtgacggtgctcgccctgttcggtgccaccgaggccgtggggggtggccctcccgtcgaggtgctcgggggcttcgccgatcgtcttgcggagctgtcgcgccgaccggtggtcacctttgcgccgcgaggactcgatggcggtggtgcgttccgagagcgagaagcgctggcggatgcacggcgtgtcctggccgaggtcggagggcctgtcgtcgtgctggcggcgaccgtggcagccggggtcggcgttgcactgggccgcgacgagcgggtcgtgggggtggcgctcgtcgacccgtggacgatcggcgaggcggtcgccttcggcgtgaacctcgacacggatgcgagcatcgatcaatccggcgatgcactggcctgcgcggtgctcgtcgtcaccgaccacgagcgcgacgtcggtgcgatcgagacgatcgcacccgaggctgagatgcatcggctctctggggccgcgcgcagcttcgtgctcgatgcgcgcgtcctcgccatcgtggcgggctggatcgagcgggccccgtggtctggggaggtcgcctcgcccgaggcctagagcacgggcgtggaggatcggcggttgtgcgtgagagtggcggcgccgggtgtgccccagctcggctgttcgcgcgcgagctcgatggcggcgcgaaggtcgtgcgctgcttgcctcgggtccggggcttccgtcagtgcccgcacgacgacgaagcgccgtgcacccgccgcgacgagcgctggtatggcttgagccgtgacgttgccggtgatgaagcggggtcgagcctcggctgctcggtgtgcgaaggcgacgtaggagcggccggtgccggggcgccctggcttcgtcggtgtgggctcgaccggcccgacggagaggtagtcggcaagtggcgaggcggcgttgaactcggctggtgcgtgcgtcgacaagcccacgattctgtcggggccgacgagggaacgaacggtgccgacgtcgaggtcgtcttgaccgacgtggaccccgtcggcgtcgctggcgagtgcgatgtccggccgatcgttcacgatgaacggcacgccgcgccgcgcaaggagccgggcgaggtctcgagcggcgcgaagcacgagtccatcgggcgcgtccttcgcccggagctggacgatgtcgacaccgccgcgcacggttgcgtcgacgaacgcaagcaggtcacgccgcagcgggacgcacaggtacaggcagcggtccccgagcgacctcgtcactgccgcgccttggcgcgagcggccttgaccgccgccttggtctcacggatgcgctcgatggcttctggcgagacggcgtcggcgaccgagcgaaagctgccgggctcgccaaagggctcgctctcgcgctcccacccgtcgggacgaacgccgaagcgcttggcgagcagggcgaggtagatgcgtgccttctcgtcgccgaacccaggcatggcctcgatgcgccggcgcagctcggccgcgtcgcgcacgtcctcccagagtgcggtgacatcgccggcgtaatgctcgcacacgctcacggcgagtgcatggatgcgcttggccatcgaggtcgggaatcgatgcagcgctggcttggtggcgacgagtcgtgcaaggtcctcggggtccatcgccgcgatcgagcacgcatcgaacgtgcgaccgagcgcacggaggcgctgctccagctcgagcggacctcggaaggctcgttccatcggtatctgctggtcgagcagcatgccaacgaggagggcgaagtgatcggtggcgagcagctcgttggcgcgctcgtcgtcggtcaggtagagctcgatcacgcttgctccttcgacgggaccgtatgagtggcgtgccctcgagcctacatggtcgggtcgaagcgctcgggtgagactccgtagtgcgcgagcgcatcgtggagttcctcgggcttcgcctcgccgatgcgcacgagttgcgcgatcgcggcgacgacgacgtgcgccgcgtcgacctcgaagaagcgtcgaagcgcctcgcgcgtatccgagcgaccgaagccgtccgtgccgagcgcgaggaaaggtcgatcgacgaagttggcgacctgttcggcgacgagccggacgtagtccgtggtggcgacgatgggcccgctcgactgggccatgagctcgtcgagccacacgcgctggcgttcggtcccggtcagtcgctccgtgcgctcggcctcgagggcgtcttcgcgcaagcgcttgtacgacgtgatcgagaatgcggtcgctgccacgccccagtggcgagcgagttcgctctgggcctcgagcactgcccggtgcgcggttccggagaagaacagcgtcacgggacggcgccgatcgcgaggggtcgctgccgagatcggctcgacgtcacccatctcgggggcaggacggaagagatacccgccgcgcatgatcgcctcgaccagtgccgctcgctcgaggtggtcgggcgcgggcggcatcgggtagttctcgttgtaggtcgtcaggtagtagatcacgtctctcggctggggaccgtacatgtcggcgatcccgtgctcgaagacggttgcgatctcgtaggcgaacgctgggtcgtaggcctgcacgttggggaatgccgccgccaggagcagcgaatgtccatcggtgtgctggaggccctcaccgaggagcgtggtgcgccccgccgtggcgccgacgagaaagccgcgcgctcgtgcgtccgaggccgcccaaagcaggtccatcgtccgctggaagccgaacatggagtagaagaggtacaccgggatcatcggaacgccgagcgttgcatacgacgtgccggccgcggtgaacatcgccgtggcaccggcttcggtgatgcccatctcgaggatctggccgtcttgtgcctcggtgtaggacagcaagagcccggcgtcgaccggcgtgtagagctgtccgatcgacgagtagatcttggcctctcgaaacagcgcttcgagaccgaacgtccgcgcctcgtccggcacgatcggcgcgatacgggatccgacctgtgggtccttgatgagcgatcgcagaatgcgagccatcaccatcgtcgtcgacaccgcttgggcgccagagccgtcgtagaactcggcaaacgcctcgctgctcggcgcagggaggctccgtgcgcgttcgacgcgcttcgggaggtagccgccgaggacgcggcgccgtgtgtggagatactcctcctcgatcgagcccggaggaagcgtgatgtagggcggatcctcgcccgcaagcatctcgtccgagatcacgtcgttcaggtggaggcgatcacggaactcgaggagctgctcccgggtcatcttcttgatctggtgggttgcgttgcgcgcctcgatgtccgggccgagcgtccaacccttgatggtcttggcgaggatcgcggtgggtgaacccgtgtggttcaccgcggcgtggtaggccgcgtagagctttcggtagtcgtgtccaccacgagggagcgcctggagctcctcgtcggagaggtgctccacgaggcgacggaggcgtgggtcgggtccaaagaagtgttcgcgaatgtaggcccccgactcggtcgcgagcttctggaagtcgccgtctggcgtcgtgttcatcttgttcagcagcaccccgtcgacgtcccgggcgaggagctcgtcccacttcgagccccagatcaccttgatcacgttccagccggcgccgcggaaggtcgcctcgagctcttggatgatcttgccgttgccccgaactgggccgtccagacgctgcaggttgcagttcacgacgaagatgaggttgtcgaggtgctcgcgtccggccacaccgagcgctcccaccgcttcgggttcgtcgagctcgccatcgcccacgaacgcccagatgcgactggaagcggcctgggcgagcttgcgattctccatgtagcggttgaacatcgcgtggtagatcgcctggatgggcccgaggcccatcgagaccgtggggaactcccagaagtccggcatgagtcgcggatgcggatacgacgacaggccctggccaccgacctccatgcggaagtgattcagctgcgcctcggtgaggcgtccctcgaggaaggcgcgggcgtagaaacctggtgaagcatgtccttggaagtagacgaagtcgccggggtactcggtgtccttaccgcggaagaagtggttgaagccaacctcgtagagagctgccgagctcgcatacgtcgacaggtgcccgccgatgccgtccgcggcatggttcgctctcgtcaccatcaccgcggcgttccaacggatgaacgcacggatcctgcgctcgatggcctcgtcccccggaaaccatggctcgttctccggtgcgatggtgttgatgtagggtgtcgagaccgtcgcggggaagccgacctggcgctccctcgccgcttcgagcagcttcatcagcatgaaggtggctcgctggcgacctcgctcgtcgacgagtgcgttgaaggagtcaacccactccgccgtctcgtcggggtcgatgtcggggatctgatgtgcgaagccgtcgatgatcacgcctccattctgacagctcccgatgtcggtgtcgactccccgctagcctggcgcggatggccgtcgagcgtctcgtctacaccgatggagcctgtttgggcaacccgggtcctggtggctgggcctggttcgagcctctcacgggacgtcgagcgtccggctcggaggcgcagacgaccaatcagcggatggagctcaccgcggtgcttcgagcgctcgaggcagaccccgcgcccctcgtactcgtgcgctcggactcgcagtacgtcgtgcggtgcttccaggagcggtggtgggcacgctggcggcagaacggctttcgcaacgccaagggccaacccgtgtcgaaccgcgacctgtgggagctcgtccttcgtctcgtgctcgacgagggccgcagcgttcgtttcgaatgggtgcgtggccacgctggcgatcctgggaacgaggaggtcgaccggctcgcccaagctgcggcccgtgcggtggcgcgcggcgtctgacgggtgcgccgacgacctcgtcactaaggtggcctcatggagctgcgtggatcgtcggtggtggttacgggaggcgcctctggtcttgggctcggggtcgccgagcgcttgatcgggcgaggtgcccatgttgtgatcgtcgaccgcaatgcggaggccggggcggccgttgctgcgcgactgtccgccgagttcgtcgaggccgacgtgacggacgaagagcaactcgctcgcgcgttcgaccgggctgcagcgttggggccagtgcgtatgggcgtggcgtgtgcgggcatcggaattgccgagcgtgtccttggccgctcgggcgagccgcatcagttggcgtccttccaacgggtcatcggggtcaatctgatcgggacgttcaacctcctccggctcgcggctcgcgccatcggagcgagcgagccggccgatggcgagcgcggggtgatcgtgctgacggcgtcgatcgcggccttcgatggccagatcggccagatcgcctatgcggcctccaagggcggcgtcgtcggcatgacgttgccggccgcacgcgatctcgcgagcgcgcagatccgggtcgtgacgatcgcgccgggcatcatggacacgccgctgctcggtcaacttcccgaggaggtgcgccgcgacctcggcgcgtcgattcccttccccaagcgactcggccaaccagccgacttcgcgcagctcgtcgaggcgatcgcagagaaccactacctcaacggtgaggtcatccgcctcgacggcgcgctgcgcatgccgcctcgatgaaccggcgcgcggagtcgtcgatcggctgacctaggctggttcgcgtgcgctacgtcgaggcagccggactcaaggtgtccgcggtcggcctcgggacgtggcagttcggctcgcgagagtggggctatggggaggcctacgccaaccacgatgctcgcttgatcgtcgagcgggcgctcgagctcggcgtcaccttgttcgacacggctgaggtctacggttcggggcgctccgagcggatcctcggcgaggcgctcgcgtcgtcgcgggccaacgtggtcgtcgccaccaagtacgctccgacgctgccgatcccgggcagggctgctcgccacctccgcgcctccgcccagcgtctcggtcgtgacgccatcgacctctaccaggtacacttcccgaatccactggtgcccacgcaccagctgctcgaggaactcgaggccgaggtgttcgctggtggggctcgtgcgctcggggtgtccaacttctcgttggcggcctggcgcgccgccgagcgaacaggtcacgtcccgatcgtctcgaaccaggtccacctgtcactggtggtccgccgcagccttcgggagttggtcccgtgggcccaggccaacgaccggttggtcatcgcctactcgccgctcgagcagggactcctggcagggacctacacaacgacgcatcggccgaggggtgtgcgtcggctgcggcgcgccttctcgccgaccgggctgctccgggcgcgtccagtcctcgacgagttgcgacgcgtggggactcgctacggtgcctcgccggcacaggtggcgctcgcgtgggtgctgtcacacccgaacgtcgtggcgatcccgggcgcgtccagcgtctcccagctcgagcacaacgtcgaggccggggcgctgtcgctcacgaacgaagacgtcgtccgtctcgaggcctctgcgcaagcagcgtggcccgtcaggtgagtgcatcggtgcggcggcgaggaattgtgtggacgttgactgcctggtagaaacctgtatcggaaggagtggaacgaacggtgagtgactcgacctacgacgtcgtcatcctcggtgcaggtccagcgggctacgctgcggcgctctacgggggatcggctggcctcagcatcgccatcgtggaacaagatcgcgtgggcggtacgtgcttacagcgagggtgcgtgccggccaaggagtttctcgagacagcgaccgttcggcgcacgatcgaagcggcgggagcgttcggtatcggtgccacgtatacgggcctcgatttcgcgacggcgcaggcacgcaagcaggacgtcgtcgccaagctgaccggtgggctcacgggactcatgcgttctcgcggcaacaccatcgtcgaagggcgcggtgtctatcgtggcggcggggtcatcgaggtcggcggcgagcggctcgtcggcgaaacggtgatccttgcgccgggatcggttccaaggaccatcccgggcttcgacgtcgatggtgaggtcgtcctgacctcggacgaggtgctctcgctgaccaagctgcctgacagcgtggtcatcatcggcggaggcgtgatcggctgcgaattcgcctccatgatggccgatctcggcaccaaggtcacggtggtcgaggcactcccgcaggtcctgcccggtgtggacccggatctcgtcggtatactgctccggagctttcggcgtcgcggggttacggtgcggaccggagtcggcgtcagcggcctcgaccggaccggttcgggtgcggtggttcgactcgccgatgggacgcaggtcgaggccgagcaggtcgtggtggcggtcggacgtcgtcccaacaccgacggggtcatcgaccctgcgagtggtgtgggcctcgacgagcgagggtttatcaaggttgatgaccagtatcggacctccgaagcgggggtgtacgccatcggtgatgcgatcgcgacgccacagctggcccacgtcggctttgccgagggggttgcggtcgtcaagtccatcttgggcgagatctccccgtcggtcgagtacgacaaggtgccctggtgcatctatacccatccggagatcgccttcgcgggtctcacggaggagcaggcccgggcccaggggcgtgacgtgatcgtcaagaaggacccgcttggtggtaactcgcgcgcccgaatcctcggcgagaccgatgggatggtcaaggtggtagcggaccgagcgacccaccagcttctcggcgtccacatcgttggcccctgggcaacggagctcctgtcgcccggctacttggcggtcaactgggaggcctcggcggaggaggtcgctgcgttcttgcagccccacccgaccttgtccgaagcgttcggcgagactgtcctcgcactgactggaaggagtctgcacgttggctgatgtcacgcttcctcaacttggcgaaaccgtcaccgaggggacgatcacgaagtggctgatcaaggtgggtgacaccgtcgagatcgaccagccgatcttcgaggtctcgaccgacaaggtggattccgaggtcccttcgcccgtctccggggtcgtcaccgagatcctcgtccccgacggtgagaccgtggacgtggggacggtcctgtgccgcatcgaagccgcggcgtcggctgcgtcggcatcatcggggccctcgacgcctccagccgcacaggccgctccggcgccacagcccgcgtcggcgccacagcccgcgtcggcgccccagcccgctccggcgccacagcccgcgtcggcgccccagcccgctccggcgccacaggctgcaccagtgccccagcccgcaccagcgccccagcccgcgccggtcgcgatggcaacgagcaccagttcgcagccagccccgagcacgcctcctgctccatcagcgcccgtgtcgccgtcgccgagcacggtcgaggccaacggcgtcgccgccggcagcggtcccgaacgagacctcgatggcctcctgctctcgccggtcgttcgtcgtctcatcatcgacaacggcctcgacccgcgagacctccacgggaccggcgtcggcggacggatcacacgaggcgacgtcctgcgcgccctcgacgagcgggcccggtcggctgcgggatcggctccaccggccacgagcgagccggccccctcggtcgccaacgagccggccccctcggtcgcccgtgaggcagcgccgcagccgacggccgcgtcggcgcctgagctctggtcgccgagccaggaaccgacaccgagcaaccgtgcccagcaggtcgtccccgtgtcggccatggagccgagcgaacgtgattacgtcgtgccgttcacgaacattcgacgccgtaccgccgagcacatgatccgctccaaggccacctccgctcatacgctcatgtcgatcgaggtcgacttcgagggtgtcgagcaggtccggcgacgtgtgcgtgagtcgttcgctcgcgacgagggtttttcgctcacgtacctgccgttcgtggtgcgagcctccgtcgaggcgattcgcgcctaccccaacatcaacgcctcggtgctcggtgacgccctcgttgtgcatcgggacatcaacatcgcgatcgcggtggatctcaacctcgaggggttgatcgccccagtgatccatggggccgacgccatcagattgcgcggtatcgctcgcgcgatccacgacctcgctgcccgagcgcgcagccgcaagctgagcgccgacgacatcgccaatggcacgttcacgatcacgaacccgggtccgttcgggaccttcatgaccggggcgatcatcaaccagcctcaggttgcgatcctcgcgaccgacgggatcacccgtcggcccgtggtggtcacggatgcccatggagcggagtccattgcgatccactcggtggggctgctcacggtcaacttcgaccatcgggcgatcgacggcgcctatgcggcggcgttccttgcgaaggcaaagcaggtgatcgagcagacggcgtgggagcaggagctgtgagcgacaccctgcgcgtccggtggctcgggcgaaccgattacgacgacgccctcgagctccagcaccgcctgcacgagggaacggggtcgtggttgctgctcctcgagcatccgcacacctacacgatgggggtgcgcgcgaagcgcgagcacgtgctggtggaccctgccgatgtcggagcacggctcgtgtggaccgatcggggtggtgacgtcacctaccacggacccggtcagctcgttgcctaccccatcgtcgacgtgccggtcgagcccgactcgacgccgcgctacgtccatcgactcgagcaggtgctgatcgagaccttggccgagttccagctcgctgcgttcgcgttggacggctacccgggcgtgtgggtcgacgccgcggcaccgcgcaagatcgcggcgatcggcgtgaaactcacgcggggtcgttcactccacggcatcgcgctgaacgtcacgacggaccttgggatgttcggccatatcgtcccctgcggaatccccgacaagccggtcacgtcgatggccgccgagggcgtcagggtgagtgtggaggacgtcgcgcgggtctttgcccgacgctttgcagtgacgttcggactcgaagcccgaagtgccggtgtcgactggccggtcgcccagccggcgtcgtccgagtcggccacctcgccggtcgagcggcgcttgcaacgggccggcgtctcgctcggcgaagcggttccgttccatgcgcgcaagccggcctgggttcgaccacgtgtccgtcatgggagcgaggtcctcgaactcaagcgtctcgtcggccaactgtcgctcgtcaccgtctgcgaggaggcggggtgccccaacctctcggagtgctggaaggatgggacagcgaccttcatgatcaacggcgagcgttgtacgcgtgcgtgcacgttctgtctggtcgacacgagccatccgctgccgctcgaccccggcgagcccgatcgggtggctgctgcggtggccgccctcgacctcgagttcgcggtcgtcacggccgtcgctcgtgacgacctggccgacggcggtgccgaggcttttgcgcgaacgatccgggcgatcaaactggcgcgtcccaccacgcgagtcgaggtgctgatcccggacttcaagggctcggcggcggcgctcgacaccgtgctcgaggctggtcccgatgtgctcaatcacaacctcgagacggtgcttcgtctgcagcgggccgtgcggccaagtgcgcactatgcccgcagtctcgcggtgttgtcccgagcgcagcgagccggattcgtcacgaagtccggcctgatggtggggcttggcgagtcgttcgacgaactccgtgaggcgatgggggatctcgccgccgcaggggtctcgatcctgaccgtgggacagtacctccgtccgacgcagtggcacgcgccggtcgctcggtactggcatcccgaggagttcgacatgatccgggactacgccaccgaactcgggttccgcttcgtcgaagcctcgccgctcgcacgctcgtcgtaccacgccaagcgcggatcggacgccgcgcaggtccttgcggagcgcgcgtgagcctggtcgagcgctacccggaacgacgtgcggcgctcgtcggcgagctcgtccgcaacggcgtggatgcggcgatcgtgaccatcggaccggagatgccgtggctgatcggctacgaagcgatgccgctcgagcgcatcacggccctggtcgtgcgtgccgatggcacggcggtcctcgtggtgccgcgactcgaggagccgcgggtgcgtcatcgcgacgggatcgacctcgtcgcctggagcgacgggcaagatccgttcgagctcgtggcagctctgctcccaccgacggggcgcatcgcgatcggggagcgcgggcgcgcgggatggctcctcgagctgcagcgtctgcggcccggctgtcggttcgagccggctggtgccctgatcggaccgctgcggcggcgcaaggaccccgacgaggtcgcggcgttgcgagcagcggggacggcagccgaccacgtcgccacggcgctcctggcgggcgagatcgcgctggtcggaaggacggagcgtgaggtgtcgcgcgacatcgccgagcggctgatcgcggctgggcatgcacgtgccaacttctcgatcgtggcgtcggggccgaacggcgcatccccacaccacgagcccggcgcacggcgcatcgagatcggcgacgtcgtggtgtgcgacttcggcggcacgttcgaggtcgacggcgagccgggctactgctcggacaccaccaggacgtttgccgtcgggacggccccggatgggttcgcgtcggtctacgacgccgtgttaggcgcgcacgacgcagcgatcgccgcgatcgtgcccgggatcgtagctggtgaggtggatcgcatcgcgagagagacgctcgtggaggcgggatatgccgagtggttcgttcatcggctcggccacggcatcgggctcgaggaacacgaggacccgttcctcgctcctggggccacgacgacgctcgaggtcggtgacgccttctcgatcgagccgggggtgtatctccccgggaacttcggcgtgcgaatcgaggacatcgtcgtcctgacggaacatggggtcgagcggctgaatcgctcgagcacgcagcggacggtgctcgaggcgcgctgagtcggccgccacgtgcgtcgcggtggcccccgtcgagcaggtgtgcgctcgataggctggcagccatggcacaacgcagtctctcccggcgtgcaacggcgctgggcgtcgtcgtcgtggtcgcggtggtggcgggcggtgccggcgcggtcgttgccacgcgcctctttcccccgaccgtccacctcgatacgccggtgtcccagctcaagccggggccagcgctggccggcggcgtatcgattcctgccatcgtgtcgtcggtcttgccagaggtcgtctcgatcgatgccactggcgatctcatcggcgtgacgaacggcggcccgttcggcctcggtggcggtcagacgggggcggagttcaagtccgccgggaccgggatgatcgtctcgacgagcggcctcgtcctcaccaacaatcacgtcatcgcgggcgcgacctcggtcgccgtcacgctggacggaacgcacacggcgttgccggccaccatcgtgggcacgattccgtcgcacgacctcgcgctcttgcggatcgaccatccgccggcccacctccacaccgtgaccttcggtgactcggctgcactggtcccaggcgatgcggtgatcgcgatcggcaatgcgctcggcctgcaggcgggttcgccgacggtcacgagtgggatcgtctcggccctcggacgggtcgtgacggcgtcgatcccgaccaccggccagaccgagacgctcgacgacatgatccagaccgatgccgccatcaatccggggaactcaggaggtccgctcgtcgactcggctggggacgtggtgggcatgaacaccgcggctgcgggcacgacgtcggacggtacccaggcggagaacatcggctttgcgatcccgtcctcggagctcatcgcggagctcccggtcctcgagcatggcggcacgtcgggagcccctggcgccttcctcggcgtcgaggtcgaagatgactcctcggcgctcgcggctcagttcgggctcccggtctcgcagggggcggtcgtcgtgtccgtcctccctggcaccgctgcggcgcaggctggactgagcgccggcgacgtgatcgtcgccttcgatggacacaaggtgacttcggcggcagcgctcggcgcgatcgaggagacgttgcaccccggcgaccaggtatcgctctcgtactggacgtcgtcgtctgagcgaacggtcaccgtgacgctcgggactcgcccggcgagctgactcgtcgcacgctactcgacgccgacgtctttggcccgcaggtgcatcccttcctgccagcgagcgagcgtccagagggcgtcggagagtcggttcaagtacgcgccgacgtgcgagctgggcgccgatgcgacgaagcggaccgcgaggcgctccgcgcgccgacagacggttcgggcgacgtcgagcgctgccgcggtcggggttccaccgggaacgacgaagtctcgaatcggctcgaagcgttcactgacgtcgtcgatgagccgctcgagccgctcgaccatcgccttcgtcacgagggtttcacccgggacgagcttgcttcggtgctcgggcagcgtggcgacttcggccatgaggacccacaggtcgcgttccagatcgagacagatggtcgcgaggtcgacggctgcactggccctgacgaccccgagctgggcttgggtctcgtcgacggctccgttgagctccacttgcgggtgatccttcggcagtcgaccgccatagagcatgccggtcgtgccgccatcgccgcgacgcgtgtagatcggcgtccggcgtcgtgctgcaccctccacgatccacctccccggtcccggtagcctagttgtcgtgaggacctacgaggagctgctgcgtgagcgtgtcgtcgtgttcgacggcgcgatgggcaccaacctgcagctggccggcctcggcgccgacgactttgggggtcccgcgctcgagggttgcaacgagatcctcgtcgtgacgaggcccgaggcggtggccgcggtgcacgactcgttcctcgccgtcggtgtcgacgtcgtcgagaccgacacgttcggcgccttggcgccggtcctggccgagtacggtatcgccgagcgtgcctacgagctcaaccttcgagcggcccagctcgctcgagacgtcgcctctggctatgcgacgcccgatcatcctcgcttcgtggcgggctcgatggggccggggacgaagctgccctcgctcggccagatccccttcgaggacctgcgagacgcctacgaggtgcaggccgagggcctgatcgcgggaggtgtcgatctcctgctcgtggagacggtctacgacctgctctctgccaaggcggcggtgatcggcgcccgtcgagccatgcgccgactgggccgctcggtcccggtccaggtgcaggtgacgatcgagaccaccggtcggatgctgcctggcacggaggttggtgcggcactcgccgcgctggagcgtctcgacccggtcgcgatcggcatcaactgcgcgaccggtcccgaggagatgggcgagcaccttcggtatctctcggagcatcagcgcgtgccgatctcgtgcctgccgaacgcgggcatgccccacgtcgtcgacggtcacatgcactacgacctgaccccggacgccctggcggcggcgcaccgtcgcttcgtcgacgaactcggggtcgggatcgtcggtggctgctgtggcacgcggcccgagcacctgcgggccgtcgtcgaggccgtcggtgaggcggtcccgagagagcgccatccgacgccacgggcacaggtggcgtcgctctaccaggcggtcgagctgcgacaagacctcgccatcactgcggtgggtgagcgcaccaacgccaacggctctcgccgcttccgcgacgccatgctcgctcgcgactgggacacctgtgtgcgcatggcgcaggatcaggttcgcgacggcgctcacatgatcgacctctgcgtcgactacaccggcgaggacggcaccgtcgccatggaggagctctcgagccgcctcgcgaccgcgtccacgttgccgatcatgatcgactcgaccgaagcggcggtggtggagaccgcgctccggcacctcggcggcaggccgatcatcaactcggtcaacctcgaggagggtgaggggtccaatacccggttcgactccttcttgcgcctcgcgaaggactacggtgcggcggtggttgcgacctgcatcgacgaggaaggccaggcgcgtaccgcggcgcgcaaggtcgagatcgccaagcggatcgttgcactcgcggtcgaacgctacggcttggccaccgacgacatcatcatcgatccactcgtcctcccggtgacgaccgggatggaggagtcacgacgtgacgcgctcgaaaccatcgaggccctgcggcgcatcaccgccgagatgcccggcgtctcgacgctggtcgggttgtcgaacgtctccttcggtatcaatgcggctgctcgtgaagcgctcaacagcgtgttcctcgccgaatgccaggcagccggcctgagtatggccatcttgcacccctcgcggatccagccgctcgctcgcatccctgaggatgtgcgcgcgatctgcctcgacctcatctacgatcgccgcggccagggcgacccgcttgcccgcctgatcgagcgcttcgcggacgtccaggcggtcgcggtcacgggcgaggagctcgaggccctctccgtgccggaacggctgcaccggcgcatcgtcgacgccaatcgtcagggcctcgaggatgacctggccgccgcgctcggcgagggcatgagcgcgctcggcgtgatcaacgacgtgctgctcccggcgatggccgaggtcggcgacctgttcgggtcgggccagatgcagcttccgttcgtgctcgcctcggccgagacgatgaagcaggcggttgcatggctcgagccctacctcgatcgcgcatcggtgaacgatcgaggcaccgtcgtgctcgcgaccgtccaaggggacgtgcacgacatcggcaagaacctggtcgacatcattctcaccaacaacggctatcgcgtggtgaacctcggcatcaaggtcgccttgtcggagatgctggcggccgccgaagagcaccatgccgatgcgatcggcatgagcggactgctcgtcaagtcgaccctcgtgatgcgcgacaacctggtcgagatgaacgaacgaggaatggcccacctgccggtcatcctcggtggcgccgcgctgacccgtaccttcgtcgagcgggacctgcgccaggtgtacgacggtcgggtcttctacggcaaggacgcgttcgaggggctcgatgtgctcgagcggttggggcgcatccgtcgtggcgagctcgacgatcccgagttcgggcgttcgatccggcagtcgagcacgaggacgccgcggctcctgcgacgctcgacgagtgagcgcaccgagcgatcgccgacggtcgcgatggacaacccgatcttccgtccaccgttcctcggcacgagagtcgtgaaggggatcgcgctggacgacatcgcggcctacgtgaacgagaccgcgctgtttcgtcaccagtgggggtatcgacccgaaggcgatgaggacgacgcggccttcaagcagcgcttgcgcgcggagctgcgccgtcagctcgaccgtgcgctcgtggaccagagcctggtgccccaggtcgtctacggctacttcgtcgcggcttccgagggtaacgacctcgtggtgttcgcggacgaggcgcgtgagcacgaactcgctcgattccgtttccctcgccaagagcaggagccgtacctctgtatcgcggacttcttccggccgctcgcggggcccgagatcgactacgtcgccttccacgtggtgaccatgggtccgcggatcacggaggtcgccaagcgggcgttcgacgagaatcggtaccaggagtacctcctcctccacgggctcggagtcgagctcaccgaggcgctcgccgagtactggcatgccaggatccgagcggagtggggctttggcgacgaggacggcccgacgctcgcggggctctttcgtcagcagtaccgtgggagtcgctacagctggggctacccagcctgtccggacctcgaggacaaccggacggtcgtcgatctgctcgatgccggtcgtatcggggtcagcgtgtcggacaccttccaactggagcccgagcagaccacgaccgcgatcatcgttcaccatcctcaagcgaagtacttcgtcgcctagcgagcggatcgccgaggggcgcatgacgcctaacgtggggccaacgaacgttcacggtgacgagacgagagggagccccgcatgggtgtgacgacgaacgtggtgagtggtgtcgaggctcgcgggctgcgggttcgactcgacgcagcgagcgagcgtgaggacgcctggcgcaccgagatcgtcggtgacgaactctggtgggtcaggggctacgacctcgaccacggcgcgcggggagccggggccgatgtcgtggcgctcgccgccgaccgccacgcgaccgacgtcagcgtcgatctggggtcgcacgacgcgatcgttgccgaggagttcgccctcggcgcgctgctcgcgagctaccggttcgatcggtatcgacacgcctcggcgccggctcagacctggcccaccgaggtcgtcgtgatgggtgacgtcgcgcgtgcggcgctccagcgggcgaggagtcgagcggaggcggtggcgttggcacgcgatctcgtcaacgagccgccctcgaggatgacgccgacggtcttcgcacagctcgccgagcaggtggccgatgcggcgggtctcgaggtgcgcgtctgggaccgtgcggcctgcgaggctgagggccttggcgggctcctcggtgttgcacgagggtccgtcgaggagccgcgggtcgtgcacctcgtctatcggcccggggcgcccaccggtgagccggttgcgttggtcggcaagggtattaccttcgactcgggcggtctcagcctcaagagcgccgacggcatgatgtccatgaagacggacatggcgggcgcggccgcgattctcgcggccatgtccgtcctcggtgagctcggctgtacgcgtgaggtgcgtgcgtacctgatgctcacggagaacctcccttcgggcagcgcgcaaaagcccggtgacgtgctcgtcacgcgctcggggaccacgatcgaagtgctcaacaccgatgccgagggccgcttggtgctcgccgacggactggcgctcgcggtggaggacggcgcgagcgccatcgtcgatctggcgaccttgacgggcgcgtgcgtcgtcgccctcggcgacgaggtcgcgggcatcatgggttcggatccgaatctcatcggtgcgttgcgcgcagccggtgaccgcgaggacgaacccctctgggaactgccgctgccgtcacgctacgaggcacacatcaagagcagcgtcgccgacgtgaagaacatgggcaagcctggcaaggctggggccatcgcggccgcgttgctgctcaagcgcttcgtcgggtcggttccgtgggcacacctcgacatcgccggtccggcgcgcgccgatggcgaccgagggtgggtgcgcgagggtgcgaccggtttcggggtcctcaccttgacgcgctggctgtgcggaccgacgctcgacgacgctgctcgttgacggcccgggtcaccgcctcgaccgtatagccctggcgaacgaggcgtgccgagacctcggcctcgctcgcgcccaggccgagcagggtcgcggtgagctggcggagcctcgcttcgcgtcgctgcgcgttggcgacctccgaggcgctcgggtgccaggcgtcgacgaggcgcagtgatgcggggagcgcacgacgctgacgcgcgctcagatgcggcacgggggaacggatctcgagccggtttcgttcgacgacgcgagccagttcgaaggtcgcgaggcgctcgatggcgcgcacgatcgagcgcaggccggtgtcgtgcgaacggaggccgaggctcgcgccgaggtcgtcgagccgtacgagcgcgggtccgtgctcgctgagcgcgtcgagtcggcgcaggagagcgagggcggtcggcccgatgaggggcagccacagaagttcgacctcgtcggagcgggggctccagccgggctcatgcgtgtgccaccggtcgatggtgagtgctggatcgagctgtgccatgggccatcctccatgatgcgggctcgggcctccctagcccgagcgcggatcggaacgtcctgttccgccttgcgccgtgtggcgcgcactccagtatgtcagctatgacgtttcatgtcaagcgatgtccgtccctacgagccgtcgtactcgccgaagactcctcgtagggtgtcggcgacctcgccgagggtcgcaccagcgcggagtgcagctcgcatgggatagagcaggtttccggtgccgcgggcggtggcggccaggtcatcgagggtgccagcgagcgcctcggcgtcgcggtgacgacgccaccgttggacccgcgcggcttggtcgcgctggaaggccgggtcgatggggaagacctcgggggcttctggctctggttcgcggtagcggttcacgccgacgatgatggtccgaccctcgtcgatggcggtggcggcctcgtaggcggagcgttcgatctcctcctgcatccactgctgttcgatcgcggcgaccgcgccaccgcgcgcatcgatctcgtcgatgaggtggcgtgcactggcctcgaccgcatcggtcagggcctcgacgtagtacgagccggcgagcggatccaccgtgtcggtcgcgccgatctcgtgggcgagcacctgttgggtgcgcagtgccaacttggcggcgtgttcggtcggaaggccgagcgcctcgtcgaagccgttggtgtgcaggctctgggttcccccgagcacggcggagagtgcctggagggtgacccggacgatgttgacctctggctgctgggctgtgagggccgatcctgcggtttgcgtgtggaagcgcatcagccagctccgctcggacctcgcgccgaagcgttcgcgcatgatgtgagcccagatacgtcgagcggctcggaacttggcgatctcctcgaagaggttggtgtgagcgttccagaagaaggagagccgcggcgcgaaggtgtcgacgtcgaggccggcggcgagcgccgcgtcgacgtaggcgatcccgttggcgatggtgaacgcgatctcttgggccgccgacgcgcccgcctcgcggatgtggtagccggagatcgagatcgtgttccactggggcaggcgatcggcgcagtaggcgaaggtgtcggtgacgagccgcatcgatggtcgaggtgggaagatgtaggtgccgcgggcgacgtactccttcaagatgtcgttctggatggtgcctcggaggtgctccggtgcgaccccttgctcttcggcaacgagttcgtagagcagcaagagaactgaggcggtcgcgttgatggtcatcgaggtcgtcacccgctcgagggggatgtccgcgaagaggcggcgcatgtcgtcgatggtcgagatggcgacgccgacgcgccctacctcgccgtgcgcgcgcgggtgatcagcatcgtagcccatctgggtggggaggtcgaaggcgacggagagacccgtttggccagcctcgaggaggaacttgaagcgctcgttcgttgcctccgcggtgccgaagccggcatactggcgcatcgtccatgggcgatcgcggtacatccccgcgtggatgcctcgggtgaaggggaaggttcctgggtcgcccaggtcccggtcgtagtcgaggtcggcgaggtcctcgggtcgatagacgcgtcggatcgggatgtgtgaggaggtgagacgctcgtcgtcggccacgggctcatcctaccgacgtctggtcctcgcgccacggcgacccggcgtcctcgtcgagcgctcgagcgagcgcgtaggctggtgcgaggacagcgcgacggtgaaggccgcttggcgcgtgagcgttgggcgcgacgaacgatcgtgatgccacgggaggagcgttgcgtggagcagctgagtgccgagcagttcacggcggtgcccacgttgagcgcgtgggaggttcgtgggcacgttgccgtgtgtcggttcgcgaccggtgacttcgcgaccggcgtgaggttgctcgaggacgttgcccatatcgctgacgccctcggacaccatccggacgtcaccatccgcttcggctcggtcgaggtggcgaccaccacctacgagacgggcggtttgacggaccgcgacgtcgcacttgcgcgtgcgatcacggagcttgctcgacggttggggctcacgcctcgagacgcgtagcaaccagccaccccgagctggaggaggccgccggtgaggctaggggcgcacggggtggggcaggcatagatcgtcgtaggcggcgatggtgatctgtgcggggtcgaggctacaagccggacacgccggatcgcggtggaggcggtagctgtggaaggtctccgcgagggcgtcgaaggtgaggaggcggcctgcgagggtgtcaccaaggccgaggatgagcttgatcgcctccagggcctggattgaccccacgatgcccgggagcacgccgagcacgccggcctccgcgcacgacggcgcgagctcggccggtggtggctcggggatgaggcaccggtagcagggcccgtcgtagggcgaaaagacggtgacctgcccctcgaagcggaagatcgacccgtggacgaccgggatcttgagcttgagggaggcgtcgttgacgaggtagcgggtcgggaagttgtcggtgccgtcgacgacgacgtcgtagcccgacaggatctcgaggacgttgtcggcatcgaggcgcaccggatgcttgaccacgcggacgtccgggttcagctgtgcgatcgcggcttcggcggagtccaccttggccatgccgacgcgatcgagggtgtggagcacttggcgttggaggttcgaggcgtcgacgacgtccatgtcgacgatcccgatcgtgcccacacctgccgccgcaaggtagagggcagccggggaggacaggccgcccgcaccgaggagaaggacgcgcgcttcgagtaggcgcagctgaccagcttcggagacctccgggagcagcaagtggcgatggtagcggcttcgctgctcaggggtgagtgtccggggcgtcgaccaggcccgtccctcgtccttccagcgattgaagcctcccgccatggagaccacgcgctcgtagccgagatcgccgagcgtcctcgcggcgaacgccgagcgtacgccgcccgcgcagtagacgacgatcggcgtcgacttgtcggggagtttggactcgaccacgagctccaggttcccgcgagggatgaacaccgccccggcgatcgcgccttgctcgtattcgtcctgttcacgaacgtcgaggagtgcccaaccctcgcgttggaggcgagcagcctcgtccgtcgtgacctcgtgtaccgaggccttggtctgaaacagcagatcgcgaaagcctgccacccctacgcacctccggaccgtccgccctgtagcttacggagcatcggcacgaggcgctgcgcctggaggtcgagcggcacgacgcggtcgcgggggtcgaggcgccctcgcctcgacggtgagccgtgcactggctcgggaagggggtggccgagcgcgaccgtgatgacgatgcggctcgtctgagcgagtccggcgaggtcgcgcagcacctcctcgcctcgaaaggtgccgatgacggctgccccaatgtcgagcgcggtcgcggcgacgaggatcgcttccagtgtggcgccagcgtcgacccaccagtaggggatgggccatcgttccaggctccagagtccggcggcgcgcttgtcgggggcaccgtagcgttcggcgtaggccgcggggtcgacggtgacgaggagcagggccggtgcgcgttcgagtcctcgcatctcgggacgcgcggccagccaccccggcgtcgtgagtgctgcgaggatccgggcgcggctctccggttcgcgcgcgatcgcgatggtgacggcctgtgtgaagccggcggacggcgctcgcagcccggcgtcgacgatggccgcgagcgtcgcgtcgtcgatcggatcggcagtgagcgctcggcgcatccgtcgccgccgaatcgcagcgagcgcctccacggtgctactcgatcacgacgacgatgtcgcccgtgccgacggtgtcgccggggttgacgcgcacttcgcggacggtaccggcgcgctcggccaagatggcgttctccatcttcatcgcctcgagcacgatgacgacctcaccagcgtcgacctgttgccctggggagaccgggaccttcaccacggtgccctgcatcgggacgctcacctcgccggagcccgtctgtgctgctcgggcaccggctctggccgatgagcttcgctgaggtcggctcggtgcattcggcgtgcgcggagcaggcgcactcggtgctgcggcgtcgagatagagcgtgacggcgacacgcttgccgttcacctcggcgatgaccggggtgggcacgagctcgtgagcgtcctgggatgcggtcgcgacgggggccacgccgcccaggtcgaggcgttcttccacccaacgggtcgagtgggttcctgcgcgaaagtcggggtggtccaagatggcgacgtcggccggtgtggtcgtggcgacgccctcgatgcggagctctccgagcgctcggatcgcacgagcgatggcgtggtctcgatcggcggcgtggacgatgagcttggcgaccaggttgtcgtagtactgcgagaccgtgtcgccggtgtcgtagccagcgtccacgcgcacccctggtccgtcgggccggtcgaagcgggtgatggtgccaggggtcggcatgaagcggccaccggcggggtcctcggcgttgatccgcacctcgatggcgtgtccgcgccgcacgacgtcgtgctgggagaagccgaggggctcgccggcggcgacccgaagctggagctcgacgaggtcgagacccgtcacgagttcggtgatcggatgttcgacctgcaggcgcgtgttcatctcgaggaagtagaacgcgccgtcttggtagaggaactcgacggtaccggcgttgcgatacccgcaggcgcgcgccacggcgcacgcagcctcgcccatcgcgcgccgggtctcgtcggggaagtgcggtgcaggtgtctcctcgatcagcttctggtggcgtcgttgcgcggagcagtcgcgttcgctcagccacaggaccgagccgtggtcgtccgcgatgacctgcatctcgatatggcgaggccaggcgaggtagcgctcgaggtagcactcgtcacgtccgaacgcgctgcgtgcctcgcgccgtgcggaggcgagggcctcggccgcctcgtcggggcgggtgacgacgcgcatgcctcgcccaccgccgccataggcagccttgatcgcgacgggccagccatgctcgtcgccgaaggccacgacctcttcgggatcgtccaccgggtgggtgaggccggggacgccggcgacgccagcggcttcggcggctcgtcgggacgagatcttgtctcccatgacctcgatcgcgtcggggggtgggccgacgaacgtgacaccggcctgggtgatcgctcgggcgaagtcggcgttctcggagaagaagccatagccggggtggacggcttcggcgccggagcgctcgatgatctcgaggagcttggtcgtattgaggtagctctcttggctggtgagcccgccgagcgcccaggcctcgtcggccatgcgcacgtggagtgcatcgcgatcggcgtcggagtacaccgcgatggttcgcagtccgagctccttggcggtgcggatcacccgaaccgcgatttcacctcggttcgcgaccagcagcgatgaaaacacgcgccctccttttgctcgccccgcgctcagggctccgccactcggcgactctagggtggagtccgtggcaggacgtcgagcgccctggcggctgatcctatcggacgaggtcgactccaccaatcgcgtcctcgcggctcgcgcccggtgggccggcgcgcacctggtggtggtcgccgatcaccagcgcagtggtcgtgggcgccgtggtcggaccttcgtcgacgtgcccgggggctccctgctcgtctcgtcgctccatcgctacgaggcaccggcgcgcccgatgctcctcggagcgtccgtcggtggcgctgcggccagcacgctgcgccgcctcggcgtcgcccagggagcgtggctgtggccgaacgacgtggtggtgggcgaggccaaggttggcggggccctgatcgaggcgtcctggcagggcggttcgctcgagttcgtcgtcgggttcggcctgaacctcgccggttgtcccgaggtgccaggtcgccagctcgccgacctcggctcgctcgctggccggtcgatcacacgcgacgaggccctcggggtctggctcgaggagctcgcgtcctggctcgagcgctggtctcggggcgatgacgtgctgggcggtgcgcgtgcgttgctcgcggggatcggcgaggaggtcgttgtcgaacgagctgcgggtgagcttcgcggacgtgtcgtcggattgggtccctcgggtgccttggtgctccgtcacgacggtgctacgttcgaggtgagcgaggcagacctcgtccgtctcgtccgctcgtccacgggagccactcgagccgacgaccaaggaggcacgcacgcatgacggtggagttctcgccggaacacgagcagctgcggtccgtggttgcggacttcgtcgcgggagaggtcgcgccgaacgctgccgcgtgggatcgtgaggagcgattcccactcgaggcggtgcgcaccatgggcaagctcggcttgttcgggatcccgttcccgtcgcgctacggcggcggggatggggacttcacctccttgtgcatcgcgatcgaggaggtcgccaaggcggactcgtcgctcgcgatcaccctctcggccggtgtcgggctcggtgcgagtccgatctaccgcttcggcaccgacgcgcaacgcgaacgctggctcccagccctcgtccggggcgaagccctcggtgccttcggcctgaccgagccggaggccggatcggacgccggcgcgacgcgaacacgcgccgagcgcgtcgctgaccgatggcgtctgcgcggcgagaaggcctacatcacgaactcgggcacgcccatcacctccgtcgtcaccgtcacggcgcgaacggacgaagggatcagcgcgttcatcgtgccggccgggaccgctggtctcacggtgctgccgtcctatcgcaaactcgggtggcgcgcgtccgatacccacggcatcgtgctcgaggacgccgaggtcggcgacgacgcgctgctcggagcgccaggggctggctttcggcagttcctcgcgaccctcgacgagggacgtgtcgccatcgcagcgctcgcgctcggtctccaggaggcgtgcctgcgcgagggtctcgagtgggcgaaggcgcgcaacgccttcggcggtccgatcggtcggtttcaggcgatcgccttcaagctcgcagacctcgaggtcgcggtggaggcctctcgtcatctggtctaccgtgcggcctggctgcgtgatcagggacgcccgtttgcgcgcgaggcggcgatcgcgaagctctatgcgaccgaggcggcggtgagcgccgccagggaggcgacccagatcctcggtggtgccggcttcatcgaggacaccccggtcgcgcgctactaccgcgacgcgaagatcctcgagatcggtgaaggcacctcggagatccagcgcttggtgatcgcgcgctcgctcgggttgagcccgagctagcatgagcgccgcatggatcggctcgtcctatgaaggcgctcgtcctcgctggcggttcggggacgcggctgcgtcccatcacccataccgcggccaagcaactggtcccgatcgcgaatcggcccatcctcttctgggcgctcgactcgatcgccgaggcgggcatccgtgaggtggggatgatcgtcggccacacgaaggacgaggtccgcgctgcggtcggcgatggctcggccttcgggctctcggtcacttacctcgagcaaccccagccgctcggactcgcgcacgcggtcagcgtcgcgcgtgactggctcggcgacgacgacttttgcatgtacctcggcgacaacgtcttgctcggtggcgtcgcgccattcgtcgagcggttcggtcgacccggccgtagcgaggacgcactcgtgctgctcgccaaggtcgacgacccgacgcggttcggcgtcgcggagttcgacaccgaggggcgcctcgtccgcctcgtcgagaagccgtcggtccccccgagcgacctcgcgctcgtgggcgtgtacttcttcagtccagcggtccacgacgccatcagccagattcgcccgtccgctcgtggtgagttggagatcaccgacgccatcgacgcgctcatcacgagcggacgcatcgtggacgcgctcgcggtcgatggtttctggaaggacctcggcgaccccgaggcgctgctggccggcaatcgcttcatgctgctcgggatcgagggttcggtcgaggggacggtcgtggactcctcggtggacggcccggtcgtggtcgagcctggtgccgtcgtggagcgcacggtggtgcgcggtcccgccaccatcggtcgcggggcccgcatcgtcgatgcgtacgtcgggccgttctctgcgatcggtcccgactgcgagctgcgggccaccgagatccagaactcgatcgttctcgccggcgccaggatcgatggtgtcggcccgttggacggctgcatcatcggacggagcgctgtcgtcgagcgccgaggccacctcccacgtgcgaccagcgtcgtggtcggcgaccactctcggctcgagctcgcctgagccgagaggcggccaaggtcggtcgctaggctgccgggcgcccgtcgagggtgcatcgcaggtgaggaggagtggcatgcggcttctggtgaccggtggagcgggattcatcggctcgaactatgtccacgagcgagtggcccgccacccagacgaccggatcgtcgtgctcgatgccttcacctatgccggctgtcgtgagagcctccgcgacgtcgatgaccacattcgcatcgtcgaaggcgacatcggcgacaccgagctcgtgagctcgctgctcgacgaggagcgcatcgaggtgatcgtcaacttcgccgccgagtcgcacaactcgctcgcgatcatcgacccggagcgcttcttccggaccaacgtgctcggcaccgtcggactgctcgaggccgcgcgtcggcacgacggcttggtgcgattccatcacgtctcgacgtgcgaggtctacggcgacctggagctcgacgaggagcgagccttcaccgaagacgacccctaccggccccgcaccccctacaacgcgtccaaggccggcgccgatcacgccgtgcgggcctaccacctgacctacggcgtgccgatcacgatcacgaactgcgccaacaactacgggccctaccagttccccgagaaggtgatccctttgttcgtgacgcgcgcgctgcgtgatgctcccctgccgatgtacgcatcgaaggagaatcgccgggagtggatccacgtgcgcgatcacgcggccgcgatcgaccgggtgctggaggccggcaccgtcggcgagacctaccacgtgggcaccggcgtcgagcgctcgatcgagcagatcgccacttcggtcctcgacctgctcggcaagccacggagcctcatcgaggtggtgcccgatcggccatcacacgaccggcgctacgtgctggactcgacgaagctgcgcaccagcctcggttgggagccgacggtcgccttcgacgaaggccttgcgtcgaccgttgcgtggtacgtcgagcatcccgagtggtgggagcccctgcttggccgtgctcctgtcgtcgaaggcgaggcctggcgccggtgagcgatcgcatcgtggtcctcggtgcgggcggtcagctcggtcggcggttggtgcgcgcgttcgagcgcaccagcgccgcggaggtcgtcggtctcgatcgtcgagcactcgacgtcaccgagcgtgtggcggtgcacggtgccgtcgacgcactccggccacgctggatcgtgaacgccgccgcgatgacggccgtcgacgcctgtgagcgcgaggtagagcgggcggttcggctcaacgccctcgccgtgcgttggctcgtcgaggccgccgagcgcgccggtgcgcgcgtatgtcaggtgtcgaccgactacgtcttcgacggtaccgccacgcgtccttatacggaggccgaccagccgaaccccatgagtgtctacggcctcacgaaactccagggggagcgcgagttgcgtcccgggatcgacagttgtgtgcggacctcctggctgatgagtgccgacgatcgttgcatgctcgggaccatcgaccgccttcgccgaggacctgggcccttgcgcttcgtcgaggaccaggtcggttctccgagcttcgcggacgacgtcgcgctcggcatcgtggagctcgtgcgtcgtgaggtgaccggcgtcatccacgtgacgaacgacggtcaggcgagctggtacgacgtcgcgagggaggcacttcgggcctttggcgacgatccacaccgagtcgagccgatccccacgacgcaactcgccggcagcttcgtcgctccgcgacctgccttctcggtgctcgccggggtcgtgcgcgccgcggtcgggctcgagcccctgcgaccgtggcaggaggcgctcggagctgcggtcagcgagcgtgctcgtggatgagctctgggcggtcgtggtcgactacgggggccacgccgacgactcgctcctcgatgcgctgatcgatgccggtgcggcacgcgtggtcgtcgtcgacaatgcactcgctgtggcgagctcgcgcaccgagccacggggccagggggtcgtcgagtttcggtcctacggcgccaacctgggcttcgggggtgccgtcaatcgggtccttgcccgtcgaggagccaggtggctgctcatcgccaacccggacatcgagatcgctccgtccgcgctgcggacactcctcgcgaccggcgagcgctggtcgcgagctggcatcgtcgcgcctcgactcgaagaccacgcaggccaaccccaggcgagcgtccgagcgttcccgagcctcgcgctcgcggcgctgcacggagcactcggcgtcgtctggccgtcgaatccggcgtcacggcgctatcggcgcgaagtgcccgatccgccgaatgcatacctggcgccgtgggtctcgggcgccctgatgctcgcgcggtgggaggcactgtcggcgatcggtgggttcgacgcgagctacttcttgtacctcgaggacgtcgatctcgcctggcggctcacgcgggccggttgggaggtcgtcgtcgatccgaccgtgcgtgtccgccacgtcgggggtgccaccacacgctcccgacgcgtggtggcggccctctggcacgcacgttccctggttcgctacgggctcgcgcaggaggacacggccactggcgcggcgttggtgctcttcggcgtgcttgctcgttgggcagtggtcgtcgtggcgtcgcgacgcagctcagcggacggatgagtcgctaacctagtgccggtatgcccaacccccaggaaggagctcggcgagtccagcgcgccaaggcggctggtcgaggggctcacgtaccgcgtgagattcccgtcgggttctacgctgccctcacgatcgtcgcggtgctcggcatcgctgccatcggctactcccgctacgaggtcaaccatccggtctccgcgacgtcgtcgcagtcgccgcctcgcgtcggccagacgtggtacaccgcactcgggatcgaggtctgcgggcacttcgagccggtgctcgccaagggttcaggtgctgcgagcggcatgacggccctcggcaacggggtcgtcaaggtcgcgccgaagacaccggccgagaccggcgctgcggcgacgctcgtgcacttcctcgacgcggcgggcgtgcgcgtctcgacgtcgagcgtcgtcctgcctgggcacgcgagcatcgacgtcgcgagcgtgtgcggccagcggccggtcgaggtgcgtacggcgacgtgggcatccctgcttgcgactcggccgacgatccatgcggggacaaccggtgtgcgcatgctgagcggcgaggtcgtggccgtcgcggtggtgaccaagggcgcgacgatcgcccagcctcccacggccgccaacctcgcgaacgtctaagggtcacccgaggacacgcaagaaagtacggagggcgcgtgcaagcgatcatccttgtcggcggggaggggacccggctgcggccgctcacgctgcatcaacccaagcagatgctgcggttgctgggctttcccatgctcgagcgcgtcgtcgagcgtctcgccgcgatcggcgtcgatgaggtcgtgctgtcgctcggataccagcccgatgcgttcatcgcgcgctatcccgaccaccgcatcggcacggtcaaggtgcgctacgcggtcgagccggagccgctcgacacggcgggcgcgattcgcttcgccgtggacaagggcaacgtccacggcacgttcttggtcgtcaacggcgatgtgctcaccgacctcgacgtcgcccagctcgtcgacttccatctcgatcgaggcgcactcgcaacgatcggcctcgtggaggtcgatgatcccagccgcttcggtgtggtcgtcaccgacgaccggggccgagcggtgcgcttcgtggagaagcccccgagggatcaggcgccctcgcacgcgatcaacgctggcgtctacgtcatggagccggcagccatcgagcgcatcgccgttggcgagcgcgtctccgtggagcggagcctgttcccgcagctcgcgagcgaggggacgctgtgggggctcgcgcagcggtgctactgggttgatgcgggcacaccggcgagctacctgcgtgcggcgctcgacatcgcaacggggcggcgcgcggcgagagtgcgagagggcgtgcggttcccggtcgagagtcgaccccccggtggcgagacgtgttacctcggagagggatcgcaggtcgcgagcgacgccgtcgtggacgccgcgatcatcgaggacgatgtcgtcgtcggcgacggggccgtcgtgcgatcgtccatcgtcctcgagggcgcgcgactcgcacccggggttcgggtcgagcactcgatcgtcggagccgagacggacgtcccggaggccgtcgagctggtcgatctcgcggtggtcgcgccgtccacggagctcgcccccggccagcgactcgctggcacccgatgagcgaggcgccgccggtactcgtcacgggcggggcgggctttctcgggtcctgggtggtcgagcgcttgttggcacgcgggctgcgcgtggacgtcgtcgatgacctgtcgacggggtcgctcgagaatctgcggcgagcgcgcgaccgacacggcgcgcgactcacggtcgtcgtcgaggacgtgacgagtgccgccatcgggtcgctggcggagcggcggggctggcgcagcatcgtgcacttggctgcccgagcgagcctccgcgcatccacgctcgatcccgtgcgcgacgccgaggtcaacgtcctcggtaccgtgcgcgtgctggaggctgcgaagcgggctcgctcgcgcaaggtggtctttgccgcctcggcggcgatctacggcgaccagcgggcgttgccgattcgcgaggaggcgccgcttgcgccgatgtcgttctacggcgcgggcaaggtggccggactcgagtaccttcgagcggctcgacacgtccacgggacggcgtccacgagcctcgtcttcgccaatctctatggtccgcgccagcgcgctgagctcggcgcggtggttgcgcggttcgtcgacgcactgctcgcggggcacgcgcctgtcgtcgtcggtgacggcacgcagacacgggacttcgtgtgggtgggggacgcggccgatgcggtggtcgccgcgctcgatcgggccgatggggagatgatcaacgtcgccaccggcctcgagacctcgatcgcgggcctcgcacgactgctcgtcgaggtcgccgggatcgacgggctccacccggtgcaccagggacgccagtcggtgggggaggtgcaccgcaacgcgctcgacccctcccgcgcggcgcacctgctcggctggcgaccatcggtccgactcgccgatggcctcgcgcgcacctgggcggctgcgctggaggcgcggcgaatccgcgaggcggcgccgaggtcctgagcagcgctgatcgagctcagtggtcctcgcggcgggcgccgagctctcgatctgccccttcgcagcgcggtcttgacctcgtctggctgctcagaagcccacggctcgccgcggtgctcttcgaggtcggcgcgcccggcgtgggcgtcagcgaaagaggtctcgagcgctgtcgcgcacgatggcgcgggcggacgactcggcgagccaggcggggtcgatgcctcgcacgacgctgaagggcgtgccggcagccttcgtcgcgacgagattcgccgccgctgcgatctcgtcggcgatgcagacctcggtcacgcgcaaggttgcgccggtccagtcggcggtgccacgcaggtcgaggattgcccgaacccccgccaccccgatggcgacgtcggtgaccccctcgcgccacgctcgaccgaaggtgtcggtgacgatgacaccgacgtggaggttccatgcaaagcgcaggcgatcgcgaatccgacgcgccgagcgatccggatcctccgggagcagcacgagcgcatgtgcgggggcgttcgaacggtcgataccggcgttcgcgcagacgaagccgtggtgggtctccacgatgcgcgtggtgccacgcacgcgcagcaccctgcgcgtctcggcagcgagtgcggcctcgaacgcctcgtcgagatgctcggggtcgctctggatcacgcgaccttcggccttggagacggccttttgcgacacgcagacgacgtcgccgtctgcgagctcgccggtcgcgcccaggagatcgccaaggttgtccccggcgcagatctcgcgatcgatggggatcgaccagatcgtgagccgtctcatcggtcagaacccaccacttggacgagccgatccacgaggtcggcgcttcggtcggggtcggcgatcatcgtgtccatcaccacggcccgcacgccatggcgttcgacgtcgccagccagtgcgccatcgcggtggtcgacgacgagggtgccggcgtacggtgcgtagagctgggccacgctcgttgcgctcggttcgaggccgaagtcggccatgatggaggctgcagggcccttgatggcctggcctcccacgatcgggctgatcgcgaccgttcgatcccgtgcgtcgcgcacgaggtcgccgaggtcgccgagttcgaggatcggaaagaccgagaggaacgggttcgagggcgcgatgatcacgagatcggcctcggcgatcgcggtccgtgcatcgggatggggacgcgcggttgcgatgccgtcgtagcggatgcgttcgacgtggggttggtgtcgcatggccacgaagtactcctggaatcccacctcggcgaccccgtcgtcggtccgtaccgtgagcatcgtcgccacctcgtcgtcgctcatgggtacgaggtcgatgtcgatccccagtcggcgcacgacgtcgcgggtgatggatcggaggccctcgcctcgacggagccggtcggttcggtagaggtggaggccgatgtcgcggtcgccgagcgtgaaccacgtcggtcccccgagccgtcgcagcatggtgagcgccgagaaggtctcgggagcgatcccccagccggtgtgggggttcacgaggccgctcagtgtgtaggtgatcgtgtcgaggtcggggcagacgcgcacgccggcgatccatgtgtcgtcaccggtgttgacgaccgcggtggtcgcgggagcgagcttgcgtcgggtgacgccagcgaggaggcgagccgcgccgaccccgcccgagaggacacagatgcgcgggtttggagtcacggccacgaggctaccggtcgaggtgtgacccgatcggcccagagcctcctcggtagactgcgcccgtgctgcgcgtgagcctcgacgtcttgcccctggtgggcgcgaggacgggcgtcggagagttcgtctggcacctcgcgaacgcgcttctcgaggccggcgtcgacgtctcgggctggggtgtgacgtggcgaggccgcgaccggctccgagcggccgtgcccgccgagctccgtgtgcacgacgctcgtctgcctgctcgtccgctctgggcggcgtgggcacggtggcgatggccgtcgatcgatcgcgtgttcgccgacgtcgacgtcgtccacgcgaccaacttcacgctgccgccgctgcgtgagcgcccgagcgtcgtgacggtccatgacctcaccgtcgtgcaccatccgaactggtgtgatcgcgcgacgctcgtctatcccaagctggtcgcggctgcagtgcgcgagggctcgttcgtccacaccccatcggaggcggtcgctcgcgaagtcagggcgtggttgggtctcgacgccgatcgggtggtcgcggtgccccatggcgcccccggggcgccggttgccccgcccgcggcgccagcgaggatcgcgcggctcgccgggcgccgctacgtcctcgcgctcggaaccctcgagccccgcaaaggtatcgacgtgctcatcgaggcgttcgcgcacgtcgccgagcacgagcgcgacctcgagctcgtgctggctggacagtgggggtggggggtcgacgccatcacctcggcgctggtggccagtccggtgcgcgcacggatccgggtgctcggctacgtcgatcccatcgagcgagcctggctgctcaccaacgccgccatgctcgcctacccgagtcgctacgaggggttcggactgccgcccctcgaagcgatggcggccggcgtcccggtcgtcgccagcgacgtgcccgcggtacgcgaggtggtcggctcggcggcggtgctcgctcccgtcggtgatgcggcggcgctcgcagcgtcgatcggccgcgcgctcgtcgacgcggaccgtctgcgcgcactcggcccgagccgagcggcgcagttcacctgggagcgcacggcgcgcgccatgatcgagctctacgagcgggtcgcggcgacgtgagggtcgacatcgtcgtcgagcagctcgcccgtccggcccccggggggatcggtgtgtgggttcgcgaagtcaccccacggctcgcccgacgtcacgccgtgcgtctggtcgcgtcgcgctcggcgcgcctcgacggtgtagtcgagggggccacgacggttcgacggatgccgttgcccgagccgatcgcacagcgtgcgtgggatgcggggctctggggggcagatccgtccgccgatgtggggctctggctgtcgttcggagggccgccgatcgcgcgacgaccgccctcggtggtggtggtccacgacgtgatcttcctcgagcatccagagctctacacgaggcgaggggctcgctggcacgtggcccaactcgaggcggcgctcgcccgtgcgacgcggttggtcgcggtcgatcccaccgtggccgatcggctggtcgcgctcggggcacgagatcgggtccgcgtcgtcgctcccggggccgaccaccttcctccggccgatgcagagggcgcgcgggccgtgctggcgcgagccggggtcgagcgcccctacctgctcgtggtcggtacgctcgagccgaggaagaacctgggtcgcctcgtcgaggcgtaccaggcctatcgcgcgcgatcgttcgaccccgtcgacctcgtcgtcgtcggcccggctggctggggcgacgacgctcggcgcggtcccggggtgcacgtgctcggcacggtggcggcgccgatcctggcgggtctgctcgtgcaggcgagagcgctggcctacgtctcgctggtggaggggttcggcctcccggtcgtcgaggcactgcacgccgcggtgcccgtggtggtgtcgacgaccgtgccggccgcgcgtttcggcggcgttggcgtggatccctacgacgtccggtcgatcacggatggtctcgccgcggtgctcgacgacgaacgggcgcgctcgcggctcgtgagcgagggcttgctcgccgtcgagcagctcaggtgggaccgtacggccgacgcgctcgccgacgtgctcgaggaggtcgccgatggctgagatcgtcatcgatgcaaccagcatccctgcggaactgacgggcgcgggtcgctacgcggtcgggctgtgccgtgcgctcgccgcgctcgaggggcgtccggacatcgaggtcttcacgaccggtgcggcgcgaccccacttcgtcagcgacgcccccggctgggcggtgtcgacggcagccccgcgccacagggtggcgcgcctcgccgcccaggaactgctcgtcggccggcgtgcacgccgccacggagcccgcgtcatccacgggctgcactaccagctcccgagggcacgtggggtcggcctcgtcgtcaccgtgcacgatctcacgctcatcgagcatccggagtggcacgatcgcgcgaaggtcctctactttcgcggcgccattcgctcggcactgcgacgtgcgcacgccatcatcgtgccctcggaagccactcgcgagggtcttcgagcacggttcgacccgcgcgttccggtccacgtggtccaccacggcgtcgagggcgttcctcgactcgaccatcgccttgcccgccccggtcgacgcagcctcctcgtcctcggaaccctcgagccgcgcaagaacttggtgcgcatcctcagggctttcgatgcgatcgccgaggaggagcccgacgtcatccttcgcttcgtcggcaagcgaggctggggcctcggcgagttcgacgcgacgctcgctggccttcgccatcgtcgtcgcgtcgaggtgctcggcttcgtctcggacgaggcgctcgcaggctacctctcggaggcggctgcgctcgtgtacccatcgctcgaggagggcttcggtctgcccgtgctcgaggcactcgccgcggggcttgcggtcgtgacgtcgaaggactcggtcatggaggaggtggcgggtgggttcgccaccctggtcgaccccaccgatgtcggctccatcgcccacggcatgcgccaggcgctcgacgaggcacgtccgacggaacggatcgaggcgcagatcgcctgggctcggagcttcacctgggagcgcgcggccgagacgaccctcgcggtctatcgggaggtcgccgggctctagcctcctcacgcatgcgcgcgctcgtcaccgggtcacggggattcgtcgggacgtggctgcgggcacacctcggggccgccggcgacgaggtcgtcgagctgccggccgatctcgacgtcacggatcgagccgcgatcggtgcgtggatgcgaacccacggcgccgcgatcgaagcctgctatcacctcgcggcgcaggcgagcgtcgccaggtccttcgaggatccaggccacacctggctcaccaacgcgctcggcacgcagttcctggtcgaggccctgtccgaggcggcgccggccgcgacgctgctcgtcgtgtcctcgtccgaggtctacggtgcaccggcgcccgatgagctcccggtcgacgaggacgcgccactgcggccgacctcaccgtatgccgcgtccaaggtcggtgccgaggccgcggggctggagggagcctggggccgtgggcttcgggtcgtgatcgctcgaccgttcaaccacatcgggcccggtcagtccgaggcgttcgtgatcccgagtcttgtgggtcgggtcgtcgaggcgcaccgcaacggagagcgcgtgatccgtgtcggcaacctcgcggctcgtcgggacttttccgacgtgcgcgacgtggtcgcggcctatcgagccttggtcgtcgatgggcacgatcgcggcgtctacaacgtctgttcgggccaggcgtactcgatccgggaggtgctcgaactcatcgtgcgagcagccgatgcgtcactcgaggtggtggtcgatcccgcactgctccggcccgtggacgtgcccgtgatcgtggggaatccggcgcgcctcgtcgcacacactggggtgcgctttcaccactcgctcgaggcgacgatcgaagagctggtcacgagcgcacttcgcggaccaacggcgacgggagggttcgtcgatcgctagcgtggaggcctcatgtctaccgctccacgggtcgcggtcgtcgtcacggcgttccgtcctggtcgctacgtcgacgagtgtctcgcagcccttgcgcatcagagctacccagatctcgacatcacggtggtcgacggcgccggtgacgatcgtgaattgcgcgacgccgtggccatggcggcacccagggcgcgcatcgtcgatggaggaagctgtggggggtacggagcctgcgcgaacgcgggggcgcgggtgcaccccgacacaccgttcctcgtcttcgtccatgacgacgccgtgctcgcgcacaacgccatcgcgtccatggtcgaggtggcctatgccgccaacgccggcatcgtgacgccgaagctggtcgccttcgacgatccacgcagtctggtgacggtcgggtgggatctcgacccgttcttcaacccgaccgctcgggtggaggcgggcgagctcgaccagggtcagctcgacgaagtcgtggacgtggacgccgcaccgggtgctgcaatgttggttcgtcgtgacctcttcgacgccctcggtggcttcgacgaggtcttcggcctcatcggggaagacgtcgacctgagcgtgcgcgctcgactcgctggtgctcgcgtcgtcaccgctccgcacgcccgcgtccgacatcgaggggtgcgcatggagcggctgcgacgcgcgcgccgacgccgccaggtcggcgcccaggtcctcgaggagcgcgtcggtctgcaagatgccgagcgggtctggcgcaggcgccgcgcctcgcgcatcatgatgtcgagcctgtacgacggcccgatccgcttggtgctgctcctcctgtttgccacggagcgcatcggcgagctggtctggagggccctcgcgggttcgccgtcggcgggtgtcgcgggactgcgggcgctcgtgctgtcgcgcgacgaccgcgtggcgctccggcgtcgtcgtcatggcatcggcgagcgcgctcggtcgcatcgcgtcgtcgcgacgcgcacctggacaccgggggagcgtctcgtggccgtcggggcccaagcaggtactctctcacctgggcccacggatgcgccccccaagcggctcgcacggtgggtgccgcgctcgggctcggctcgctggttgctcctcgtcgcgatggtgattggcctcgtctcagcgcgaggtgcgctgacggcctcctcgcccggggggagcctcctgggtggagtgagcggcctcgcgttgctcgatgcctgggtccacgctcgggccgttccggcggtcctcggggccggcgtggcgccggtggggaccgcgttcatcgggctcgtgtcgctggtgttcggcggtgacgtcggactcaccgtgcgattggcggtactcgtcggcgcactcgtggcgcccgtcgcggtggctcggctcgctcggcgcgagttcgacgacgtgcgctccagtgcgctcgcgctcgtgtggtcgctcggtccggccttggcactcggcatcgccaggtcctctctgtcgctcgtcgctgcgtcggcgctcgcaccggtgctcgtcggcgccacgctcgctgccacccaaggacagcgtctcagtccgcgtcgcgccaagcgtgcccagcggcggctcgggctggttgcggccgtcgcgctggcgttcgcgccagagctcgtcgcggtgtggctggtggtcatcgctgccgaggcgctgtggtgggcccgtgcggcagacgcctaccgactccggcgtctcgggcgcgcgctcggcatcgcgggcctcatggcgatcggcatcaacctgccctggctcgcggccctcgtcctgtggcatcctggggtcgctgtcgtggcccacggcgtgccgggagcgcgagtgcagtcgctcggggcgcacctgttcggcggaggctacctcgctggcccagcaccgtggctgtacgtggcgctcggtgcgatcgccctcgctgcgggcgtcgagcgcagcgaacgagccagactcgcggtggctcgggccgtcacgggtcttgccctcagtggcgtcggggcgctggcgatgctcggtggccttggctcgacgccgatccagccggcctacttcgacgtgctcggtggcctcttgatcgtgctggcggtgccgactggtgtcagcgcggcccaggcgtggctgcgccgcagacgcctcggactctggcatctcgtgggggtggttgcggcgctcctcgtcgccatcctcggccttggttcggcgctgtcggcgctcatcgcgccggcggagccgatcgcgctgccgaccgccaacctcgcgctcgctggcgggttcttcgcccgtccggtgccgacgttgtggatcgaggtcgggcccggcggacctgttggtggcgcagcggtcgccgccaacgtgaccgttgcggtcaccacgggtgcggagccgagcttcctcggccagttcggtccgccggtgacggaggggtatcggcgcatcgtgccctcgattctcgatgcgctctctggtcacacggtgcaactcggcgcggtcctgcgaaggctcggccttggtgaggtcgtggtgctggacgcatcgcagtctccgctcgccagtgcagtcacgctcggcgtcgagcgccaggtcgacctgcgtcagctcctcggaacctcgtcgatgactatcgcggcgacgacgggggtgcctcggccggtcgccgcggcggcaacaccgccgtggttcgtggtgagcgagctcatcgcagcgggggtgctcgtctggtcggcagcgagcgtgttcgggatcgaggagcggatggtgaggcggcctcggctgcgcatgcctgctgcccccacgaccagggtcgaggtgctccagtgacgcgctggtcgcgcaccccgacgatcggggtgctcggcgtcgtcgtggtcgtcgcggcgacggtcgcggcaggactcgcgccggcacggccgcgcccagcggtgttcgcgcttcccgggcaccgctcactgagcggtgcgaccgtgctcggggcactcactcagccagcggtcgtggccggtgcgtcctcggaggcctggtactgcgtcgccccaccgttgctgccgctcgcggcgtccacgatcgcgctggccaacctcggtgcgagggcacgccacgtggaactcgtgcccacggccagcggtgctcgcccgatcgccgtcgtgcccctcgcggcgggcgcgatgacgtctcggcccgtgggtgtgcgtgggttctcgatcgtcgagggacctgggggcgtcgcggcgacggtggtgagtcacgagagcgcgggcgtccagagcgagccgtgccagagcactgcgagcgatgcgtggaccgtccttggtttcgacaccggcgcgggcgatcgcgccgtggtgcgcatcgccaacccgttccagacgactgcggtcgtcaacgtcgatccgatcggaccgtcgggtaccacggtggtcgcgtcgacgcaggggatcgtcatccagcctggccagacggtgaacgtggacgtagccaagctcgagccgggcatgacggacgcaggggtcgtcgtcggcgcgaagaacgggcgcgtcgtcgtggtcggagcgacgcggcccaatggcgcgatcgcgccgatcgtgctcgatccgcaggcgacgcaggggcgatcgctcgtcgcgccgtgggtgccggtggtcggcctgcgcaacctctcggtagtgctggccaatccgagctcgagcgtggtgcgagcctcggtgcgggtcgtcggccttcgtgggaccgccggatcgacggcttcggtcgcggacggacatggcgtgagcgaacgggtcgtcgtgccgagcggcgccacggtggtggtcccgctcaccgccgaggccctcgcggagccgtcggccggggtgcagctcagcgtccacacgagcggcggtgctgtgagcggggtcgtggacatcgagcgccgcggtgtcctcgacgggcgcagtgtgatctccctcgagcaggttgcttctcgcgggtggttcctcacgtgcccatcgagtgcggcgatgtcggcgctcgccttcgacgaggttggagcgagcgcccagctcaccatcgccgcccacaccgctgcgagcggtgcgcgatccttcgagacgaacctgctccacgcgggcgtcatcggtcttggcggcgttcggggcgtcgcctggtacgacgtgagcgccaccgagccggttgccctctggccggtcgcttcgtcgaccggctgtgcggtgctcggtgtggtcggtccgctcgattagtcgaacctggtccaggcctcggcccagaggcgctcgtagccgacacgtgcgaccagctcgatcgcgtcggtcggtcggctgggctcggctccaccctcgagcaggatgcgcgccatcgccgtgggtatgggatagtcaccgggggtctcggcgatacgagccagcccatccgggggtgcctgggagttcggtccgagcggtccccaggctccccaggcgcgcagcaccacgacgaggagcgctgcgggaccaagggtccgattgaccacctgctcggtggcacggcccggggggccagcgatccagctcgccccgaggtagtcggcagcgacgagccgtaccgggccgaaggtcgtcgtgaggtgtgccgccatggcgtcgagggacggaccatcctcccaatcgagcaccccgtcgacgagggacgctcgaggctcgagcgcgcgcgcgacggccagcaggcgctcggggtcgaggatgcggcgtcgtaggatcatgcgtcggcccgatcctgggtggtcggcaagccgaggcgccacaggagctcgcgctctgtcgagacgagggcgagcggtgtcgccgtgagcggagcctcgaggatgcgagggacgagcggcgcctcggcttgcccggcgacgatcggagcgaccgtcagcgagagttcgtcgatgagacggcgttcgaggagggtcgcaaggacggtcgggccgccctcgacgaggaggtggccaggggcgctcggctcgacgccacaggcaccgaagaggtcggcgcgcgtgcggatcttgtcgaggtcgacggcgcgagctgcgaagtcaggcgccgtggcgcgggtggcgatgcagatcgggacctcggtgcccccgatgccgaggcgcgctcgcagcgaccggagctcctcgttgcgcaccagcgcgggtccatagccctcgtcgcgagccgtggcagaccctacaaggatggcttgggccgtggctcgcaggaatgcgagggccgaacgatcggcctcgctcccgaggccaccggagcggccgtcgatggtggctcgcccgtcgagcgaggcgatcaccaccgcaatgacacggcaggtccctggcgcaaagtggcggccgaggagcgtggtcgggatccgtccggtcggccagtgctcggtcttcacgatctcacgctagccggctaggctcggttcgtcgtggagctgttcctcgggcgcccggccccaccagcgacgtcgacagcgttgatcgacgaactcgtggtgccgcgcgcgctggtcggggcgacgttcgacaactacgagccgaccgacgcctcccaggtgcgtgcgagagacgccgtgcgtgcctgggtgagcgcgatcgaggccccccgcccccggcgtccgtggagacggcgccatgggcggagggcaccgatggggatctacctcgacggtcccttcggcgtgggcaagacccatcttgcggcggctgcggtggcggctctcggcgatcgtgcacggttcagtgcgttcggtgacttgaccgcaatggtgggtgtgctcggcctcgagcgggtggtctcgctgctcgcggcctctcgcgtgctcgtgatcgacgagttcgagctcgacgatcccggcgacaccgtgatgatcgccaggctgatcggtgagctcttcgagcggggcacagcggtgctcgccacgtcgaatacgctccccgagcggctcggtgaggggcgcttcggtgctgatgactttcggcgcgagatcggccagctggaggctcggttcgaggtggtgacccttcgtggcaccgactggcgtcagcgccgcttcgacgcgctggtcttcgatcggcccctcgtgccgacgcgactgcgtgacgacctcgagcaccggcggggaacggagctcgtccgggaactcgttcgggtgcacccggttcgctatcgcggcgcgattcgcgggcaccccgggtgggtcatcgagggaccggtaccgctcgatgaccaagatagcgcgctgcgcctggtcgccttcgtggatcgagcctgggaggaagacgtggcggtcgtgctgcgcgaccagccgctggcgaccttgttccgtgagagctggctcaccggggggttccgtcagcgctacggcagggccctctcacgtctcgtggcgctcagcgaccgtggcggtccgcagcggcaggctgaacctggccatggtgcccccggttggtcggcgctcgagacggaacgcgccgccgagttcgtgggcacgggcgctgagattggcgagaccgtgcccgagggtggccccgtcggagtcgaatccgacgccgtcgtcgtcgacctcgagggtcaccgtccgcgcatcgacggcgatgcgtaggtcgacgcgctgggcttgggcgtgcttgacggcgttcgtcaggagttctcgtaccgcggcgacgaggtgtggccggagcgaggcggcgaccgcgaagtcgacggggccatcgaaggccacgctccgtcgcatgccggtcgcggcggtcaggcgctcgacgaggtcgagcacctcgccgcgcagtgacgttcggcgggcctgttcgaggtcgaagatggtggtgcggagaccctggatggtcgcgtcgaggtcgtccatggcgttgccgaggagttcgagggcgtggggcgcctcgatctctcggagcgccgcttggatggtgaggcccacgccgaagagccgctggatcacgtcgtcgtgcaggtcgcgtgcgatgcggagccggtccgtcgtcacttcggtcgccgcgagctcgtcgcgcagcgcgaggctctcgatgacggcggcgagggcggtggcgagcgcctcgaggacggcggcgtcgacgaggtcgaatgggccgccgtccgcgcggtcggcgacatagaccgtgccgtagatggcgtcacgaacgctgatcggtgcgccgaggaaggaccgcatcgcagggtgggactcggggaacccgacgctgcgagggtgcgtggcgatgttggcgatcgcaacgacgtgatcacgtgcgagtccgaggagccccttgccctcgggaagggaggcgatctggtctgcggtggcggggtccatgccggaggtgacgaagcgagcaagacggtcggggcgatctcgctgccacacaccgatggctccgtaacgggcgttcgtcagccctcgcgcggcctgggcaccgaggtcgaggagttcatcgaggtcgtgggctcgaaccaaggcgatgacctgatcgaagagcggccggagccgtcgcgccggaattgcctgaggcacctcgactagcctagcgatggcgctcagacggtctcggacgtcgcgtcgagttggagggcggtgccatgatcttgctggaagagaccccgatcgaagccgaggtacccgagatcggctcgggcgcctggcggggggtgcggctcctgcgtcgccactgcccggtcttcggcaccggcacgcgcctgatcgagggcgccaaactgaccggcacggggtccgatctcgcaccgctcgtggccgaaggggggttctgccctttctgtgccgatgtcatcgaggaggcgacggctccgttcccgaccgagatcgccgtgacgggacgcatccgtcaaggcacggcgtgggtggtgcccaacgtgctcgcgtactcggcggtgtccgccgttggcgtctatgaccccgggcgccacgtgctcgagctcgccgatttcgacgaggacctcctcttcgacgcctttggtgccatgctcgagcacgcccgagccgttcgtcgcctgagacccgagctcgtctggtcgtcgatctcggcgaactacctgccgccctcggggtcatcgttgctgcatccgcacctccagagttcacacgatccggtgccgcttgcggcccaagcgatcctcgaggcgaggagcgaggcgcactgggcgtcgtttggtcgagggttgctcgacgaactcgtggagctcgagcgcagcgcgagcgcacgcttcgttgcccagaccggtccctggtcgtggatcacgccctttgctccaagcggcttctacgaggtctggggcgtgcacgagcgcctgggcgatctcgtcgcgctcgacgaccacgaccgccgacagctcgcaggcgcgatggccgccgtcctcgccagctatcgcgccaagggtctgtcgagcttcaactaccagctgctcggggccggcccgcgtgggggcgagttcgacgttcgtgtgctcgtgcggatggtggcgcgtaccccggcggccccctggtaccgtagcgacgtcacctacttcgagaagcttggtttcgaggcgatgatcgatcacacgcccgaggcgttcgccgcggagctacgtcagacgttcggcacggggctctaacgacggggctcaagtcagagccctgagacgtccgatacctgcttcgttcaggcggtgtggcctcaggaggcatggatgcggacgctggcacagaagttgctcatcgcgatcgtgacgctcgcgatcgtcgtcgggattggtggcgccatgacggtcgaccaggcgctcgcctcgcggactcaagcacgcgtctacgcggccgaccaggcgcggctcgaggtgttgtcgcagaccatcacctctgacttctacgcctgggacgatcagatgaacatgtacgtcctcacggcgctcgcgacgccaggacagcacagcctgatcgctcagacgtaccagcaggcagcccaagccggcgcccagctcgaccatgacctcggcgtcgctgcgtcgctcccggcgacgcccgcgatccgagctgacctcgcacgggtcgcacgcgatgcacgggcctatggcgggtatgcgcgagaggtgcacgcggcggtcctagccggggcgacgagtcgagccgcctacatccagacggtgggcaacctcgcgccgtccaacgacatcatggtcgcgctctcgaacctcggccgcgacgcacggatcgacgcatcgggcgcactggccaacgtacgcgccaaggcagcctcggcggcgacctggaccgccatcagcttggcactgctgatcgtgctgctcgtcgcgctcgtcgtcgggatgcgccgttacgttctcggaccactgcgtgcgctcggcgcgtcgctgtgggcgcttgccgaggggtcgacgacggtcgagcggctcgatgagtcgcgggcggacgaattcggtgagatcgcaagagccttcaaccagttccggggaaggctcctcacgctggtggaccgcgtggccgcttccgtcgggacgttgctcgagagcgcccgcgaactcaccgaggtggcccaaggcctgagcgatggcgcacgcgagaccgcggaccagaccgccaacacggtccacgccgcccgggacgtcaacgagcacattcaggcggtcagcgtcgcagccgagcagatgcgcgtcgccatcagtgagatcgcgcgttcggcggccgatgcggcgggggtggccgctggtgcggttgacgtcgcaggcgcgacccaggggcgtgtgcaggccctcggcgagtcgtccgccgagatcggtgaggtgatcgcgacgatcaacgggatcgcggagcagaccaacctgctcgcgctcaacgcggcgatcgaggcggcacgcgccggcgaggctgggaagggattcgcggtcgtcgcgagcgaagtcaaggagctcgcgcgcaataccgctcgagcgaccgaagacatcggagccaagttggaggcgatccgctccgagagtctggcggccgtcgaggccatcggtcggatcagcgaggtgatcgcgacgatcaacgacctgcagtcctcgatcgcttccgcggtcgaggagcagtcggtcacgacgaacgagatcagtcgggtggtcgagctcgcgacccgctcgacgggggatatcacgcgcgcgatggaagacgtctccgacagttcgcgccgcgcggtcgactcggtcgacagcgcaggcacggtcctcgcccagctcgtcgagctcgcgaattcactcggagagctcgtcggggtcgcggcgacacggagccgcggcagcgatggtgccgcacggttcggcctcgcgcgtcacgacgccgatcgtagcgagtcgttcagcgcggtatcgtcgtgaacttgagctcgttgatctcggggtgatcgtcgaaggtcccgaggacgtggtcgagcgtccggcgggcaagcgcaccgtcgccattggggcgggtcatcaggcgtacgaacgcagctcggccgtcatcgaggatgacggtgggcacgccgaagacgcgaaagcgctcgacggcatcgtggtgtgcttcgccgagggcgcggatcgcgcgaggttcttcggcggccgcgagcacgctgggcccatcgagcccgctggcggtgagcacgtcggcgaggacctcgcgatcggcgaggtctcgcgcttcgtcgtggcgggctgcgaagagcgcccggtggacgcgcgcgaaggcttcagggtggcgatcgcgaacgaccacgcccgcgctgagcgcgagcagctggtcgcgcttggactcgtccgcgaagacgctcgtgccaccttcggggacatggacctcgaggagcgagaagggaacgaagtcgacgttccacgacgctccagcctcgagggccgcgagcacgtgctcatggaagttgcgggcgaatgggcaccgatagtcccacgtgacggcgaagtgcatggcgtacctccttcgaccaggctaacggctgcggggagaacgcgtgcagatgcaattacatgccggggctcggtgccctgagcgcgcggaggagctcgacgtcgccgccgtagtgcaggagctccggtgcgtcggccagggggatccaggtgacctggtcgacctcgacgccgtcggggcgaagctggcacggggccggcgcgagcatgaggaaccacgtcacgaccttgatgcgtccgtccgcgaggcgatagcgcgcgacgccgaccggcgcgatcgggaccgcatcgacgccggtctcctccgcgacctcgcgcagcgcacaggcgaggatgggttcgtcatcgatggccttgcccttcgggagtgaccaatcgtcgtagcgagggcggtggacggcgatgacggtgtcgtcggatccgatcacgatgccgcctccggcacgcaccagcccggcacggaccggctcagccacgccgacgccctcgacgagcgtcgccgggctcgaggtgctcgatcagtcggcgggcgaacgtgccgtaggccagcccgaccgcgatgccgccgagcacgtcggaggtgtggtggatccggacgtagatgcgcgacagcgcgaccgcaccagcgagcggcagcagtgagcgccgctgcgcaggcgtgcggccaagcagcatggcggcggcgaaggcagccgaggcatgaccgctcgggaagctcgaggtgcgcggatagcggagtccgagtgggtggggatgatcgcgatcgatcgggcgatcgcggtggaagacgctcttgacgacgccgttcacgagtacggactcgagtccgagtgcggcgatggtcagaagcgcccgacgacgagagcgcgcagagagcgcctgcacgcccgcgatgagcatccacaagatcgagtgatccgcgagtgccgtcagcgtgtagaacgtcacgtcgacgatccggtggccgcggagggcgtcgatcctgcggtcgatcgcggtgtcgaaggtgtgcagtgggcctgccgcggtgctggcgctcatcgggcggctcccatcgccgggcacacgtcacggtgtgggcagctcccgcagagccgtgaggggcggggcggaaagtcctcgcggtcgcaggcccgctcgatcgcgtgccagagcgcgcgaaggcgtgtggcgaccccgcggagcatctgtgcgctcggtgcgcgttcgatcacgctgccgtcgccgaggtagacgaggcgaacgagacggggtacgcggccgaagagcaccgacaccagcagggcgtaggtgaggacaccgccgagccgcgcgtcttgatgggacggtgggggggtccgcccggtcttgtagtcgacgaccacgaggtcgccctcgtcgtcgaggtccaggcgatcgatgaccccgcgaacgtggacgccctcgatggtggcctcgagacgcagttcggtgccgattgcccgaacgcgcgcgggatcttcgaggtcaaggatggtgcgcgagagggtggtgatggagcggtacagtgcagcgcgttctcggtcgtcgagctcggccacataggcaccgagctcgtcgtcacaggcggcggcacggaccgcggtgtccaccgcttcgttgagcgcagcttcggatcgacggtccggctctcgtcgatagaagtcctccagggccgcgtgaaccaaggtcccgaccgcgagcgggcgggtcggtggggttcgcacgccgtcgatcacactgcgccgaaaggcaaaggggcagtcgctgaacgccgtagccttggtcggggtcagggtcgctggcggcgcgagaggcatggcccaaggttaccgaggcggctcgagcggtgccgtcgagagccacgagcgaacgacgcttgcgacggcgtcgggatgctcgaaggggccgaagtggccgacgccgtcgacgatcgcgcagctcgcggacggcgcgcgttgggcaacgagtgcgaggtcctcggccgtcatggtcgtcgaggcggcgcccgcgaggatgagcatcggtgcgctgatggtggcgacgaggtcgagcgccccggtcgtgatgccaccgcgatacatcgcggcttcggcagcaggggcgaagcggaggcgaacgcccgcgtcgtcgctgacgaggcacgtgtcgaggtaggcctcgagcacgcgtgggtcgaacgaggccatcggcggcttggcgccgagccgttcgcgtgctgcttcgcggctcacaaaggaggctcgccgacgcagcgcgccgtcggcgagcgcgttggcctcggccagctggcgtgcgttcgtcgggtcgatcaggatcggctcaaaggccaccagtgcccgagcgggcacggaggcgcgtgagagtgccatgatggcagcggtcgcgcccagggagtggccgaggatcaccggggcgtccgcgaaccgcccgagtgcgtcggcgacggctcgtgcaaagacgttccagtccgtggcatcccccgggggtgggtcggagtcggcacctccgtgaccagggagatccagtccgaatgccaagccaccgagcgcttcggcgagtggtgcgtagcaggcggcgctgaaaccgcccgcgtggacgatcaaggtcgagatggccctggcgctcgccgagatcggtcgatgcagcaggacgaggttgggcgctggcagttcactgctccttctcagggactttcggtgcgacgtccaccacgttacggctaccatcgcggatgtgacccacctgatcgactcgctggtgtctcgcgatggcttgatcgccatcgtcgttctcatgacgctcgagtctgcgctgatcccggtgccctcggagctcgtgatgtcgcttgccggcttctttgcctacgaggggcatctcagcctcgtcggcgcgatggtggcgggcgtcgtcggcaacgtggttggttccgtcgtgctgtgggtcatcggccgtaccggtgggcgcgctctcgtcgagcgcttcgggcgctacgttctcctcaagcctcgagacctcgatcgcgcggagcgttggttcgccaagcacggcgagtcggcagtgatcgtctcgcgactgctgccggtggtccgatcggtgatttccttgcctgcgggagtggcagagatgcgggtggggcgtttcacgctgttcacgctgatcggttcgatcccgttcgtcgtggcgctcacgcttgccggctatttcctcgggagcagctacgagacgatcgtgcgcatcgtccaggactttggctacctcgctgccgtcgcgatcgtgctcgccgtggtcgccttcgtggtggcacgggcgagggctcgacgccgtggggccgaggcggcctgacccgagcgaggtctagactctcgcgtgcgcgggaagtggcgcagcttggtagcgcacctgctttgggagcagggggtcgcgggttcaagtcccgccttcccgacggccacagccacgcgggtgtagctcaatggtagagctccagccttccaagctggtggtgcgggttcgattcccgtcacccgctccgcatcggcgcttctgggcgcacgacccgacggtcgtgcgcagggggcgcgggcacgatcgaggcggtcgcgttgtcgctcgttcggacggattcgcgagcctcgcgcgtgccgacaccctcgggtcgtggcgggtgccgaagaacgtcagcggtgcgccggcatgagcgcacgcaaggactcgtcgtggctctggtgactcgcggctggccgtcgccatgcctgatacctggtagggtataaggagcggacatgggacgtgaccggtctgaagtcgagttgctgggtcggatttcgttcatgccgtttcgtattgcgctattatcagtgcgatagcagagaccgaaggaggcccccggtggtgcaggtcgtgcgccctagtgatccttccgaggagcttggcgctccgtcgctggactcggtcgtcggcgagggtgtcgacggacgcgtcgtcggcgatcagccggcaggcctcgacgagtccgaccctcggagcggagaggtcggcgacctcgttcgacgtctctcgcgcatcgaaggccagatccgcggcatcaagcggatgatccaggacggtcgcgactgccgcgacctcgtgacgcagttcgctgcggtctcgcgcgcgctcgagcaggctgcgttgaactacgtcacctcggagctggtgtggtgcgtcgagcgacctgacgaggccgctgagcacggctacacggtcgacgagctgcgaaagctgctcggtcgccttcgttagtccggtcagcgggccggcgcccccggtatgattggtgcgctatgcgctctaccacctctaccagcgatgatcgccgatcagccaccgtcaccgtcgagttcgagagtgacgaactcgcctccaagttcgacgaagtcctcgcgcgcctgcagcagcaggtgcgcctgccaggcttccgtcgtggcaagatccctcgtcagctcctcgttcggcgcatcggcgaagaggagctggtgcgcgaggctgcggaggcgttgatcgaggagcgcgtcggagatctcctcgccgagagcggtctcgacgtgatcggccggccggcgttggcgcgggtcgaggcgcggcccgagggaggtgccgaggccgagctgcgggtcgagctgcgtccgagcgtcgaggtcgcgggctggcgcgacatcgaggtgcgggttccggatccccgcttgacgagcgaggaagtcgatcgcgtgatccgtgagatcctcgagcagcgtgcggaggtccgtgacgtcgatcgtcctgtcgccgaaggtgaccaggtcaccttgaacgtgtggcgtgtcgagtccgacgggaccgaggcgctcgtcactccggacctcgtcgtgcgcctcgggcgaggtcaggttcctcgtgacatcgaggaggcactcgtcggcgccgtcgtcggcgctcgcgtcgagcgaccggtgccacacgagacgccgaccgacgctggggccacgaccgacgccgaggcaggggaggccggcgatgccgaggatgcgtcaccggccgacgcgccgccccaggccgccgcggatgcgccgagggagctctacgaggtgcgtgcgatccgggagatcgtcgttcccgaggcgacggacgagttggtggaggaggtcacaggccagccgacactggcggccttgcgcgaggccgtcgaaggagacctgcgctcggctcgcctgcggcgcgcccaggaagccttcgaggccggagttctcgcggcgctcctcgagaggacggagccgaagacggtgccgaacacgctggtggaccccgtctttcagcaggagatccgccggttcggctcgtcgctcgatgcgtcgggaatctcgctgcgtcgctacctcgatctcaccggccagagccgcgatgacatcgcgaggagcctgacggagcgctcggcggagacggtcctcatcgatctggcgctgcgtgccatcgctcgcgacgcggatctcgaggtcaccgacgaggagttgcgcgcggaggtcgatcgcttggtcgcgacgggccagattcgcgatcgcgaggaagcggcgcggccggcgatcgagacccagctcgtcgctgacgttttgttgcgcaaggcgctcgcgctgctccagcgggaggtgcacgtggtcagtgagtcgggcgaggcgctcaccctcgacgatctcgagctcgcgaacgccatcgcagacgtcctcggcgatgcgcctccgaccgctgaggaggagcttcctggttcgatcgccgaggaggcatcgacgcccgcaggttccgagaccgacgacgctcactaggatcgctctcgtggatcgaccgctcgcgcctcgtaactacctcgtcccgaccgtcatcgagacctcgtctcggggcgagcgggcttatgacctgtactcgcggttgctgcgcgagcgcatcatcatcctcggcacgccgatcgatgatgcggtcgccaacctggtgtgctcgcagatgctctacctcgagtacgaggaccccgaccgcgacatcaatctctacatcaactcgccaggcggggagatcaccgcactgttcgcgatctacgacacgatgcgcttcgtgcgaccagacgtgtcgaccttctgcttcggtcaggcggcctcggcggcggccgtcatcttggcggccggtgccaagggcaagcgatttgcgctcccgcacgcgcgcatcctgctgcatcagccctacggcggtgtcggcggccaggcgacggacatcgaaatccaggccaaggagatcctgcgcatgcgcgacctcctgaacgagatgctggccgaagcgactggtcaaccggtcgagcgcatcgcccaggacaccgatcgcgatttcgtgctcgaggctcctcaagcggtcgagtacggtctcatcgacgaggtcgtggtcgcgcgcgaggctcgttgaaccagcagcggaccccacctccgcgaccatgacgcgctaggctggacgagtccgcaccgttcgaaggaaggtgggcgatggccaaggtgggcgacgggcaagagatcgtcaagtgcagcttctgcggtctgtcgcagaagcaggtgcgcaagctcatcgctggtccgggcgtgtacatctgcgacaagtgcatcgagctgtgcaacgacatcatctctgaagagttgggcgagccgaagccggaagcggtcacgcaggaacgactgccgaagcctgccgagatcatggagttcctgaacgcctacgtcgtcgggcaggagtctgcgaagaagatcctctccgtcgcggtctacaaccactacaagcggatccggtccggcgcgaaggatgacgtcgagctccagaagtcgaacgttctgctgctcggaccgaccggttgtggtaagaccttgctcgctcagacgctcgcgcgcatgctcaacgtgccctttgcgatcgccgacgcgacggcgctgaccgaagccggctacgtcggcgaggacgtcgagaacattttgctcaagctgattcaggcggccgacttcgacgtgaagcgcgccgagaccgggatcatctacatcgacgagatcgacaagattgcccgtaaggcggagaacccgtcgatcacgcgtgacgtatcgggcgagggtgtccagcaggcgttgctcaagatcctcgaggggaccgtggcctcggtaccgccccagggtggtcgcaagcatcctcatcaggagttcatccagatcgacacctcgaacatcctgttcatctgcggtggtgcgtttgtcggtctggacgagatcgtggctgcgcgccttggacaccggggcatcgggttcaccggctcgctcgccgagcgcgatgggggtgagaacatcctcgcccgggtccaaccggaggacctcttgcgcttcgggctgttgccggagttcatcggacgactcccgatcgtgggcactatcgagaacctcgatcgagacgccctgatctcgatcctcaccgagccgaagaacgcgctcgtgaagcagtatcagaaggtgctcgcgatggacggcgtcgagctggagatcacgccgtcggcactcgaggcgatcgcggatctcgcgctcttgcgcgggaccggtgcgcgcggcctcaaggcgatcatggaagaggtcctcctcgacgtgatgttcgaccttccctcgcggtccgatgtccagcgctgtgtgatcgatcgtgacgtcgtgctcgagcacgcggctcccacgctggtgccgatcgatccggcgagcgagccgcgccgccaggcctcttgacgagcgatctcgcgcggtcggcggacccgcgtcgttggctcggtgagctccccgacttcgaggccgatcgcagcgtcaccgttcatggccctgccgtggtgcgggccgccctcgatgcgctcggcgcacccgaccgggacctcgtcgtggtcagcgtcgcgggcaccgctggcaagggctcgacggcgacgctactcgccgcgctcctcgcctcggttggcgtgcgagctgcactgttccgatcgccgcatctgtgtcgatgggaggagcggttcgtcgtcgcgaccgagccggtcgaggcggcggccatcgacgaggagctcgagcagatccgcctcgcgagcgaggcgggactgctcgtcccgttgacgcggttcgaggtcgagacggtcctcgcggtccagctcgcggcccgcgagggctgcgaggtcctggtggccgaggccggactcggcgcccgcgaggacgccaccagagccctcgagccggcgctcgcgatcgtgaccgccatcggtgacgatcaccgggccgagctcggcccgacgctcgagtccatcgccgctcacgagctcggcatcgccgcgggtgccccgacggtcgtgctcggcgagctcggcgccgtcggggaacgggttgcggcgaggcagctcggtgccgttccgagggtccggcgtctggggatcgatcgagccatcgtggagcgccacagcggcgtggcggggcagtccgtcgtgctcgacgacggccgtgagctgctcttgcccttcatcgggcgaccgggtgcgcagagcatggtcctcgcggtggtcgcgctcgaggagctgctgtcgatctcgctggaggcggcccatatcgatgcggtcgcgcgtcgtgcggtggtgcccggtgtcccgtggctccatcggcagccggttcgtgcggtgagcgatctcgcgcacaatgccctcgcgatccgcgcgctggccgagaccgtggcggagacgttcccgcccgacctcacatggcggttggtcatcggcctgacgcatggccgcgatccgcgtgccgtcttcgaaggcctcggcacgctcaaggtcgacgaggtcatcggggtcgacgtgggtgtggcgacggaggtgcttggcgaggcggcgcgcgagctgtggccgtcggcgcgctggcggagcgcggcgagcgtggaggaggcgttgtccgaggcgccggaggacgacgtgtggacgctcgtgaccgggagtctgcgaatcgtcgcgccgctgcgctgtgccgaggcgccgtcggggatcatcgcggtcgactaggctcctcgtcccgtatgcagcgcacgcttgtcatcttgaagcccgacgccgtcgaacgaggactcgtcggggagatccttgcccgtctcgaggcaaagggcctgcggttcgagcgcctcgaactacgccagctcgacaaggacacggtgcggcgtcactacgccgagcacgaggggaagccgttctacgacggtctggtcggcttcctgacgcgcggccccgtcgtggtcgcggcggtgactggtcccggggatgcggtcggcgcggtgcgggctctcatgggtgccaccgacccggcagtggcggccccggggacgatccgcggggatcttgctatgctcatcgacgaaaatctgatccacgggtcggactcgccgggcgcagccgctcgtgagctcgcgctcttcttcccggatcatcagtagtagctcaccaccgacatgcctgaggtcgcgatcggccaccacaggggaggttccagatggccagcgtaggaaagatgttcggacgcgatatcgccgtcgacctgggaacagcgaacacgctggtgtacgtgcgcggcaagggcatcgtcatttcggagccctccgtcgtcgcgatcaacgtcaacgacgggcgtccgctcgctgtcgggctcgaggcgaagcgaatgatcggacgcacgccatcgaacatccaggccattcgtccactcaaagacggggtcatcgcggacttcgaagtgtgcgagaagatgttgcgctacttcatcggtcgggtgagcgcgtcgaaggtctccaagccccgcatggtgatctgcgtcccgagcgggatcaccggtgtggagcgccgtgcggtccaggaggcggcggagtacgcgggcgctcgtaagcctgcctacatcatcgaagagccgatggccgccgcgatcggcgcgggtctcccggtgcacgagcccaccggcaacatggtcgtcgacatcggcggtggaacgaccgaggtcgcggtcatctcccttggtggcatcgtgacggcgaagtcgatccgcgtcggcggcgacgagatggacgaggccatcatcgcgttcgtgaagaagcaccactcgctcgccctcggggagcgtaccgccgagcagatcaagatgacgctggcgtctgcctacccgctcgaggaagagctgcgggcggagattcgtggtcgcgacctggtcaccggtttgccgaagaccatcaccatcaccaccgaggagatccgggccgccatcgaagagcccaccagccagatcgtcgacgccgtcaaggcgacgctcgacgcgacaccgccggagctcgccgccgacatcatggagcgcgggatcgtcctgaccggtggaggggcgctgcttgcgggcctcgatcggcggctgcacgacgagaccggcatgccgatcgttgtggcgaagaacccgctccagtgcgtcgcgatcggttctggtcagtgcctcgaggagttcgacgccctgcgccaggtgctgatcacctcgtctcgctgatcgagctcgtgtcgcgactgcttgcgagacctcgctcgaccctgctcgtcctgctcgtcgtcgggttgaccctggtgacggtgagctttcgatcgccgaacgcgtttcgtttgggaaccgtccgttcgctcgtcactgacctcgtgaacccggtgcgcaacgccgtcgacggcgcgtttcggccgttggcatccagcgtgcgcggcgcggtcgactaccagcaagccgaggccgagatccgcacactgaaggcagaggtcgcccaagccgaactcgcagcccgggagcaccaagctgctgtggcacagctcgatcagctctcccggctgctgcacttgccgtgggcgggctccatccccgtccagccagcggaggtcatcgggaccactccgtcgaatctgcagctgtccttcgtgatcgatcgcggcagcgctgcaggggtcgcggtcggtaatcccgtggttggtggcggtggtctcgtggggcgtgtcgtcgcggtgacgtcgtcgacggcgacggtcctcgagatcaccgatcccacgtcggtcgtcggcgtgcggctccccgggtcgggtcaggtcggtgcgatgacgggcagggggcttggcgcgccaatgtcggtctcgctcatccagccaggcacgccgctgcggcgaggggcgatcctcgtcacctccgggctccagggggggctctttccaccgggaatcccggcggcgcgcgtccggtcggtctcgaacccgttgaacgcgctccaggagcagatcagcgttgttccgctccagaacctgtcgtcgctcgcctacgtggatgtgctgcgttgggtgccgacctctggcagcggcgcatgaggtacctccgtgcgctcgtggtgctggtgctgctcggaaccgcgctcgtcatccagaacaccggcctcggacaggcgacgatcctcggggtgcacccagatctcgtcatggccatggtggccgcgatcggggcggtacgaggacgcgagtcgggcgccatcgctggctttgtcggtggtatcgcggtcgacgccttcctgtcgacgccgttcggcctgtcagcgttgatctacgtcgtcgtcgggtatctcgctggtgaggtggagcgcatcgacggcggcgcacccctcgcggtgcgctggatcgtcgtcggcctggcgagcctggtcggggagggcctcttcgtcgttgctgagttcctgctggggcttgcgaatcctcttcagaccaggctggtagaacagatcttggtcgttggcggcgtcaacttggtcatcgctccggtggtccttgggctcgtgcgcttggccttcgtgtcgacgccgtcgaccgtgagttgatcagggagcgtgcgatgcctcgacgtcgacgtcgcagccgtccgggctcaccaccaaccggcccgaggacgtcgttccgagcacgagtgctcggacttgcgaccctcgccctgttcggcggtctgctcgcccggctctattcgttgcaggtcctcgaagcaccgacctaccaacaggcggcggtcgagaactccgtgcggaccgtgtcggttcctgccccccggggcttgatcctcgaccgcaacggcacggtcctcgtcggcaaccaggtcgtcgacgtggtcggcctgtcggcctacgaggcatacctgcatccggcggtcgttggtcggctcgccaaggtgctcggattgagcgccgcgcaggtcaaggcggatctcgccaactcccagtactcgacctacgagcccactccgatcgccacgggcgtctcgcaggcgaccgcggtgtcgatcgaggagcacgcggccgagtttccaggcgtggtcgtggagctcgagacgcagcgcacctacccacagggcgacacggcggcccatatcctcggctacgtgggtccgatctcgccctcgcagctcgccaagctcgccaagtacgggtacgcggcgggagaccaggtcggtcgtgcaggggtggaggagacgttcaaccagtacctccacggtcgcgccgggtcggagcagctgctcgtgaacgcatttggtcaggtggtcggggtacgcaagcgggtcgccccgacgcccggcggcaatctcgtgctgtcgatctcgctgccgctcgagcgctatgtcgagcaggtgctcgcgacccaggtccgcaagctgtcgaactcctacaacagctacttcgggcgctacaccggcaacctcggcggggccgcggtggtggaggatccgaacaacgggcagatcctcgccatggcttcctatcccacgtacaaccccgagtggtgggtcgggggcatctcgacgcagcactacgcggagctgaccagcgcgtcggcgaacgacccgctgctcaaccgcgcgatctccgcagccttcacccccggctcgacgttcaagctcgcgaccgcttcggcggcgctccaggacgggctgatcacccccagcacggtcatcgacgacacgggccagttccagatcccgaactgcaccggatcgttctgctcgctccacaactcaggtggtgaggcgctcggccccatcaccatcacgaccgcgctcgctgcctcggacgacgtcttcttctacacactcggctaccgcttctatacgcaggcggcgcagttcggccagacgccgatccagaacatggcggctgcgtatggctggggtaagccgacgggcatcgcgctccccggcgaggtctcgggcatggtggactcgccccagctgcgcaagtacctccacgagcactatccacaggcctatccctacgacacctggtacgtggccgatcagctggagatggcgttcggccaggggctcaccgagatcacgccgatccagctcgccaacgcctactcgacgttcctgaacggcgggactcgctacgttccccagatcgccctcgcggtgacgaacgaccagggccgtgtgatccagcgcttcgcgcccaaggtggcgggacacgtgacgctctcgccgacggtgcgccagacgctcatccagggctacgaggaagaggtctccaatccgctgggcacgggctactacgtctggcagggttggcccgatgccagctacacgatcgccggcaagaccgggacggcgtccgtgtccggccaggtgccgaactcgtggtacgtcggcatggggccgatgcagaacccgcagtacgtcgtggtggtggcgatccccaatggagggttcggcgatctcggtgcgggtccggtggcgcgcgagatcttcacgtacctccgagcacacccggtcggcgccccgaactaccaggtctcccacctcgctgcgggatcgatcacgccagtcgggcagctcggcaggacctcggcgggctaaactgccggtgagcgtccccttggcctacccagcgtgactgcgagagtccgctcgcggtgggcacggggcttcggattccagtggggcgcggggtcgatcggagggtgatgcggtgagcaagcgtgctcagctcccgtgtcctcgtgtcgacccgtgggacatcgtctgggaagccgccatcgccgcatccgaatggacggcccccgacacgagttcgatggtggtccgcgggcccaggcggcgttcgcgcgtcggtctcgatgcgcccggtcgctcgcgcgccacccagcaaccgagaagagggtttcatggtcgatcagccaacaccgacggaccgtgggggtgcgggtcctgaaggagcagctccaccgcctcctccaccacctccaccacgagcgccaaaggctgcctcagcgccggccacctcgagcgctcaaggtcaggggcgacgacgtcggtcgcgaggagctcgccgcggctcagcggcgtcgagcgctctcgacgccacgtcggaggccgtagcagagacctcgccagccgatcggcccgcgagcgcagctggcgggcgcccagatggcctcggcgacgacgctcccgcgaacggagccgacggctctgggagcccggctcagggggccccgggtggagagggtagtggcccatcggccgagggttcgcgacgtcggcgttcgcgtcgcggcggccgcggtcggcggggtcagggaaccccgagcgaggcccggagcgagccggtgatgatggagatccaggcgccgctcgccgagccctcctcgcagcgtcaggggcgccgtagggcccagagtcgcctcccgagggagcggcgtggccgaccggtcgggcgctaccagatggccgtgcatgtccacggggacgtcacgcacgtcgcgattctcgagggtcgcagcttgatccagcacgcggtctctcgcgcgagcgacaccgagacgagcgtggtgggcaacatctatctcggacgggtggtgaacgtgctacccggcatggaggccgcgttcatcgacatcggcacggcgaagaacgcggtgctctaccgcggcgacgtgcgctacgagcgcgaggatctcgagggactcggtgacggcgcccgcatcgagcagctgctgcgtccgaagcaggtgatcgtgtgccaggcggtgaagaacccgatcgcgcacaagggcgcgcgcctcacgcaggaggtgtcactcccggggcgtttcgcggtgctggtgccgggtcagcggtcggtgggcatctcgaagcgcctcccagaccaggagcgacggcgtctgcgagggctcgtcgaggatctcgtgcccgagggtttcggcgtgattctgcgcactgctgctgagggcgcgacccgagcggaactcgagcgcgacatcacgcagctcgtcgggatgtggcagcgcatcgacgagctggcacgaactgagcacgctccagccctgctctaccaggagcccccagcagcggtccgcgtcatccgcgaggagttctcgcaggagttccgctcggtcgcgatcgatgaccgagcgctctacgaggacgtcgcgcgctacgtccagacgatctcgcccgagctcgccgaccgtgtcgagtactacgacgccgaggcagagggcgttccgatctttcagcgttaccacgttcagcaccagctcgccaaggcgctcgagcgcacggtctggttgccgagcggcggatcgctcgtcatcgatcgcgcagaagcgctcaccgtcatcgacgtcaacacggcccgcaacgtcggggcggtgtcactggaggagacgatccaccgcaacaatctcgaggcggtcgaggagatcgctcggcagctccgactccgcgacatcggcgggatcatcgtgatcgacgtcgtggacatggtggacccgcagaaccgtgacgacgtgatgcgggcgttccgagcagcccttgctcgcgacaagacgagaacccacgtctacgacatgagcccgctgggtctcatccagatgacccggcagcgcatcagtgagggcctcgtggagtcgctctcgtcgacgtgcccgacctgccatggccaaggctacgtcctggacgaggatgtggtcgcgagccgctaggctcgtgcgagctatggacgcaatcatctcaaccgggggccgccaagagcgggtgcgcgagggggacgaggtcctcctcgacctccagtcgttcgagggctcctcggcgcggctcactccactggcgatcatcgacggtgacgaggttctcgtcgccccggctcagctcgagggagcctatgtcgaggtcgacatcgtcggggtggccaagggtcccaaggttcgagggttcacctacaaggccaaggcgaacgagcgtcgccgttacggccatcgtcagcggtacgtccgtgtgcgcgtgacgagtgtccacgtcgagcgcgcggcggcagtggagaggactgcgtagccatgtcgaagaccaagggtggcggatcgacgaagaacggtcgcgactcgaatgcgcagcgactcggcgtcaaggcattcggtggcgagaccgtgaaggcgggctccatcatcgtgcgtcagcgcgggacacgattcttcccgggccacaacgtcggtcgagggcgtgacgatacgttgttcgcactcgccgcgggccaggttcgcttcggcgttcgtcgtggtcgtcgcgtcgtcgacgtcgagcccgccggggagtcgctcggctaggcggccgagcagcgtgtcgagcttcgtcgatcgcgctcagctccatgctcgagcgggcgatggcggggcgggtgcggtctcctttcgccgtgaggcccacgtggatcgtggtgggcctgatggcggtgacggtggtgatggcggaagcgtcttcgtccagggcgacgaaggcgtcgcctcgctgatcgccttccgcgatcagccgtttcgccgtgcagaagatggccagcatggccgcgggcaacggcggcatgggcgtcgcggccgagatctcgtcgtgcggctcccgctcgggacggtcgtgcgtgatggcgagggcaacgtcctcgccgagatcctcgacaccacgacccgcgtggagatcgccagaggtgggcgtggggggcaggggaacgctcggttcctctcgaaccgccgccgtgcgccggcgtttgcggagcagggcgagcatggcgacgatcggtgggtcaatctcgagctgaagctcgtcgcggacgtcgcactcgttgggcctccgaatgcgggcaagagctcactcgttggggtgctcaccaacgccagaccgaagatcggggactatcccttcacgacgctcgagcccaccctcggcgtcgtgcggcgcggccccgagcgcgagttcgtcatcgctgacgttcctggtctcatcgagggggcgagtgagggtcgtgggctcggccatgcgttcctccgacacgtggaacgcgcgcgggtgtgcgccgtcgtcgtcgacgcggcgagtgcggcaccggagcgcgatgccgcgacgacgttgcatgagctccacgcgtatgccccatggctcagagagcgcccgacggtcgtggtgctccagaaggccgatctcgtcgacgaccgagccatggtggccgagcgggttggtgacgcggtcgggctcccggtggcaggtgtcgtctccgctcaccagcgggagggtctcgggccgctgctcgacgtgttcgagcgactcgtggccgaggcgcgggctcgggcggcggcggggccggcggtgaccgtgctcaggcctcgggcgcgtgtggaggcggaggcgcgtcgtgtcgcgcccggggttttcgagttgctcggacgcgacgccatccgggccgtgcgcttgagcgatctcagcgacgagggcgccttacgggtggtgcacgagcgtctcggagcgcttgggctgttgcgggcgttgcgccgtctcggggctcgcgatggcgacgtcgttcgtgtcggggacctcgagctcacctacgaggacgaggcgtgatccggcgcctggtggtgaaggtgggcacctcctcgctgacgaccgaggcgggctcgctccgcaccgagctcatcgggagcctcgccgctcagatcgccgagctcgagcggagcggcgtcacggtggtctgggtcgccagtggcgcggtcgccgtcggactggctcgctgtgggctgacgaggccgcaggaacccgacgtcctccaggccgcgagcgcacttggtcaggtggtgctcgcgtctggactcatcgaggcgctcggagcgcatggagtgctgggaggacagatccttctcacctcggatgcactcgccgatcgtcggagctacctgcatgcgcgcaccacgttcgaggcgctgtttcgcctgggtgtggtgccggtcgtgaacgagaacgacgcggtggccagtgacgagatccgcttcggcgacaacgatcggctcgcggcgctcgtcgcacacctcgtgggtgccgatcggttgctgttgctcaccgatcagccgggcgtcttcgccaaggatccccgttcccatcccgacgccgacctcatcgaggagctgacgcccgaggctgcctcggtggtgacgctcggtggtgccggcacgatgcgcggaagcggcggcatgagctcgaaggtccaagccgccgagatcgcggcccgttcgggggccgactgcctcatcgcgagcgcggctcgtgccgaggtgatcgtggacgccgcgcgcggacgtccgctggtggcgaccctcgtgcgacgccgtcgtcggcgtgagcctgcacggaggttgtggatcgcctacgcggcgacgcctcagggtcgcgtggtggtcgacgacggagcgcgcgatgcgctcgtcgagcgcggcgcgtcactgctcgccgtcgggatcgtcgaggtcagcggggagttcctcgccggcagcgtggtcgaggtcgccgaccgatcagggcggctgttcgccaagggcgtggtgcgggtcgattcgagggatgtgcgtcgttgtcgcgacgaggtcatccaccgtgacgacctcgccatcctcgtcgagggccccgggccgagagagcaccacgcagacggatgactcgtccgcaggtcctcgctcggttcggagtctgccgcgagggttgtgcgcgagcgttcggtgccgtgccgacgaggcggccttggcgagcgacgccgccttgaccacggccgagagccgtggtggcgtgctcagacgagctcggcgatgcggcgagcgagcttgtcctcgatctcgcgattccacgcgagctcggcgagatcgagcggcaggaacaggtcggagatgagcagcgtctccacgcccgcgacgacgaggtccttgcgccagttgccgacgccgatcgtcacggtgacggggctcggtgtgacggtgaagacgagggcccgttgcgcatcgatgatctcagcgaggaacccacccttcttggcctgcagcacgaaacccttcgtgccatccccggccatctcgacggtgaagccatcgccctcgaggagttggcgtaccttggtcgcgagctcactcgggtcgacctgcttgtcgccgaaggtcacggtcttcttgcctgccatggagtactcctcgtggtcggatcgtgccttcatagtctcgacgaccgggcgggccagcgcaagtcgcggcggtgtcgtcctctcaggaaccgaccgtgccgtcgatgagttcgcgcaggaggtcagcgtggccgttgtgacgggcgtactcctcgatcatgtgcgcgaggacccagcggatggtcggagcgccgggctggcgtgcccacgtcagctcgcgcccgtcgatggcgcgccggctcgcatcgatcgcgctctgccaggtggcgaggtcgtcggcgaagcccacgggagcgtcgatgagaaaatcggcatccggggtctctggatcccagaaccgaggtgcccagccgtcctcgccgaggagctgcttgcgaaaccaccacgcctcgacgtcggccatgtggcgaacgagtccgcgcagcgacaggagcgacgtcgcgatcggacgcgtcgtgagctgctcctcggtgaggccttcgaccttgaggagcaacgtggtgcggtggtagtccaaccatccctcgagcatggcgcgctcgccatcgtcgaaccctggttcgactcgcctgggatcgtgcagttcaccgaccgtcgctggcatcgttgcgctctccttgctcggtggggtccgttaccagtgtcaccaccagctccccgtctcggcaggctaccgggtccgacatcgtggtgggtgtggcggatgcgtggtgcctccaggttcgatggcgagcgccgagcgcacgttagagctcttggaggccttcgagtccaaagaaggcctcgcggagttggttgtcgtgttcgaaggcgtcgcgagggccgctgaagcgcacccgaccaccctcgaggacgatcacgtcggtcgcgagctcgaggaaggagacgttctgttccgccacgagcagcgtgatgccctgggcatggagatcacgcaggcgatcgatcacctcgttcacgatccgaggagcaagcccagccgagggctcgtccatgatgagcaggcgtggggccgccatgaggcacttggcgatcccgaccatcttgcgctgtccgcccgacaggctccctgctggctcgccgagacgatcggcgagctcggggaacatcgcgaggacctcgtcgatgcgcgctgctcgctccctctggcgaaggcggaggccaccgaggacgaggttctcgcggatggagagactcgggaagatgccctgctcgctcatgaacgcaacgccgagacgagcgcggcgatgggcaggcacccggtcgaccgactcgccgaacagcgagaccgacccgccgcgcgtctcgtggaggccgacgagggtggcgagcaaggtggacttccccgctccattcgcaccgaggacgagggtggcggcgccgtcctcgaccgagaacgtgatgtcccagagcacctggacggggccccacgcggccccgagaccgtcaatcgtgagcgctggtggtgccaaggaagaccctttcgacctcgggatcgcgcagcgcgtcgcgcagcggtccgacgaagatggaggagcccgcgttcaacacgacgaccgtgggcgtgacctgctcgaggaagccgagcaggtgctcgacgacgacgagtgaggttccctcggccgcgatctcgttcaagaggcccgcgatgctgtgcagttcggctggggagagtccagcgccgagctcgtcgatgaaaaggacgcgtgggcgcagcatgagggcacgtgcgagatcgagcagcttctgctgcgtggcattgagcgtgccggcttcggacgctccgaaccgcgcaagtccgaggcgctcgaggagttcgtcggggtccacgtcgccccgtgggtggcgcgtgctcgtggcaacgaggaggttgtcgcgcaccgtcatcccgcggaacgggcgggggatctggaacgtccgcccgatgccggcgcgcgcgagctggtggggccgtgccccggtgatgggcgtaccgtcgagcgtcacggtgcccttcgtggggcggttgaggccgcagatcgcgttgatgcacgtcgtcttgccggagccgttgggccccacgaggccgagcgcttgggcgggctcgaggtcgaagtcgatcccggcgagcgcgacgagcccgccgaagcgctgttcgagtcccctgacgctaagcagtggcatcggggagctccttgggccgccgaacgagcagcccgcgaacggcggtgaggatgccggcgaggccacgaggtgcgaacaggacgagcaccacgatggcgagcccatagatcagctggaaggcctgtgggtcgctcacgccgatgatcgcatagagcgcatagaggaccacggcgccgatcgttgggccccacagggtgccgacaccaccgaagagtgcgaagacgagggccagcacggtcgtggtgacgtcgaagacggcggtggggtagaacagggaactcgcccagccgtagagggcgccggccatgccggcgatcgcgcaggcgatcagccacgccacggcgcggcgcatcgggacgttgacgccgaccatcgaggcggagtagggctcgtcgcggatggcttggagggtgaggccgaaccttgagttgcgcagccagaccaccacgatcagtgacaggccgacgagcacgatggacgcgacgtagaactggccggaggagtaggcgctcgcgaggttgaggccgtccggaccgttcgtcacggaggtaagggccgggttggcgacgatgtcggcgagggcgagagcagctgcgagggtagcgatcgcgaagtaggcacctcggagccgaaacagtgggatgagcacgaggccgacgacgacggcaccgaggccgccgacgagcacactcgcaagtgccgggacgtgcaggtggatgatggcgaggccggaggcgtaggcgccggctccgaagaggccgaagtaaccgaacggaagataaccggtgaaaccgtagatgacgttgatgccttgagcgagcgcgacgtaacccatcatatagacgagcaggagttcgttgccgtagatgtggaggccgaacgcaaagccgacgaccgggacgacgacgccaaggccatcggcgatggctcggcgccccaggcgtcgtcgtgagcgccgttcggtcgtggggcgttgggcgagcgcaggctcaggcaacgcgggccctccttccgaagagaccttcgggtcgtagcagcatcgtaccgagaacgaggacgtaggggacgaggttcgaccattccgggaggtagacctgcgcgagctgcgacaagacgccgaaggcgatgccggcgacgatggtgccgatcgggttgccaagcgatccgaagacgatgatggcgaacgcggtgatcgtgaggctcgctccctcggacgggtcgacccccgagaagacgacgatggcgagaaccccggcggcggccgccagcgcgatgccgacgccgaaggtgatcgcggagatccgacgagtgtcgatgccgacggcgagggcctcgcgcgcgtcggccatcacggctcgagtctcgaggccgagtggggtgcgatagaggtagaggagaaagagtacgagcagcggcagtgacaccgcgccgacgatccagaggtaggcggggtagctctcgccgaggaagcggatcggatgcgaggggagcgccgcgatcggcagtgtccgttcgttcgggccgaacccgatcgccccgagtgcctcgatgacctgcgagatgccgaagaagaggacgagcgacatggtctcgatgtcccgagcgcgtgcgagcctggggacgacgaggcggtggaaaccgtagccaacggcgacgccgaagggaaggacgatcaccgcggcgaggacggggctcatgtggagggcgctgtagagatcccaggccgcgaagccaccgagcatgacgacgtcgccgtgggcgaggttgatgatgcgttggacaccaaagacgatgttgaggcccatcgcgaagagggcatagaagagcccgagcaggacccctccgatgatcgcaaagagggcgagcacggcggtacggttcctccagccagtcatgcgcggatccgccaccgagcaccggtggcggatccgcgtgaggtggtcgttacggtgcggggtagacggcgctgaccgggttcggtgcaggcgatgtgaccggcttcagggcgaccgtgttgcccgatcccgggaacagctgcgcgagcggcagcaactctcccgtctgtgctccctcggagttgatctggaacgtgccgtcgacggtcgtgaggttacccgagaccgaggtcagcgcgttgcgcagcgccaactgggacaacgaggtcgcgtgccggagcgcggcttcgaccaccagaccggtgttgtagccgagcaggcccagtgtgttcaccgcgctcgggtaggtgctctgcagcttggccatgaacgccgaggtggtgaggccttcggtcacggagttgtaggtgttgtagaagttggtcccgtaggtgtaggtgtactggagaccggtcttgccgagctgcgactcgaacagcgagagcagctgccccgggaagacggtgaacaccatggggaagtggtcaccggagctctcgagttgctgcaagaacgcggtgtcgttcggctggtagccgagttcgagcacggcgccaggcttcttcgcggcgaggctcgagatgatggtcgagtagctcgtcgtcgacgtcgggacctcttcgtaggcggccagcgagacgtgggccgcggtcagcttggccttgagcgtctcggcctgcgagccgtcgaagtcattgcccccgtagacgatggccacgttgttgatgtgcttcgagatgatgaagttcgccaacggatccggccagatcgacgacaccggtaggtcgcagagcacgatgtagggattgcccggggtgaagaacgggatgccggttccggactggtcgaagagcaggtagtgatgcgcctgggcgatcgagacggccggtgcggtgagcacggacccgaagtcggcgacgaggatgttgaccttgtcctgcgtgatcagctggttggtgagcacgccggccgtcgatgggttggactggtcgttcagggcgatgagcttgaccggaatgcgcttgtggtaggcgcccacgtagacgccacccttcgcgttctcgaggctgacccagagcttcaggccgtcgagttcggggatcgaactcgtcgcgtactcgccggacgaggcgtacgtcgttccgacggtgatctgggacggagccgccggcgcgctcgagctgctcgaactgcttgacgaggagctcgagccgcacgctgcggcggtgagtgccagcgtccccaacgtgagcgccccgagcgacgctcggcgaagacgcggacgaagacgtactcgcatgtggtgttcccccttgtatcccacggagtggtcgccgctgcgccgcactgcggctgcggtgcgccaaaccgacggaagcataggtggtggggtttcgggggccaaggcgatgtcgatactatgcacagtctgcattcaggcaagattcaggttccctgatcacccgcgtcggtgacctgtgtgccgtagactggacgcgcgggtcgcgacgccgtgcgacgtcggtggtccccgacgagtgggtcgggtcgatcggtgggtcgagcggctcgcgagccggtgtcggtcagggcgccgggacagcgcaggagtgggcttcgccggagttggagcggtcagatgatccaaagtgtcgaacaagcgcaggtcgatcgggtcgacgcgcgagcgatcgaagcggtcgcggtggcggcccgggcggcacaaccgcagctcgcggcggcgcccggtgagcagcgccgggcggcactgctcgcggccgcgcgggagctgcgcgcgagcagggctgcgattctcgaggcgaacgagcgtgacgtggccgacgcggtcgatctcacgagtgcccagcgggaccgactgcgcctcgacgatgcgcggatcgaacagatggcccagggggtggaggcggtggcggcccaacccgacgtcgtcggtcgggtcgtcgatggctggacgttgccgaacggcctgcgcgtgcgtcgggttcgcgtcccgctcggtgtcgtgggtgtcatctacgagaatcgaccgaacgtcaccgcggacgccgccgcgctcgcactcgcgtcggggaacgcgatcgtgctccgcggatcgtcccaggcgctcgcgtcgaaccgtgtgatccggggcgcgatcgcgaggggggtcgcctcggtagggctcccggaggcgctcgtcgggctcgtcgaggacacgtcgcgagagggtgctcgggcgttcatgcgcctcgagggcatcatcgatgtgctggtgccgagagggggtccggggttgctccgggcggttcgggacgaggctcgggtgcccgtgatcatcgatggcgacggcaactgccacgtctacgtcgatcgggcagccgatctcgcgaaggcagctgcgatcgtcgagaacgcgaagctccagcgacccggtgtgtgcaacgccgccgagacgctgctcgtccacgcagccgttgccgacgagttcctcccgcagctcgccgagcgactcggttcgtgcgaactgcggggcgacgagcggacgcgagcgctcgtccctcgggcgttgccggccacggccgcggactgggagacggagtatctcgcccccattcttgcggtgcgggtcgtcgacaccctcgaggacgccatcgcccacattcggcgctactcgagcggtcactccgaagcgatcgtcacggaggacctggctgcagcgacgcgcttcacgggcgaggtggacgccgcagccgtcctcgtcaacgcctcgacgcgcttcgtggacgggggccagctcggcttcggtgcggagatcggtatctcgacccagaagctgcactggcgcgggccgatggggaccgaggcgctcacgagcgtcaagctggtcatctggggcgacgggcacgtgcggacctgattgggggcgctagcctggggtggacatggtcgcttttggctcgccccaggtggtcgcggaccggcttcgagaggtcgggtacctcccgaccgatgagatcgcgacgacgatcttcctcgccagtgtgctcggcaaacccgtgctcgtggagggacccgcaggaaccggcaagaccgaactcgccaaggcggtcgcgagggcgtgggggctcgacctggtgcgcctgcagtgctacgagggtctcgacgagtccaaggcgctgtacgagtgggattaccgcaagcaactcctggcgctccagagccacgacgatgacctcggctccgtcttcgacgaggcgttcctcctcgagcgtccgctgctgcgcgcattgcggatgacgagcgaccgactgctgctcatcgacgaggtcgatcgtctcgagatcgagaccgaggcgctcctgctcgaggtccttgcggagttccaggtcacgatcccagaactcggcacgctcgcggcgacgagtcgaccgctcgtcgtgctcacctcgaacggcgtgcgtgacctctccgaggcgctcaagcggcgagccttgttcctcttcctcgactatccggatcccgagcgcgagcgtgcgatcgtcctcgaggcggtgccggggatcgaggcgagtctcgccgatgccatcgcacggttcgtcgcaagcgtgcgcgagctcgacgtgaagaagcgaccatcgatcgcagagaccatcgactgggctcgtgcgttggtcgtgctcggtgccgatgtgctcgatcgcgagaccgtggagacgacgctctcgctgctcctcaagcatcgtcacgacatcgagcgagtccggcgcgagctgctcggggcggccagcgcgtgatcggtcgcgtcctcggcctcgggcgcgcactcgcggaggcgggcgcaccggtgagcccggccgagctcgtcgatgcgctgcgtgccgtggctgcgctcgaggatctggcgcgctcgccgctcagggctgcgttgcgcgccacgatggtcaaggacgtctcggcgcttcccatcttcgacgtgctgttcgacatctatttcccgatggcgaacccgacggaccaggacctcgcggagctcgacgatgcagcgatgcgcgccgagctggaggttgcgttgcgcgatggcgatgacgagcgactcgctgcgctggctgctgccgcggtcgagcgtttcggcgaggtgcactctggcgccgcggtcgctggcgcctactacgcctatcggacccagcgcgggctcgatctcgagcgggtgcgcgaggaactccttgcgggcttggcccgcccccacgacgccgaactcgactggcgcgagcgagaacgcgaggcgaggcgtcgtctccagtcgttctcgcgccacatcgacgatgcggtacgcgcgcgtcttgctcgcgagcgcgatcccgacgaactcgcgcacagcctcggcctgcgcatcgccgacgacgtcgacatcatgaacgcatcacgcgaggagttggcggcgattcgcgaggccgtgcgtccactggctgccaaactggtcgcacggctcgagcggcgtaggacacgccggggcggtccactggagctgcgtcgcacgatccgtcggtcgctctcgaccggtggggtgcccctcgagcccgtgttccggccgcggcgaccgcatcggcccgacgtggttgtcctcaccgacatctccggttcggtggcgtcgttcgcccgcttcacgctccagctgctctgggcgctcgcaggggagctgcgtcgacttcgagccttcgccttcatcgacgccgtcgacgaggtcacccccctcgtcggggggtcgtgggacctcgacgctgcgcttcgagcggtggcagagcgcgccgcggtggtcggcaagcagggtcactcggactatggcgccgtgtttgcccagttcgaagagcgcttcgtcgacgccgtcagtccgaggaccacgctgatcgtcctcggcgatgcccgcgcgaactaccacgagccgcgagccgaggtgctcgatcggctggcgcgacgagcgcgcgccacccactggctgaacccggagccggcacgctactgggacagcggggactcggtcatgggcgcctacgccccatcgtgcacgtcggtcgtcgagtgtcggacgctcgcgcagctggagcgcttcgtcgaggaggtgctgtaggctctggccggcgaggcgcccggcggcgacgatgtcacgaacgcgacgatgtcacgaacgcgacggcgtcacaaacgcgtcaaggtcgcacgagggctcccgcgtcaggggcatgccgtgtcgaggtcgaccgcggtgccgttgccgttggcagagaaggccgtcgtggctccgtactggacgtagcgaatggtgccgccgccgaagggggcatactcggtcccggcggtgcccgcgcagacgctggctgggtccgccccgggatcgggaacccagaggggcgtgccggcaggcagggtcgcgccgccggtgatgtcaccccactggtagttggtcgagtagacgcctgcgctcacgccgaccgattcgaggaacgcgagggccccgtagaccgcgtcgcggttggcggtcgtcgagctcgtccacgatccgctgagctcgacgtccagccaccacgcgttgcgcagcgtgctcgaagtggagccgagatcgacgaaggaggtcgcgtaggcgtactcggcttcgtcgtagccgtaggagaagtaggcaccgggcccgctcgccgacgtggcgctcgtgtagagctgaccggccggcgtcgagagtgctgcctggggcaccgggttgaaggaggtgccgttccacgtcgaccagcttgcggtgccggcgggcgggatcgcgagcggcgccatgttggtgccctgggggatggtgttgctcgcgccggcaaagacgtagagctgggtgctggagccccccaggccgaccgcctgttggaacgcgtccggggcgcagccggagttgctcgtccagtcgtacgagaagggccagccgttcgactcgacgagcagcagtgggtcaccgacaggaaggtaggggaggttcgagcagttgaagttgctgaggtcgaccccgctcatggcgggcagttcgatcgccccgacgatggcgccagggagcgggtgcgaccccgcaagtcccgtgtagcccatcgagtaggtggtgccgtcgaagctcgcgtccccgaaggtgaacaccccgccgtcggctgcgaccaaggtgtagccggcaccggtagggctcgggtcgatcccgacgacgggagctgcgagcggacgagacccaccgagaccggtgagccccaaggtgtaggtgttgccgtagaagccagcatctccgaagctgaacaccccgccgtcggccgccaccagccaatagcccttgccgtcgggggttgtggccatcccgacgaccggggctgcgagcggacgtgacccaccgagaccggtgagccccaaggtgtaggtgttgccgtagaagccggcgtctccgaagctgaagacgcccccgtccttggccaccagccaatagcccttgccgtcgggggtgggcacgatcccgacgatgggggctgcgagcggacgagacccaccgaggcccgtgagccccaaggtgtaggtgttgccgtagaagccagcatctccgaagctgaacaccccgccgtcggccgccaccagccaatagcccttgccgtcgggggttgcggccatcccgacgatgggagctgcgagcggacgtgacccaccgaggcccgtgagtcccaaggtgtaggtgttgccgtagaagccggcatctccgaaactgaacaccccaccgtccgcgccgaccagccaatagccgccaccgcctggcacggcggctgccccgacgacaggagcagcgagcgggcgagacccgtagagacccgtcagcccgaggttgtagaccgagccgaaggtctgtgtcgcgaacgggtacgaggagccatccgccccgacgagaacatagccatcggctggcgtggtcgacgaggccagggtggccgccgtgtgcggggcttgcgccgtgagggggcggtcggtcgcgagtccggcggcggtgacggccaagaggctcgtcgcggcaagtgttccgagcgagcgtcgtagcaaccggtgcgacatgagcggtgcgatcctccgtgcgtgcgtcgtgtagcagaggggatatcggcacgccggctcgaaacgttgagccgagcgcgtggcgcgcccacgaggtcggccgcttcgcgccatcgaggtggttccctacgagtggtgctcggtgtggccggcgtctggcgcgacgaactcgttgcgcatcgtgccgatcccctcgacggagctctccaccacgtcaccgggccggaggaagacgggcggccttcgaccggcaccgacaccatcgggtgtgcccatggcgatgagatctcctggctccagggtcatgatctcggagaggtaggcgatggtggtcgggacgtcgaagagcatgtctcgtgatcggccatcttgcatcgtggtcccgttgacgcgcgtggtgagagccacgtcacggacgtcatcgacctcgtcgcgggtcaccatccatggcccgacgggcgtcgaggcctcgaagatcttgccttggaggaactggctcgtgcgatgttggtagtcgcgcatggagacgtcgttgacgacgacgtagcctgcgacgtgctcgagtgcatgggcgacatcgacgtggcgagctcggcgaccgatgacgacgccgatctcgacctcccagtcgacctcatgggacgtgaccgggagcgtgatctgatcgaaggggcccgtgagggaccgtgggaacttcgcgaacaaggtcgggaaggcgggacgctcgtcgtgacccatctcgtccatgtgcttggcgtagttcagccccaggcagatgatggctccgggggtcgtcacggtcggggcgaaacgggcgtcggcggcttcgacggcttcggctgcacgcagctcgccgaacgcgccgaggtctccctcgacggcgcggagcgccgccgcgaggtccgggaatggtaacagccgccaatgggtaccgaaatccatcgcggcgtgcgttcccgttgctgtgcggatagtggcgaggcgcacggttccctccttgtgcgacgcggtgcgtgggtggaacgctagttggactggtcggcgtcgtcggagctggcccggatggtctcgagctcgatggtgagcggtgccgccgactcgctcgagcagcgcgggcaggggtcccgatgaatcatggagcgtaggatgcgagatcccgatggattgaggcgaacgaggaaggcgcccgagaccgggtcgacgacgacggagtcatacggctcccaccgagacgggggcaccatcgccgctgcatcggggtgtgcttggttgcggggcaggcgcacgaaccgatgctcgctcgtgtcgaagatccacgtggagttgcaggtgtcgatcgtctcgtagcgcccgacgtcgttggagggctgaggtgtcatgtgtcggctcccggtcggcgggttggcccccacagtgtacccggtgggcgctgctcgcgaagagagagtgcgcgggtggagttggctagtcttagggctttgcccgccgcaccaaacggcctcgaggaaggagcacgtcatggccgaagaggaacagccagcgagtccggaagaagaggagctcgccgccttcttcgacgacgaggacgcgcccgaggatcgcatgacgttctctgccttcgatgggtttgcgaccggcatcgcgctcgcccccgaggcggtcccacaggcggcgtgggtcgcggtcgcgcttggcgaggcggccgatgaggcaccaccgcgggtcatcgagttgatggcgcactacgtcgacgagatgcgatcggtgctcgactcgaccgacgtgagcgagcgattcgtacccgtcttcgacctcgtgggcgaggacgacggcgaagagctcgtctcgccgtcggattggtgcgcgggatttctgatcgcgaccgagttctaccgtgacacgctcgatgcgctcgccgagacgaacgacgaggtggccgaactcctcgtgccgatcatcagtttcggtaccgatgagggtctcgacgcgctcgaggagagcggcgacgaggacagcctcgcggacgaactcatcgacgcgatccaacccagcgtgatcgccctgcgcggatacctgcgctcggcttagtcgacccgcgcgacggaagcgtcgtccgcgtcgaggggcgcgcttgcggcgcctgtcgcgatggtcggtgcgtccgcccagaggcgctcgagctgatagaactggcgagcctcgggtgcgaggacgtggatcacgatgtccatgcagtcgaggacgacccaggggtctcccgggcgtccttcgacgcgtgggtggagtccgagatcgcgacggatctggcgaacgagatcggtgacgagcgaggcgccgaggcggggatttcgcgccgtcgcgaggatgaagtgcgtcgcgatcgcggtgagttccgccacttccaagaccacgacgtcatcagcatgcttgtcctcggccatgcgggcgatcgcgagcgcgtgcgtgcgctgatcggagagccggaggcggtgaagatcgtggtcggtgctcacaccagggtcgtggaatgggcgcagggtgctgtcggcgatgtcgatgatggggcctcctcgtcgtgatcgttcggttgggcgcgacggcactcgagactcgtgattgccgagcggtcctcggccgagagcacggcatcgcgcagcggcgggcgacaccgaccgaggcgatggaactgacccagtcgatgcagacgaggacggacggacgcttgctcgccgagagctatctcggagcgaccgctgcacgcgagcctgcggtgctcgggcctgctcgaggtcgtaggagatggtgacgccacgcaccagtcagtctagcccggcttgggctgtatcgccgagtgtggcgggggcgcgtcgtggtagagcccgaagcgattgatggcggcgatggcctcgtcgggcaacaggaactggagggggcgacgatcgcgcacgcgttcgcgcagatcggtcgaggagatgtcgagccagggcatctcggcgaagatcggatcgcgaaagccctcgagcacggtcgggctcgggtagccatagcgattgacgacgacgatgcgagagaggagcgggagctcgtcggctcgttcccaggtcctcatctggttcgcggcgtcggagccgacgatcaagaagagctcgtcgttcgggtgctgagcccgcagctcgcggagcgtgtcgaccgtgtaggagcgacccccacgacggatctcgaggtccgatgcctcgaatccgtcgatggtctcgatgaccgcgcgcaccaccgcgagccgcagcgcagggtcggtcacttcgcgagcggcctccttctgccagggcacgttggccaccacgaagagaacgcggtcgagggcggcagcgtactgcgcgttctgagcggcaacgaggtgtccgatgtggagagggtcgaaggtgcccccgaagaccccgatgcgcatcagtggttctgctcgaggagctcgatgacttcgccgaaagcctcgcgttctggctcgtggaccacccattcgtcgacgccgagcgtctcggagacggcctggatcttctcggcaacctcggccgcggtaccgatcaggaccgccggcatggcgagcgcgtcggcgacgtcgacgttgtaggcgcgactgaggtcgcgcacgacggatgcggcgtcgttgccgaggtgcacgaacgcggtgcgcagctggatgcgtggcgatcgatcagcgagggcggcagcctcacgcaccttggcgagcttgcggcgataggaggcggccgagagctgatcggcgaccgcgcgccgcgagtcgggtcgtgcgagcgatgggttgacgctgacgacgtcggcgtagcgtgccgccagtgtcagcacgcgcggccccccgccgccggcgaccagttcgaagcccgccgcccccatggggaggcggaatccgttgagctgataggcccgaccgtggaaagtgacctcgccgtgcgatcgcagccgatcgacgatcgcgagtgcctcggccagacggtcgacgcgagcggcggcgacgtcgaagcgcgcgccgaggtggtcgaagtcgctgcgctgccaaccagctccgagtccgagcgcgatgcgacccgggaacgccgaggcgatggtcgcgaactcggcggcgatgatcgcgggatggcgcaggtcgttattcatgacgagcgccgcaaccgtgaggcgtcgtgacgctgcggcggcgagcgccaccgaggcgatgggagcggtgcgctcctcgatgtggtcggggaacgacacgccgtcgtagccggcggcttcgatggatgcaaggagcgcggggagctcggcgagctgtgtgctcgcgccaagttggacgacgaagtgtgggcgcgtcacgagacgattccttcgcgagggctggagagcggggagtcctggggcatggtcgggtgagcacctagactaccgctaggaggcttcatgaacgcgcttgacgacgccggttggcagccgtgggactggcagcagcgtgtggccgcgcagcagcccgagtggcccgatcccgaggcgttggacgcggtcatcaaggagttggctcagcgcccagccctcgtggtcgccaaggacgtcgaccggctacgagccgcactggcgcgtgcggcccgtggacgtgccttcgtgctccaagccggtgactgcgcggagagcttccacgatcactccgcgagttcgctgcgcgccaagctgaagatcatcttgcagatggccgtggtcctgacctactcgtcgggcgtgtcggtggtcaagatcgggcgtatcgccggccagttcgccaagccgaggtcggcgcccgtcgaggtcgtcgacggggcgaccttgccgtcgtttcgcgggcacatcgtccatgatgacgccccgacactggacgcgcgtcgtcccaaccccgaacgcctactctgggcctacgatcagtcccgagcgacggtgagcgtgttgcgagccctcaccgaggggggcttcgcggatctctccggggcgcatcggtggaacctcgacttcgtcgcctcgtcgccggaagggcagcgctaccaggcgatcgccgatggggtcgatcgggcacttcgcttcatggcaggctgcgggatcgatctcgagcgcgaggccgttctgcaccaagtgaacgtgtggacctcgcacgaggcgctcttactgccctacgaggcggcgctcacccggcgcgatcctgcctcgcagcgctactacgacctctcggcccacatggtctgggtgggcgagcgcacgcgccagctcgacggcgcacacctgcgttttgcatcggggatcgccaatccggtcggactgaaggtcggccccacgatggagcccgacaccctcgtcgaggcctgccggatcctcgatcctgatcggacgccgggtcggctggtgctcatctcacgcatgggtcacgacgccgtgcgtgatcgcctcggaggtctcgtcgaggccgtacgtgaggcgggctatccggtggtgtggctgtgcgatccgatgcacggcaacaccttcgtctcccagtcaggctacaagacgcgccgcttcgaggacgtgatggacgagatcgccggtttcttcgaggtccatcgacggcttggtacccacgcaggtgggatccacctcgagctcaccggagaggacgtgacggagtgtcttggcggctcggaggcggtgctcgagtcggaactgtgtcgtgcctacgacaccatctgcgatcctcggttgaacgcgcgccaatcactcgacttggcgtttcgcgtcgctgaactcctgatccgctgagttctgctcagctcagatccccatccgttgtgcgaccacgccgcgccgggtggcgcggggcgccgctctcgagctacgcgttggcgaccagcgtggtgcggccccggcgtacgaacacgacgagcacgccaagcaaggcgacggtagggacgagcacgacgacctccatccctcggtaccctgcggcactcgcgatcgccccgagcgcggccggtgcgccgaccccgacgatgttggagaacccgatcagataggagttcgccttcggtagcgcaatgggttcgagggtgtcggcgagcatggagagcacgatcgggaagatcgccccgtgcgggatgccaaggaccgccatcgcgatcgcaaagacggcgaacgacggagcgacgaccgcgatcgcgagtccggccacggtgagcaatccggagacgacgagcatgcgctgcttgtgcgcgatcgggctgcgcgcggcgacgacgccgcgtgatgcgaacgacgtgacgaagaaggcggtgaaggcgtactgtgcttctgcggcgctgacgtgagggagcgagcgcgcaatggccgcgccaaaggcggtcaccgcggcaaagggcaaggcgtacatgagctgagcgatcagtgcctggcgggccgctcgatggcgaaacgggtgcacgtcggcgatggcggcgcgctcggaggcgtggtcgttggcggatggtcgggagaggtggatggtcgccatggcgccgaccacgaccagcgggaagacgccgaagacgaggaggggcgcacgaacgtcctggtgcgcgacgaccaggatgcctgactcgatgagcggggcgacggcgagcgaggccgagagtacgagcgtgaagatggcaagctgacgttctcggtcgggtgccccggccgagacgagttggctcagtccggtcaggctcggcatcccgagcccgcccgcgatgccgacgagggccgctccgaggctcgccacggcgaggttggggctgagcgcgaggaccacgagccccgcgagcaggatcagggctgccgcgagaaccgcgtcgcgcaggcgcgatgggtgcaggcgcgacgagaacccgaggttgacgacgacggtggctgctccggcgatggcaccgacgacgccgatcgccgtcgcgccggcgtggagctgatcgcggagcaagagcgcgatggtggtaagggccatgttctgcgtcccgcggaaggacgccgtggcgccgaggagagcgacgggacgacgagaggactgagccatgattctgatagtgtagcggtcattacggttgcatgcgcaacgactatcttgcggtgagtagttatctggcagtgtgcagttgccgaggttggatgcgtcgccacagcgcccaggcgagtcgcggaccgaccaggaagaggccgaggaacgagccggccacggcgacgaagagccacaccacgccttgatggctgagaagacgcaacaccataccgagcgttacggtgctggcccagacgacgatccctcctggccagacctggcctgtacgtcgacgtacgagcaggaatccgacgagcgtcccgacgaggaacggccaccacgtgcgccagacgccgatcagctgctcgctgtggccgtgcgcgtggcgtccgatcacgacgaagatcagtgtcgcgacgatgtcccacgcaatccagcttcgccagcgcatgtcgctccccttcgcgtcgggttctcagcgtcgatcgacctcgggcgatgcacgatgacgcgtcgatcgctctcgacgcagcgtaggcgacctcgatggcgaggctgtccgacaccgttgacggggctctgtgtgctcgggctcgtcggtcctccggtgcggttggcggactgccatgcggcgcgggcagggcctcgggggcctcacggtgtcggtcccccgtgcgcgtgtggtgggggctcacatccttggaggctcacgcgctggcgtgcgagcacccagcgggcggagcgatcgtaggaggtccgtggtggtgctggaggagcgtcacggcctcgatgctctggtgcacgagtgcgaaacccgagccccgccagcgaaggctcacgacgtagtaggcgacgtgttcggccgcgttggagggggccgggccatagctgcccatgaggcagagggtgagcctggagccgttgtgggcaatccaggcagcgctcacggggacgggtggcagcgcgagcggctggtcaggatgcggggcgagaagcgttggcgtcacgactgccgtgacgtggtgcggcaggagcgcagggtacgcggtgtagagagcctcgacgagcgatgcctggtggtcgcgcgtggctcgaaagagcagaatggaagcgggcgtgatgctcgcgaagttggtggcttcgtaggcgagcacggcgaccgtctggcccccctccacgagatacaccggtcgttgccgcgacaggcgctcgtcgacgtgcatgaacggagggttcgggaccgggagcggaaggttgagccgttgccagtcgaccgaggaaaacgcggccgggttcggttgttcgggggccgcgggcgacgtcgagccgcacgccccgagcgcggccccgacggccaacgcgccgaggatgccgaggatgctccgggcccggtgcgctcgaaccgatgcgaacctgatcacctcggtggcgcgagccgaggcgcgaggctcgcgctgcaggtgcgaccgtgtgagcctcgccacctggaggctccggcgaggacgactcgacgtcgtgatcgacatgacgagactctagctcggcagggggaacgcgtcacggagcgtggagcgtgctccacgctcggccactcgtcaggatcaggggcgcgatgtcctcggctctgtcgacgggcgcacccggcgctcgagtcgttccgtcggcgaactcatcgcgacggccggtgagcgaagccgacggcgcgaggccgcggacgcacgcctccgagggtcgctgtggtggcacgatggagctcgggtggggggtgtgtgtcgcagagcgacatgtggtcacaagggggcacgggtgcacgggacgcgttccgggcgcccccggcaggattcgaacctgcgaccgactgcttagaaggcagctgctctctccactgagctacgggggcggcactcagcatgctaccgatccgatgtggcgacgtggcgtccaggttgtagcatcgccagccagatcaggaggagtatgcatgcgctgcattccgggtgagctgacccttgccgagctgcggtcgttgtgggcgggggaaacctcgttcgaactcgacgcgagtgcctgggaggtgatcgatcgcgccgcgcgtaccgtggccgaactcgccgatcgtgacgacccggcctacggcatcaatacggggttcggtcgcttggcatcgacgaagatcccgcgcgaccaactcgagctcctccagcgcaatctcatcttgtcgcacgcggtgggcgtcggcgatccgctcgacccgccgaccgtgcgactcgtcctcgcgctgaaggtcgcaagcctcgcacgtggtgcttcgggggttcgccgcgagctcgtcgaggctctcctcgcgctcctcgagcacgacgtgttgccgatcatccctgagaagggatcggtcggggcctccggtgacctcgcgccactggcgcacgtcggcgcgctgctcatgggtgtcggtgatgcgctcgtcgcgggtgcgcgcgtcccagccatcgatgcgctcgccgaggcggggcttgctccgctgtcgttcgctcccaaggagggtctcgcgctcatcaacggcacccaagtctcgacggcgatcgcgctcgcgggactgttcgccctcgagcgtacgctcgccgctgccgtcgtggcgggtgcgctcgccgtcgatgcggccgctggctccatggtgccgttcgacgctcgcatccacgcgctccgtggccatccgacccaagcagacgtggccgccgcgctgacgacgctgctcgcggggtcaggcatcgtccagagtcatcaggactgtggcaaagtgcaggacccctactccctgcgttgtcagccccaggtcctcggcgcggtgctcgatctcgtgcggatgcaggccgccgtgctcgagcgagaggccaacggcgtcacggacaatccgttggtcttcgtcgagaccggagaggtgctctcgggcggcaacttccacgccgagccggtcgcctttgccgccgatgtgctcgcgatcggcgctgcggagatcggcggcctcgccgagcgtcagctcgcgctgctcatcgaccactcgctgtcgggcctacctccgtttctcgtgcgcgagggcggtgtgaactcgggcttcatgatcgcgcaggtgaccgccgcggcgctcgcgagcgagaacaagacgctcgcacacccggcgtcggtcgattccttgccgacgtcggctaaccaggaagaccacgtgtcgatggccaccttcgcggcgcgcaagctccacgaggtcgtcgccaacacgcagacggtggttgcgatcacgctgctcgctgcggtccaaggcgtcgagctccgtcgacccttgcgcagttcggatcggctcgaacaggtgatcgcgctcgtgcgcgagtacgtgccacactacgacctcgatcactacctcgccccggacatcgctcgagccacagagctcgtacgggcgggcgccatcgcggagcacgcaccgttgcgcattctcgagcagcgctaggcggtcgacgttcagggagagggctgctcgagccgctcgatcgccgtgaccgagctcgggccctcatcgtcaccgaccacgacggtgagcggatcggttccccacagcgagaccgtggccgccgagcctcctggcagtgagcgcgggaactcgatgcggacatgggtcggtcccgtgagcgccgccgagaggccggcgcgccacagtgcctcttcgacgagggcgagatgaatggcgttgttgacgtggtcgacgatgtcgagatcgctgcggcgtaggtcgagatgccaggtcgcctcgggctcggtgtctggtgtcgtgatgacgaggctcgggcggacgcgacgaccagcggcggcctcgccatagacctcgtcgaagccatcggggagtgacgcaggtgccccagtgtcggggcgggtgttcacccagacggcggcggcgctgacgaggagttcgccgcgaaccaacaggtcggtacgacgctctgcccacgcgcgcccggtcccggagaccgccgtggcgaggtcgacggcgtcgagatagcgaggccaggagaagatctcgatgtcgatcgagcggatgacccatagacccttgtccaccagcggggcatcggtgttgtcgagggtcgcgatgtcgtggaggaagcgggcgatcgcgtcgagccgaagacgtccgtccggcgtcgtgtcagacagcagcacgcggcggtggtcgtcgtagcgacgaccctggtctggcagaggggcgagcggcacgcgcccacgctagtcgggaggggctgacgcgggcaatgacgagctgggacgctcgtcggccagcgatgcgagttgcgcccggagcaccttcttgtcgaacttgccgacgctcgtgcgagggatctcgtcgacgacgacgaggtgatcgggcagctgccaacgcgggacgccatgggtctcgagccacgcccgtgcggcggcgagcgagagcgaggtgccgggtgcgagcacgaccgctgcggcgggcctctcgccccatcgcgcatcggcgatcgcgacgaccgcagcctcgacgacgtcgggatgtcccatcagggtcgactcgagcagcaccgagctgatccattcaccgcccgacttgatgagatccttggtccgatcgacgatgcggagccggccgccggggtcgatggtgccgacgtcgccggtgcggaaccaccctggccgtgccgtgaacgactctgggcccgccccgtggaggtagccatcgagcacccatggtccccgcacgtagatgtcgcccatgtgcgcgccgtcgtgcggaacctcgctgccggtctcgtcgacgacggcgagggtgatgccagcgacgggagcccctgcgctggcgatgtggtcgagctggtcggccaaggggagctcacccatggcgtgcgggagtcgcgaggtggtggcgatcggggaggtctcggtcatgccccaggcctggagcatgcggatcccgtaacgctcggcgaaggtcgtgatcaacgagggtggcggcgccgacccgccacagaggagttcgcgtagtgctccgaggtcgccgccgttcgcctcgagcgcctctgccaccgcaatccagacggtcgggacgccgcccgccttcgtgacgcgctcggcgcggatcagctcgatgaggaccgcggggttgagggtcggtggcgggaagacgagcttcgcgcctgccgccaccgcgccgaagggcagtccccaggcgtagacgtggaacatcggcacgaccggcatgacgcactcgctgcgcgagagggccggcccgttgccggcgttcaccgcgagcgcggtgtggagcacgagggaacgatgagtcgaggccacgcccttcggccgtccggtggtgccggaggtgtagcagatgccggcgcgctggcgctcgtcgagggtgcgcgtgccgggggcgggatcggcgctcgtgacgagcgcgtcgtagtcgagcacctcgccaagggcgttcgcggccccggggtcgacgggaccgatggcgatgatccgtgggatctgtcgaaggcgcggtgcgatgcgcgccacggtcgcaaccagatcgccgcttgcgatgatgacctcgtcgccggcgtcgtcgatgatccaggcgagatcgtcgtcgccaagacgcggattgagcgtgtggagcgtcctccccgagagcgtgatgccgaagtaggcctcgaggtgctcggcgctgttccacgcgagcgtccccacgatggcctccggcggagccaggtcgtcgaggacggtgatgaggcgccgggcgcggtcggcgaagtcgccgaagcgagagcggtgctgctcggtgggcgagcgctgggtgacgatctcggtgtcggcataggccccttcggcgtgctcgaacaggagccacgtcgtcaacgcaacgtccatcatcatggcgacaccccccttcgccacttcggatggtagcgaagggctccgcgccctgtcagctcagtcggcctctggttcgtcctgcatcacgcagaactgtacgccgtcggggtcggcgaggacgcaccaggcgcccccgtcgacaccctcgcgtcggtcggagcgctcctctgcgccaagggcgagggcccgctcgcggagcgtctcgcggctcgcgccgtagaggtcgaggtggacgcggttggcgcgagggtccgccgtctcgatgcgctggaggaacaccggcggcagggacccatcgggcgccacgaggtcgagataggtgccggtgctgtcgagatcgccgatgcgatagcccaggaggcgtgcccagaacgcggccgcgcgccccgggtcgggggtgtcgatgccgatctcgatgcggcgcagatccccgtggtctgcgatgggaggtggtggtgagaacggggggcgccatcgacaggtgtcgcagctcgatcgaacctggcgccaggcgtcctcgatgccgtaccagacggcgtcgaggacggcgggatcggggccgaagcgctctgcgacctggaggtcgagcccgagcgcgcttgcgcgctccgtcgcctcttgttcggcccgctcgaggaggacgccggcgaacagccaccacggcacgaggaggacgctccgggccccgaggcgccagaggcgttccacaccctcaccgacgctgggttgggccagcgagacgaaggcctcttcgacgaggtcgacgccgagacgttcgccgacgaggcgcgcgatcgcggcgagctcggcgttggcgctcgggtcggtcgatccccgtcccacgacgagaacggcctcgggcggcatcggcgagaccgcacgagctcggcgtacggcgagctcgaggagctcgttcgaggcaccgagctggggggcaaggcgcacgtcggcgtcgggggcgagtgctcggatgcgcgccgcgaccgatgccgcgtcgtccttcaagtgacccgcaccgacgagcaccacgggcgcgacggtgatgcgtcgcgcgccagaacgagcggcagcgtcggcagcgtcggcgagggttgggtcggcgaactcgatgaagcctgcctcgacgcgggtcgggaggcgccgagcggcaagctcgacgaaggcgcggaactcagcctgaccgtgctcgagacgcgtgccgtggccgacgaggacgacgagatcggttggggcgcgatgtgtcatgtctcctccgtagcgagttcggcgagcgcattgagtgccgcggcggcgacgggactgcctccgcgacggccacggagggtgaggcacgcgaggccgctcgcgaggaggcgttccttggcttccgccgcgcccacgtagccgacgcagaagccgaggacgacgccgacgttgacggggtgctcgaggagcgccgagagagcggtcggggcgttgccgatcgccaccacggccgggttcgcgagagcggagagcgacgcgcgcatcgctcgcgccgagcgggtctcgacggcgtcaccttgctcgaccgcatcgagcgtcacgatggtcgggagccgcggagcccctgcggcaaccatgcgcgcgtcgacgaggatcggcgcgccggtgcgaaggagacggaccgcctcggtgacgaccgcctcgtcgagtacgaggtcgtcaacgagcgaggggtcggccgtggcgtggacgatgcgcgcggcgacgcggcgcgcgccgggaccgaaacgcgcgagatcgacctcggcgcagatgcgctcgaagctctcgcgagtgatgcgtgctccggcgtcggtcgtcatcgtcgctcccagctccccacgatcgcgtcggtggggcagacttcgatgcaggcgccgcagtcgtcgcaacgtgaggcgacgagctccgggcgccccggagcaggtcgaagggcgtgggtgtggcaggtcgggatgcacacgccgcacccgacgcaggtacccagtgcgatcgccacgctcatcgcgcaggctggtagccacggggtgtcaccgcgagtcctccgaggactcgggtcgccgactggcccacgatgacgatgctcgtcatgtcgacggtcgtgacgtcgaggtcgtcgagcgtgccgagttcgaggtgttcgtcgacgcgttcgacgttgcggccgacgaggacgggcgtcgtcgggggtcgatgtgccgcgaggatcgcgagcgccttctcgagctgccacccgcgtcgtcccgaacgggggttgtagagcaccacggtgagatcggcgcgagcggccgcttcgagccgctgctggatggtctcccacggcgtgaggaggtcggagagcgagatgacggcgtgatcatgggcgaggatcgcgccggcgcgggccgcggtcgcgagggatgcggtgacaccgggcacgacggacaccggcacgcgaccatcggccacctcgtggacgagggtcgcgagcgcgtagataccagggtcgccggaggcgagcaccacgactcgggcgcccgcctcggcgcgggcgaccgcggccatggcgcgctcacgttcggctccgagggcaaagccctgctggagagcgtggcgaccaatgagaggttgggcctggtcgaggtagccgtggtaggcgatcacgacgtccgcgttggcgatggcgccccgtgcccgcggcgtgacgagatcgagcgagcccggtccgagcccgaccaccgttacctcaccgagtggcgcgtcacggaccgccacggcgacggtgacgggcccgtcgatccgcttgggcagcacgagcgttgcgtcgggtccggcgagccgaagggccgcggcctctgccacggatggcgtgtgcacggcgcgctccacgatcggcgatggcgtcggtaccgccacctcacggaggacggcggcctcgtagccgacgatcggaagtccgagcgcgccgagcgctggatgcaagcggcggcggtcgatggtggcgagcgctgccacggcggctggctcgaggtcggcctcctcgagcgccgcgtcgatggcagcgcgcaggtcatcggccgttgcccgctgttccagcccgaccccgaccacgaccgtgcgcgcgatgatgcggggtgcggcgagaccgcgagactcaccgacgttgacctcgaccgctggggctcggcccggtcgtgcacggcgagcgagccagtcggagatcgcaaggccaggccgcggtgcgaagctgagggcagcgccgtcattgaggcgttgctggagccgtgcagggagcggttctgggccgagagcaggcagctcgtcgagcgcgggtgcatcgatgagatcggcactcgtcgtcacgaccgcgaccgcgcccgtcgcacgggagacggcctcggcgaggtcgttcgcacctcgatgggcgcccgtcagcacgacgcagtagcgccgggcgctgtcgagggcgacgatcgcgggcgtgacgcgcttcggggcgaggccgacctcgacgatcgcgcgtacgaccaccgggatcggggcgacgacgacgagcgcgtcgtagctgacgagcgcctcacggagcatggccatcgacgcgtgggcgaccgacgcaaagccgagcgtcttggcgaggtcagcgagctcggctccgatggcgaccacggcgccgccggcggcgccggtgacgctacgcgaactggggcatgaggtggacggggtggtctcgatggcttggcagcctacccgcttggcgagggcaggacgagggagcgcctcctctgcgaccgagatcgccggacgcccgtggcgatggcgggcacacggagcacctcgttgctagagtcgcgctgtggcgccgctgacgagctggatcgacacggatctcgagcacggctacggcctcgaccacctgccgctgggggtggacgccgagggcgtggtggtgcgcatcggggatgtcgccctacggctcgcgccgctcgtcgacgacgggttgctgaggagcgtgtcgcacgggctcgttgctgcacggacgctcggtccgctctttgcggccggctcggccaccatggcgcgactgcgagacgagatcgtggtcctcgcgagcggacgcccggacgacgccgtcgcacgtcggttggtctcgatcgatgcgctcgagctctctgtgccgatacgaccacgcacctacgtcgacttctacgcgtccgaggcccacgccacgaacgccggcaggatcttccgtcccgacggggatccgctgccggctgcgtggcgtcggctcccgatcggctaccacggccgtgcgtccaccgtcgtcgtgtcaggcacccccatcgtgcgcccctggggtctgcgccgcgagggcgagggtgtcgtgctcgggccgagcgcgatgctcgatctcgaggccgaggtgggattcgtcgtcggacgcgcgagcgagcgtggtcggccagtgtcggccggcgcgttcgcggagatggtcggcggcgtcgtgctcgcgaacgactggagcgctcgcgacatccaggcgctcgagtcgttcccgctcggccccttcgccggcaagtcgttcgccaccagcattagcgcctgggtcaccccactctcggcactcgacgcagcgcgggtgacgccgccggtgcaagatccggcaccgagtgccaacctcgtcgatccggacccatggtgcctcgatcttcggctcgagcttcgcctcaatggaaccgtcctcacgcgtccgccggccgccacgacctactggaccccgggccagctccttgcacacctcaccgacaacggtgcacccgtcgagccggaggatctcttctgctctgggacggtgtcgggcgcggcgcccgacgaggtcggttcgctgctcgagctcacctggggtgggacgcggcccgtgcgcctcgatgacgggcacatgcgtacctggctcgtcgacggcgacgaggtcaccatcacggccacggcaccggccctcgacggcggcttcatccgactcggcgaggtgacgggccgggtggtctcggccatcgcgtcgccttggtgagtggctctcgggactcgctgctggcggcggagctcgcgcattaggctcgcccgcgtgcctgttccatcgcgcttgctggtcaacaccggagatggcaaggggaagtcgtctgccgcgttcggggtcatgggtcgtgcatgggcgcgcggctggacggtgctcgtcgtccagttcttgaagagcgggacctggaaggtcggcgagcgcaagctcgccgagcatctcggcatcgagttctacgcactcggggacggcttcacctgggagtcgacggacctcgagcgtactgcggaactggggcgcgaggcctgggcattcgcggccgagcgcctcgcgagtggtgcctacgacctcgtgatcctcgatgagctcacctatccggtgcgctacggctgggtgagcgaggatgcggtggtggaggcgttgcgctcgcgtccttcccgtaccaacgtgatcgtcaccgggcggggggcgcccgagggcgtggtcgagctcgccgacaccgtgaccgagatgcgcaaggtcaagcacgcctacgaccaggggattcgtgcgcgcaaggggatcgagtactgacccggggcctcatcgtcggcgccgcacgctcgggcgcgggcaagaccgcggtcacgctcgggctcgtcgcagcgctgcgcgcgcggggcctgcgcgtcggggtggccaaggcgggtcccgactacctcgacacacgcttgttaggtcgagccgctcgccgtccggcgttcaacctcgacgcgttcctgaccggtcgtgacgggccggcgcgttcgctcgcgttggcggcgcgaggtgccgatgtcgtgatcgccgagggtgcgatggggctgctcgacggcgcgccgaccgccagcacgccacccgtcgcctcgagcgcacacctcgcgcgcacgctgggactggggctcgtcttggtcctcgatgcgacctcaacggcgcagacggtgggggcggtcgcgctcggtctggcgacggcgtctggcgtcgcaccgctcggtgtcatcgcgaaccgggtgcgctcggcgcaccatggggacctcgtagctgaaggtcttgctcgtgtcggtatcgcgctcctcggtcacatcgccgagggagcgctcgacggtcttgcgcagcgacacctcggcctcgtcgacccgagtgagctcgacgggttcgatgcgtggctcgagcgtgctcggtacgtggtggaggagtcggtcgacctcgaagccctggtgcgtcgggcgcctgagctccgcctggtcgaccccgaactcggcgaggcgcggtcccgggtgccggtcgcactctccgtggggccgagcgcgcgctttcgctacgaggagaacctgctcaggctggaggcagcgggagctgagctgctcccgttcgatccgctcgaggaggtccccgacccacacgcacggctgctgtggcttcatggcggctatccagagcattaccaggcggcgctcgccgacaacgggccgctgtggccggcgctgcgtcgggcggcgaacgagatcacggtgatcgccgagtgcggtgggtatgcgctgctcgcacgctcgctcgagggttctcagatggcaggtgtcgtgcccgtcgccatgcggttgggctcgcgtccggtcctcggctatcggtcggctcgcctggttgacggtcctttcggggctcggtcgctgccggctcacgagttccactacctggtaccggaggacgacccaggtgagatcgacgtcgtggacgcccgaggcgagccgcgcccaggcggggtggtgagcccgaggctcctggcgagcttcctgcacttccacctcggtgtggacccggggcttgcgggcgatctgctgcgtcgtgccggcgggggtgggtcgtccgagacggcgtaggatgcgccccgtgagtgggctcatcagcttcgtgggtgcagggccgggcgcgtccgatctgttgacgcttcgtgcggttgagcgcttacgcgcagccgacatcgtcgtctgggcgtcgtcgctgatcccagacgacgtcctcggcttctgtgcccctggcgcacagatccacgattcggccctcatgaccttggaggacgtgctcggcgtctacgcggccaatcccgaggcggccatcgtccggctccactccggcgatccgtcgctctacggggcgatccaagagcagctcgactggtgcatcgccaatgatcgcgccgtcgagatcgtccctggcgttacgagcgttgcggcgtgcgccgccgtgctcggacgcgagctcaccgtgccccaggtcgcccagagcgtcgtaatcacgagggtggcggcccgtacgagcgcctcgatgcccgaacgcgagcgactgcgggcctacgcggcactcggtgggaccctggcgatcctgctctcgggtgcgcatcccgagcgtgtggtcgaggagctgctcgcggagggttcggccttcaccgcgtcgacgccagcggcggtcgtcgtgcgggcgagttggccggaggagcgcttcgagcgcaccaccatcgcaggcatcccggaggccgttcgccgtctcggggcatcgcgcagcgtgaccatcgtcgtcggggatgcgctcgtcgcgcccggagcccgatcgcacctctacgcaccttcgttctcgcatcgtttccgagcacgctcgacggcgggcacgacgcaggggcgcccgcgggcccgcctgcgtcgctccgttcggtgagggcgtcgtgccaggcctgcggaccgggttcacgaccggtacctgtgcggccgcggccgccaaggcagcggccatttggctcgtccatcgtgagcacgtctcgcgcgttgagatcgccctgccgacggggcggcgagtcgagcttccggtcgagtgggatgcgctcgggcgggcctacgtcgagaaggacgcaggtgacgaccctgactgcacccacggggctcatgtgacggtgtcgctgaccccgctcgccgaggcacagctgcgcttcgtggccggtgagggtgtcggcacggtcacgcgccccggtctcgggctcgaggttggtgagccggcgatcaacccggtgccgcgccgccagatcaccgacgccattcgcgaggtgactgacgagggcttcgcggtcgtcgtcagcgttccaggtggcgaggcgatggccgagcggacgacgaacgcccgcctcggcatcgtcggtggtatctcgatcctcggcacgacggggatcgtgcgcccgttctccacggcgtcgtatcgcgcaagcgtcgtgcagcagatcgacgtggcggccgccgccgggcttggcgagatggtgctcgcgaccggttctcgcacggaggcgagggccatggccgagcgttccgatctcgacccggtcggcatcgtcgaggtcggtgacttcaccggcgtggcggtccgacgggccgcccaccaccacatggacccgatcacgtggtatgccatggtgggcaaggtgacgaaggtggcccaaggtctcatcatgacgcacttccaccgcgccgacgtggacacgtcggtgctgcgggaggccgcgatcgcggcgggagctccggcggcggtggtcgaggctgcggatgcgaccaacacggctcgacacttctacgaggtctgtcgtgaactcggcgtggttgcgccgctcgagctgcttgccgaacgcgcggcggtcacgttgtccgaggcgatcgggggccgggccacggtcgaggtcgtgctgtgcgacgtggacgatgccgccgtcgtcgtgcggcgttcggtgcctggcgagcgatgagcgtcgtggtcggctgggtcggtgacgacccctcgaacttgacgggtcgccagctgggcgccctcgagcgcgctcgtctcgtcgtggcgcctcgacggttgcacgaggtgctcggctcactcgcgccgcaggcgacggtcatcgcttatccgacaccgatcaccgagctcgtcgatctcgtccacgagaacccggacgtggtcgtggtcgcgagtggggacccgggattcttcggcatctcgcgcgtgctcgccgatgcgggcctcgacctcgagatcctgcccggaccgacgaccgcagccgtcgcggcggcgcggctcgggcgctcctgggagggcgcgagcgtggtgtcgttcgtcggtcgtgaccatgacgtggccctccaggtcctcgacgaggtgctcgctggtgacggtccggtgatcgcgctcttgtgtcccggccaggcactcgtcgacctcgcgaatgctgtggcggcttcgggtcgacggtcctggctcgccgttgccctcgggacggcagaggaggtcctcgacgaggcgtggcaggcccgctccgaggcgccgcgtgtgccgagtctgctgtggatcgatggagctctctcgcgccgtgaggtggtccatcggatgcgcggtctcgacgtcttcgccgatcgacctcgagactcggacggcgtcttcacgagtctcgaggtacgcctcgtcgcggtcgcacgactcgctccggatcgactcccaccgggcgcgcgggtgctcgaggtcggcgcgggcacgggatacgtgggtctcaccctgtggcgcctacgtcccgacatcaccatcgtgcagctcgagccccgcgcggagcgtgcggctcgagcacgcgagcatgcgcgagcgttgggtgcgcgtgtcgaggttctcgaggcacgcgtcgaagagcatgctcccgagggcgactacgacgccgccttcgtcggcggtggcgggccgcgtgcgctgcgagcgacgctcgatcgcgtccgaggtgggggtcgcgtcgtcgccacgttcgtcgatcccggacgagccgcggtcgcccgagagctgctcggcaacctcgaactcatcgaggtcgcggacgcgtctcctgtcgcgccggaaggggtccgcttcgttccccgtagtccgatcttcctcgcgtggaggtaggagtcgggggagctggctcgagggccgaccgtgcgagctcgtacagtgatggatcgttgcccgcgctcgatggatcgtggctctcgcggttcgacgacgagccggcgcgcggaggcccgtgccgggctgagggagcggtcctcgctcaggtagccgttgtgggtgctgccacggtcgggcgtggccggtgacccctccagcgaatgttgacgggggtcagagggagctgggcacgcgcgtccgctccggcacggtgtcgacaggcacggccgaacggtggtggggctggaagcgagtctcgtcgctcctctctcgcgcggcaacgatgccaacggatcgatcgggtccgagacctctggcgaggcttcgtaccggcgcgacaaccgtgccgctacgcggctcgctgggggggaccggggaggtagcgatgcgtcacagtggctcgagcacgacgcctgcgtaaggtggggcttgccgaatgccgatagacagtgggtcctcggcggactcgcggatcaggggtgcgggtgcggttgcgaggtgccggaggaggtgcgcacatgacgtcgtggtacgggcggagtcggttgcacgctgggatattggtcgcggtcgcggggatcgggctcgccgcttgcggacaggcgacctcgtcgacgcattccacgagctcgtctcgctcgtcgtcgactccgaagcgttcctcctcgcagacttcgtccactcgctcatcgtccgggtcgtcatcgacccccgcagcggtcgccccatgcgatacggcggcgttgtccgcgtcactcggccaaccaagtggggcggcgggaacgacctactatccgctcctcctgacgaacgtgtcgtcgcggtcgtgcacgctctacggctacccgggggtgtcgctcgtcgtgtcggcgagtggttcgcaggtgggccgatcagccagccgcgtcgcggggagcgagcagacggcgacgctcgagccaggacagtccgcgcaggccatcctcggcatcgaagtcgcgcagaactacccgacctcgacgtgccagccaaccaaggtcggaggcgttcgcgtctaccccccggatcagacgactgcactgtacgtatcggcgcctgagctctatggatgcgccaaccgctcagtcgacctgctgaccatcgaaccgctgacacgggcccaatccggtaccggcagtggttcggggggtgcgacgtcctgaagcgtcgggatggggcaacagacgtggtggagaggggtcgcgaactgctccaacagaagtccgtgcaacccatgcgtacgcagagtcgagtgcgagcgtggccctgtgaacctgaccgagtgggcacgtcgccaggggatccacccgcagaccgcctccactggatccatgctggtggctagctccctgcaacgagaccccccgctctgtgaggagcccgaccagcatggacaggcggagggagcgcacatgaagggcacgaacgccacacctcggagcagatcctccggaggctggccgaagggggacgagagccaacgaggggccacggtcgccgaggtcgctcgcgccctcgcacatcaccgagacgacctggcagcggctggaagcagaccgacggccccatgaaggggcccgacgtgaagagggtgaaggagctctcggccgagaaccggcgcccgaagaagctggtggctgatctcgccctcgacaacgacagctctgaggagctggccgagggaaacgtctgaccccggaccgccagcggggagccgtgcacctactccgccagcggttcgcaggtcacctgagcgacagcgtgcgaggcgcaggtcgggcgggccacctgactgcaccttctcacagcctcggccaagcgttggaaggctgctacggtcgagagcatcggcgcccaacgggaccagcgagcggacgtgcgcgaacgtggtctcgcggggaaggcggacgtggttctggagccggccagcgacaccacggtctcgggcgtgacccaggtcggcagctgcctccggcgttcgactcgactgcctggttagagtgcttcctatggttgcacccggcatcgatctcgacgacctcgaccccaccgttcgccctcaggatgatctgttcggtcacgtcaacaaccgctggtttcaacggacggccatccccgacgatcgagcacgctacggcgcgttcagcgagctcgccgacgctgcagagatcgcggtgcgcgaactgtgcgagcaggcccgtgaggctccggccgggtctgaggagcgcaagctcggcgacctctacgcgagtttcatggatgccgaacgcatcgaagagcaaggcgccgcacccatcgctccgctccttgcggcgatcgacgacgtcgccgattacggatcgttctggcacctgctcggcagtctcgagcgcgatggtgtgcgcggcctcgtcgacctcttcgtcgacacggatcctggtgacccttctcgctatctcgtcttcgtctcgcaaggtgggatctcgctgccggacgagcgctacttccgtgaggaacgcttcgcatcggttcgtgccctgcatcgacagcacgtggcgacgatgttcgagcttgctggcctgacgaacgcggccgcgagggccgcagcggtcgtcgagctcgaggcggcgatcgctgctcgccatctcgacaacgtcgcgagtcgcgacgcgctcgccacctacaacctcatgacgtacgaggacctcgtcgggttggtcgcgcagggccaccgcgaggccgaggcgttcctcgaggcctggatcgacggtatgggcgtcgatcgtgcggtggtccgtgaggtcgtggtgcgccagcccgccttcctcggctcggtcggtgagctgttcgaggatggtcgaatcgatgtctggcgcgactggctggcctggcacgtcattgcccacagtgctccgctgctctcgacacgcttcgtcgaggagagctttgccttctacggcactgcactcaccggtgctccgacgttgcgggcgcgctggaagcgtgcggtgtcattcgtcgagggggcgatgggggaggcggtcgggcgcctctacgtcgcgcgccacttctccgagcctgcaaggcatgcggtgcgcgagctcgtcgaccacctgctcgatgcgtaccgtgagagcatcgcctccttggagtggatgcgcgaggagacgcgggccgaagcgctcgccaagctcgaggcgatcgtggtcaaggtcggctatcccgacgcctggcgtgactacggcgcgctcgtcgtcgacccggaggatctcatcggcaacgctcggcgcgcggcgtcgttcgccatggacttcgaactcgccaagatcggtcggccggtcgatcggtcggagtggttcatgacccctcagacggtgaacgcgtactacaacccaggcttcaacgagatcgtcttcccggcagccatcttgcagccgccgttcttcgatgccgaacgggacgccgcggcgaactacggggcgatcggcgcggtcattggtcacgagatcgggcacgcattcgacgatcagggctctcgttacgacggtgagggccgtctgcgcaactggtggaccgacgacgatcgggcgaacttcgagcatcggacgaaggcgctgatcgaacagtacagcgcgctcacacctcgacagatccccgagcaccacgtggacggggcactcaccgtgggcgagaacatcggcgacatcggtgggctcgcgatcgcgtggcgtgcctacgagctcgccctcgacggcgcggagccccctgtactcgaggggacgtcaggtggagagcgcttcttcttctcatgggccatctgttggcgagagcaacgccgtgacgaagaggcgctgcgattgctcgcgatcgacccacactcgccgccagagtttcgctgcaatcaggctgcgcgcaacgtcgacgccttccaccagacgtttcacaccgatccgtcgtcggggctctggcttgaccccgaggagcgcgtgcggatctggcgtgcctagctgaccgcgagaaccgagactgcatgcccgagtgacgtctcgcgggctgtcggccccggtgctaccatcggctcgagcacaggggggaccatgccgtactaccgtcgcgtgggtgaggtgccgcgcaagcgccaccagtacgtacgtgcgcacacaggcgcgcgtatcgccgaggagctgatgggcaaggagggcttcgcggcggagtcgtcgctgctctaccacctggggcggccgacggccatcgtggatgcagcacccgtcgcgattgcgggcaccaccctcgtcgcgaatcgtccactgctccctcgacaccttcgcacgcccaagctcgccggcctcggtggcgacgctgccacggaccggcacctcttgctcggcaacgacgacgtgtggatctcgtgggtggtggcggatcgtccgagctcgctgcagcgacacgccgtcggggacgagtgctactacgtccatcgtggtacgggcgcgtgcgagtcggtcttcggcaccatccgagtaggtcccggcgactatctcgtgttgcctgcgtcgacgacctatcggctcgtcccggacgaaggttcggtcctcgagtgtctggtgctcgaggcccggggtcatatcgagatcccggaccgctacctctcccagcggggtcagctgctcgaggcggcacccctgtgcgagcgagacctgcggggccccgagggcccgctcgtcgtcgagggcgaggacgtggacgtgatcgtgcgtacccgtctggacgccacgcgttacacctacgcgacacaccccttcgacgtcgtgggttgggacgggtgctgctatccgttcgcgttccagatccgcgacttcgagccgatcgtgaagcgattccacgcgccaccgcccgtgcatcagacgttcgccggaccgaacttcgtcgtgtgctcgttcgtcccgaggccgttcgacttcgatccggaggcggtcgcggtgccctaccaccatgcgaacgtcgactccgatgaggtcctcttctacgccgacgggaacttcatgtcgcgggcgggctccgggatcgaggcgggttcgatctcgctgcatccgtcgggcttcgtccacgggccccaaccgggttcggtggacgcagcacggggtcagccaggcaccgaggaggtggccgtgatggtcgataccttccggccgctcatgctgtcggagacggcactcgcgatcgacgacgacgcctacccgtggacctggtcgaggcgcggtcctggagcgcagtcgtgagcaccaagccgttcgcctcctcggcagacctcgcgcccaagcacgaggtcctcgagcatctcgccgatggtgtcgtcgccttgaccgccgaaggtgaccccaacgtcggtgcgatcgcgacgagcgaggggctggtctgcgtggaggcgcgtgcgacgccagtggcggctcggcgctggctcgagcgactgcacggcgtgctggatgggccggtgagctacctggtgctctcgcactaccacgctgtgcgggtgctcggggcgagcgccttcgacgcgggtgcgatcgtggcacacaccgccaccgccgaactgatcgaggagcgaggtgccgaggactgggccagtgagcaggctcgcatgcctcgactgttcgaagagccggcgtcgatcccgggcttgacgcggccgacgctcaccttcgccgacgagctgcgtcttggccgtgggggtggacgaggcgacatctggctgtggtggcttggtcggggccatacccgtggagacatcgtcgtgtggttgccgcgcgagcgggtgctcttcgccggcgatctcgtcgaggcccgggccgcgctctacacgggcgatgcctaccaccgcgagtggtcgggcccgacgctcgatgcgatcgccgacctcggtgccgaggtgctcgtcgggggtcgaggggccgtcgttcggggcagggaggccgtggcggcggcgatcgcgcagtcgcggcgcttcctccaggtcctcatcgacgagtcctcgcgcgcgctggacgccggtggcggcctccgcgaggccttcggcgcctgctacgaggctctcgcgccgacctatggctcctggccgatcttcgagcacaccatcccgttcgacgtcgcccgtgtcgtcgaggaactccaaggggtcgagcaccccacgatctggacgacggagcgcgatcgggccgtctgggacgagctgcaggggtcacggtgacgagggcctggccggtcgcgatcgtcggtggcggtccggtcgggctcaccctcgcactgtgcctcgcgcgccagggcgtgtcctcggtgatcctcgagcgcaacgacggcgcgacgggcgagggctcgcgcgcgatctgtcagcagcgcgacgtgctcgatacctgggacgcggtcggtgcgtcggcgatctggcgagagggcctgacgtggtcgagggggcgtacgtacgtgcgcgatcgggaggtgcgcacggtcgagctcgccgatgtgggtcgcagcgagctaccggcgttcgtcaacatctcacagctgcgcgtcgagtcgatcctgcgcgcgctcgtcgctgagcgtccgatgatcaccctccggactgggttctgtgccacgagcatcgtcgacgacgacgcgggtgtgcgcgtcgtcgggtctcgcggtgaggtcgtcgaggcagcgtgggtcgctgtgtgcgctggcgcgcacgccgatggcctgcgacgtgcactcggcgtcgagctcgctggcgagacccaccccgatcgcttcttgatctgcgatgtgaaggtggatctcgacaccgagagccctgagcgtcgcttctggttcgatcccgagtggaaccccggccgacaggtgctcctccacgcccagccggacggcctcgtacggatcgactggcaggtacccgaggcgttcgatctcgaggccgaggcgcacaccggccgactcgacgagcggatccgagccgtcgttggcgaacgcccctacgacctcgtgtgggcgagcgtctatcgcttccatagtcggctcgccaccggtttcgtcgtgggacggagcgcgctcgtgggcgatgcggcgcacctcatggcacccttcggcgctcgcggtctcaacagcggggtgcacgacgcggagaatctcgcgtggaaactcgccgcggtcctgcggtcgacagctcccgcgtcgctcgttcgcacctacgacgaggagcggcgccaggccgctcggcgcaacctcgaggtgaccgctgcgaccatgcgctttctggcaccgagggacccccacgaccgccagcgacgcgaggcgatcctcgccggcgccttcgctggcgacgccgaggcgatggccgcggtcgactccggtcggctctacgagccggcgtgctacgacggatcgtcgctcaccaccgacgatccccggcgcgcatggttgggctatgacgacgccggtcgacccatcggtccggcggcgggcatgctgctccccgacgtaccgacggccgacggtacccgggtgcgcgcgcagctgcgcttcaccggcgggatcatcggaccgggctgggttcgcgaggcaaccgagcgagtgcacgcagacctcggcctcgcgatggtcggcctcgagcgggctcacgccgaccccgacggcgtcctcgcagacgcgctcggactcgaccccgacgaaggggtcgtcgtgcgtcccgactgccacgtcgcgggctttgcgaccagcccgtcgtcggcggtcgcggtcgccgcacgcgcttggggctggggaggaggtgtcggcgggtcgtaggctgggccgacgtgactggcgcgctgctcgtggtcgggaccggctcgaacgtcggcaagtcgaccatcgtcaccggcctcgtgcggatcctcgcgcgccgtggggtcgcggtcgctccgttcaagggtcagaacatggccctcaacgccgccgtcaccgtcgagggaggcgagatcggcagagcacaggcggtccaggcgcgtgcggcgtggcgcgacccgagcgtcctcatgaacccgatcctcgtcaagcccaccggtccaggccgcagccagctcgtcgtgctcggcaagccggccggcgagctccgtgctgcggcgtggctcgagggacgtcgggggctgtggccgatcgtgctcgacgccttcgacgagctgcgcagcagcgtcgacgtggtgatcgccgagggtgcggggtccgcagccgagatcaacctgctcagtggcgacctcacgaacctcgccctcgccgaggctcgtggcgtgccggcggtactggtgggtgacgtcgaccgtggtggcgtcttcgcgtcgatctacgggcactacaccgtgctgccgccctcgctggctcgccacctgcacggcttcgtgatcaccaagctccgtggtgaccccggcctcctcggcccgggcgttcgcgagctcgaggatcgcctcgcgacccgttgctacggggtcgtgccctggcacgagatcgccctgccagcggaggactcgctcgtgcgccaccgcgccacggcgccgcgggcaccagggcagctccgtgtcggggtggtggcgctcccgcacctcgccaacgagaccgatctcgatccgctcgttgccgagggggtcgcgctgtcgtggatcgacgacccgagtcgtctctcgggtgtcgacctcgtcatcgtgccgggatcgaaggcgaccgtggccgatctcggctggctccgagcctcaggcattgcggccgccctcgaggaccaccttcgtgagggcggatggctcttggggatctgcgctggctaccagatgctggtcgacgtcatcgacgatccggtcgaatcgggggaggggaccgtggcaggactcggcctcgtgcgagggagggtgcgttttgggcccgagaaggtcctcgcgctcgtcgaagggtccctgcggtggccagaggctgcctcggttcgtggctacctgatgcaccatgggcgcgtggtgagcgaggaagagccgttcgtcgcgctcggcgacggtcagctcgagggtgcccgacgcggtcggatcctcgccaccgccgtccacgggatcctcgacgacgaccgggcgcgccgggcgctcctcgaggccgtcgccgaggatcgaggtcgcacgctgccccctccggtggccttcgccgcctaccaggaggcgcgcatcgacgaggtggccgatctgctcgaggaacacctcgcgctcgacgcactctgggggctcctcgggtcctaggctcgctgggccgtagggtggccacgagggggccacgaggggagggacgcatgcgcatcacggtcgcgacgaacgccgacaccgaggtgcttgcgctgcgcatggcctgggaggatctcccctcgaccatcgagctccacgtcgccgcgctcggcgagctgctcgagacctggcatcccatcgagggcgacgtgctcgtcgtgcgcgcgctcggcgggatcgcggcggtgcccgacccggcacagctcgcgaccagggcacgcgctggaggagctcacctcgtcgtccttccgggcgaggcgaccttcgacgtaccgacggcacaggcttccacggtgccgatggccgtcgtggagcgcgccttcgcctacgcccgtgaggggggtgctgccaacctcgcgtcgctctgtcgctacctcgccgtccggctcggcggtgtcgaactcgacgtcgcagagccggtgagtatcccgttcgtcgggagcatgggccacacgtcctggtgcgagcgtcatagcgggccgcgcatcgcggtcgtggtctatcgcgcccatctcatcgccggcaacacgcagttcgtcaccgatctcctcgacctcgccgagcagacgggcgtcgcgctcgaggcctggtgggcctactccgcacgcggagaggcgggtcaggtcctcgcggccgagctcgaggcgtccggtgtcgacgtcgtcatcaccacggtgctcgcgggcggcgagaccgaggggctcggttgggatgcgggtccgctcggcgggctcgacgtgccggtcgtccaggcgccgatctcgaccgtgtcgcggcaggagtgggcggcctctgctatgggtctcgtcccgttggacgtcgccatgtcggttgcgattcccgagtacgacggtcggatcatcgcggtgccgatcgcctacaaggagctgatcgatgccgacgaggtcttcggggcgccggtgcacgcctatcgcctcgatcgcgagcgagcgcatcgtgtcctcgaacttgctcgccgcctcggtgcgctgcgccgtcgcgccaacgacgccaagcgcgtggccatcgtgctgtcggcgtacccgaccaagcgctcccgcatcggtaacgccgtgggtctcgacacgccccagagtctcgtgcgcctgctgtcgatgctcgcggagcggggttggcggctcgagacccccgacgatcccgacgcactcatggcgcgccttggtgcgttgctcgatcccgaggccccgagcgagcgtgctcgcggaggcgcgaccctctcgatcgatgcctacctggcgtggtacgcgacgctccccggtgagctccgcgacgaggtcgaggcggcctgggggccgccgccgggctcgcgctacatcgcggagggatcgttgtggttccccgcgatctggatgggcgatgcgctcgttgcgatccagcctcctcgcggctacggcgagcacgagatcgcgatctaccattcgcccgagctcccgccgtcgcatcactacctggccttctaccactacctcacggcggttgctggcgtcgacgccgtcgtgcacctcggcaagcacggcacgctggagtggttgccgggcaagagcgtcgggttgtcgtcgtcgtgctggccggacgtcgcgctcggctcggtgcccctcgtctacccgttcgtggtcaacgacccaggtgagggcgtgcaggcgaagcgtcggagccacgcggtgatcgtggaccacctcgtaccgccgctcacccgagccgacagctacggagccatcgccgatctcgagtcgctgctcgacgagcaccagcgggtcgcggccctggacccatcgaagctccccgagctgcgagcggcgatctggtcgctgctcaccgagtcgcgcatccacgaggacctcggtatcgacgaggccccgagcgtgcgcgacgacgccttcgacgacctgctgctcgacgtcgacggctacctgtgcgagctcaaggacgccacgatccgtggtggcctccacatcctgggcgcgccaccggtcggcgaggcactcgtcgatctcgtggcccagatcgttcgggtgccgcagttggacgtgccgagccttgccgaggagctcgatcgcctcgaaggccgtctcggcgacgggagccgtgcggcgcgcgacgcctctgacgggcgcctccacgagatcctgtgggccctcgccgagcgcgattgggatccggaggtgctcgatgacgccgagtggtgtgcgagcgtcggtcttgaggccgccccggacgacctgcgtacggcgctcgcctgggtcgccggatcgctggtgccgaggatccgcggggcgagccgagagctcgcggccgttgcggacgcactcgaggggcggccgatcgcacccggtccggctggtgcgccgtctcgagggatggcgcacgtcttgccgactggtcggaacttctacgggctcgatccacgagcggtgccgagtcggctcgcctggcgtaccggccagcgtgcggcagccgcactgtgcgagcgctttcgacgcgacagcggcggcgagctccgtcacgcgagcatcgtgctctggggtaccgcggcgattcggaccggtggtgacgacgtcgcgctcgccctcgcgctgctcggggtggagccacgatgggacgcgatctcgggccgtgtggtcggcctcgagctcgtgccgctcgaacggctcggccgagcgcgtgtggatgtgaccgtgcggatctctgggctgttccgcgatgccttcgcccacgccattgcgctcatcgacgaggccgtcgagttggtcgccaaggcagccgacgagggcgatgcgaacccggtggctcagagcggggcgggccctcgcatcttcggcccaccgccgcgtgcctatggttcgggggtgctcgagctgatcgagcacggggcatgggagagttcggcagatctcgggcgcacatgggtgcgctggtcgcagcatgcctacgggcgcgggcgcagcggcgaggaggcgactggggcgctctgggatcgacttcgtagcgtcgaggcgatcgtgaaggcgcaggacaaccgggagcacgacatcttcgactccgacgactacctccaagagcacggcgggatgatcgccgcggcgcgcgcagccggcaacgtctcggttcggggctacttcggtgacacctcgcgaccggatgcacccacggtcaggagcatcgaggaggaggctgcgcgggtcgtccgtcagcgggtcgtgaacccgaagtggctcgaggggatgcgccgtcacggctacaagggcgcgttcgagatggcggcgacggtcgattatctcttcggctacgacgcgaccgccggggtcgcgcgcgactggatgtacgacgcggtgacggatgcgttcgttcgcgatcgcgagaaccgatcgttcctgctgcgcgtgaacccctcggcgctcggggcgatctgtgcgcgcttgctcgaggccgctcggcgcggcctgtggcacgccgacgacgaacgcctggctgcgctcgcggagggcagcctcgaggcagagggggccgaggagtgatccgcatcgacagcgtcgagggcaacgacgaggccaagctcgccatcgcactgctcgcggtcgatccgaccattggcggcgtcttgttcgtcggacctcctggcgtggcgaagtcgacgctcgcgcgttcgctcgccgaccttggcgaggacgcccccttcgtcgaggtgccgctcggtgcgaccgaggacagggtcaagggttcgatcgacgtcacgagtgcgctgcgcgacggcgacgtggtgctgcgccgaggtcttctcggcgctgccgacggtggcgtgctctatctcgacgaggtgaacctccagcccgatcacatcgtggatctgctgctcgatgcggcggcgaccggcgtcaatcgcgtcgagcgagacgggctgtcggccacggagccggcacgtttcgccctggtcgccaccatgaaccccgaggagggggccttgcgtccccagctacgcgatcgcttcgccatgctggtcgaggtcgggccgccccccacgcgagaggcgcgcctgcgggcgcttcggcgagcactgcgcggcgagaacccgagtgtcgacgccgaccgcagcaccgtcgtcgccgcacgagaacgtctctcgcaggtcgacatcggcgacgccatcgaggcagcggtcgacgccgcgatcgctgccgacgtagcctccttgcgtgcggacgtcgcgatggtgcgagcagcacgtgcgcacgctgcgctctcggggaagacggccgctggagccgacgacgtgagggcggtcgcgcccctgatcgtacgcgggcgaacagggagcgcaccacgcgtctcgtcggcgacgggagcctcccgcgctccgtccacgacgccacctccgccagcggtgcgttcgcccggggatgctcgcggtgagctcggcggtggggcagcggatcgcggcggctcggcgagctcggtgacgtcgtcctcggcgcgtcgaggtcccgatgaccgcgagggggtctcgtccgagggggtctcgtccgagggggtcgcgtcgacgagtgcgggtggcgaagccggcgacgctgccggcaccgataccgatggcgaggctgtagctggggagcgatgggcggcgggccagcgccacccgctggtcgggggagcgctctcgcgtgtgcgcgctcactcgggggcgttggggcgcgaggcccacgaactcggtgcctccaacgacgccggtgccatttcggtggcgcggagcgtgctcgcgcgactcgagcgtcaagggggaggcccgctgggtccggaggacctgcgccgaaccgagcgagcacgccgcgaggcgcgctgtgtcgtgctcctcgtcgacgcctcgggctcacaggctgccgaggtcgcgttggagatcgcttcgcaggttgccgaggaactgctcctgcatgcctaccaggcgagggcacacgtcgcggcggtggccttcggcggcgacggtgccaccgtcgtgctgcggcccacgcggtcgatcgaggtcgcccgggcgcgactcggtgcgatcgagcgccgcggtgcgacgccgctcgccgctggtttcgacgtcacggccgagctcgtggtgcagctgcgccatcgaggcatggagccgctcgtggtcgtggtgaccgatgggcgtccgacggtcggtgggcgcgggctcgggccgatcgaagcggccctcagcgctgctcgcgagctgggtcgcctcggtgtcgacggagtgatggtggaggtgggtcgcgcgtcgcgtgatggcctcgaactcgccgcgcgactcgcggccgaggccggtctcggtcacgtcgtcgctgctgatgcgtgagccagggcgtcggcgagcacggtgtcgagcatggctggcgtgaggcgtcgaggcgcggtgttctgcggactcgggtggtagctcgcgaggacgaggcggccacgtccgagttcgatgcgttctccatgtcggaaccggccgagcggctcgccgagcgctgcggccagagccgaccatgcgatcgcaccgagcgcgaccgcgcttcgccacggcacgagctcgagctcgcggacgaggtagggtctgcaggcggcgagctcgccagcacgaggccggttgtcggggggtgcgcagcgagcggcggcgctcagccagacgtcggtgaggacaaggccgtcgtcgcgactggtcgaggtcggctgattcgcaaggccgagtcgccacagcgctgcggtcaagaaggcggccgacgggtcgccggtgaacatgcggccgtgcgcgttcgcccctcggcgcgacggcgcgaggccgacgacgaggatgcgagcagccggatcgccgaagcctggcaccgggagggcgacccagtcggattggctggtggttcgccgccactcgacgagacgatcgcatcgacagcacgtgaggatgtcctgagcgagctgctcgagtgccgtggccatgtgcggagcctatccgtcgcggccggaatggcgacggccgcgcgagtgttacagacaataggcacaccgttgaggtacgaaaggagacgctatgcacgtccttggactcactgtgctggtagcacttggtatttggatcatcgtcgcgcttggagcacggtggtacaggtctgccgttgaggcccggtcgctggttgcgctggtgctcggcgtcgtcgtcgcctggctcgccaacatcgatctgtggcgcttgtggtcgctgcccgacctccgctacggctgggtgggcgtgacgctcaccggcctcgcactcggcgggctcgccctcctgtgggatggcgtgatcggactcgtgagcggcctgtaccgcaaggtcgaggacgaggccgagaccttggagcgacgtgatctgaagcgcgtcgcctgagccgaagctccacttcagcgggcgtcgtcggacgacgagcgtccagatgccagtcccgaggcggcaggcgtgtgcctgccgcctcgctcgcgtcgagcgcccgatcgcctcgcggggttcgtgcgctcggcggtgatggcagcgacgaggcgctcgagtagctccttgaggccgacgggttcgtcggcccggccgcactggtgttcgtggacctcggcgagctcctcgaagctcgcaagatcgccgtagcgtccctctcgctggcggagccacgaggcgatggggcagcgctcgtcacgctggtgcgcaaggggccgaccggcgcgtgctgcgacgaggctcgccagcaggggcaggtcgtcgagggggaagggcgcgatggaggcgaggagcgcccgtgcaccggagcggagcctggtcgggaccgtcggttgtggacgaccgagtccgtagccttggacgaagcgtcccccaatcgctcgccacatggcgaggtcctcggtggtctcgatcccttcgccgacgacctcgaccccggcgtagctcccgagcgcgagtgcagagagcgagcttgcgaacgaccgtgggtccgtcgcgagggaggccaccagcgagcggtcgaccttgagctggtcgatggggaggctgtggacgtaggccatcgacgcccagcctcggccgaagtcgtcgatcgcgatgcgagccccgagggcccggatcgcctcaagccgactcaccgcgctcgcgagatcgtcaccgagcgagtgggcctcggtgatctcgaggacgaggcgctcggtcgatgcggtgcggatgacgcgcgcgacgtcggccgcgaaggtgggcgtgaggaggtgacgcgccgcgatgttgacggccacggcgggcagtgaggggcgctcggcgaggagcgtgcaggcgtgctcgagcgcgtccaggtcgaggcgtcgggccaggtatgcatcgcgctcgaccacgtccatgaacgcatccgcggggacgacctctgccccgtcgtaccaacgcgcgaggagctcgacgccggcgagacggcccgcgacgaggtcgacctggggctgataccagaagcggacctggtcggtgccgatcgccgaggcgagcttcgtgcgcagacggtggcgacgatcggcaagccttgccatctcgtcttcgaagatgcgtgtgcgacctccaccctggctcttggcgtggtacatggcctcgtcggcgtgcgcgagcagcgtctccacgtcgacgccgacaggaccccagagcgcccaaccgaggctcgcgctgagcggtccgccgggggtgggcacggcggccgcggcgtgcaccgcctgcgacagggtcccgagatccatgctgtcgaggcgcgcgaggagtccgaactcgtcgccgccgaggcgcgccacgtagagctcaggagggagtgcggcgagcgacgcgccgacctcggcaaggatgcggtcgccctcggagtgtcggtagacgtcgttccattccttgaacccgtcgaggtcgaggatgccgagtgcgaggccgacaccgtcctcttcgacgcgacggcagcgtgcctcggcttcttcgaggaacgcccgtcggttcggcaggccggtcagcgcgtcgcgcagcgcgacggtccgttgggcatcgcgttcggcgcgcaaggtcgcctcgaggcggatgcgtgctcgctgggccgcgaggctggcggcaacgcgctcgagcagcagcaactcgcgattgccactgaccgggctgcgcacggctcgagcgcacaggacgaggtcggtggcgtcggggaccggggtggcgaacagccagtcttcggcaccggcacgggcttcggcccatcggacgggtcgtggcgagaggcggacctgtccggagtgaccttcgcgtcgcactcgctcgcacagacgtgacaaggcggtgcggcacggggcggcgaggtcgcgctcggacgagcgcgagagcccgagcgtcgtcgaaccggcgacgagcgccgcaaggtcgaagacgcctgtgtccacgaggctcttcgtcgtgacgtcggcgagttcggtctcggtccgacaggcaaggaggcgatccgagccggttgcgagcgcgtcgaagagtgccgcgagcgccacgcgttctgcgaagccggccgcggtctcgagcgcctcggtcgccgtgcgtccgatctgctcgagcagcgcggcgatccgttcggggtcgggcgccccgggttcgacgagcgcgacgagcactgctcggacctcgtcggcgaggacgagcgggatcgcgaccgcgagcggcacctggcggaggcgtggttcggctcgccagtggtcggggagctcgaggtgggaggccggtcggcgcaccacgtagcagcggcgcgcgtcgcgcgcgaggtcggggatggtgagctgtgtgccgtcggttcgtggttcggggagcagtccgacgacgctgcgcatcgtcccgtaggtggcgaggcgctcgaagcgtcgctccccgtcgctcgtggcgagcgcgtcgacagcaccaacgccgggcagctcggcgaggtggcgcgcgagctcgaggatcgtcgactcgggaggttggtcggtggtggagcggagccaggcgaccagtcgatccgtcgccgcctcgagctcgcgcgcccgcgcgcgacgctgctcttggtggagctcggctgcggcctgggcgagggcgtcgagcaccagcgccgtctcggggggcaggcgcgccaggtcggagcggtagagcgagaggagatagcgggtcccgtcgtcgcaggccgcggccgccgagagcgaaccttcgatgccgaagggtcgggctcgctcacgccagggcgcaaagatcgcatcgtcgaccgtggccacgacgggggagagcgaccggagggtcgtgcccgccggcccctgccccgagagcgaggtggggtcgtcggagagctcgaggtccgcacagtacgccttggccgtgccactggtggcgagaatggtcgcgtggtgctctccgggatcgaggcgcgcccagaacccggcgagcgtgggtgggacacacaaggtctcgagggcgtcggcgaggcgttcctcgaagcttcgtccgtcggcgcgccggagcacccgctgggcctggaaggcctgcagcacgagctcgaggaccgctgacggtcgctcgagcgcggggtcgacgacgctcatggtactcctcgcatacgctgcaactcagtatcgtacgccccagggcgctcttgagccctcggcgacggtcgagccctcggcgacggtcgagcccccggcgacggtcgagccggtgcggtaggctcccaccatgaacaagaccgagatcgtgcgagctcgcatcgacgacgacgaggttcgagcgccgatcggcacacttctcgtcgagctcgtggggcgcgacgtcccgcacgtgtgctatcacccgcagctcggcaccatcggtacgtgcgatacgtgcctcgtcgaggtcgatggccagctggcgcgagcctgtgaggtgtcgctccgcgaggggatgcaggtgcgtacgcgaggtgtggatgtgcgtgcggctcgcctgcgtgccgccggcgccctgctcgccaaccacgagctctactgcaccgtctgcgacaactccaacggcgactgtgtgctccacgagagcgtccgcgacctcggggtgaacgaggagctggtgccctttacgcccaagccctacgaggtcgacgcctcgcaccccatgtatcgctacgacccctcgcagtgcatcctctgcgggcgctgcgtgcaggcctgccaggaggtgcaggtcaacgagacgctcagcatcgattggtcgctggagcggccgcgggtcgtctgggacgggggcaagcccgccggcgaatcgagctgcgtgagctgtggccattgcgtgagcgtgtgtccgtgcaacgcgctcatggagaagagcatgctcggtcgcgccggcaccctcacggggctcggccgagctgcgctcggtccgctgatcgagctcaccaaggcgaccgagcctgcgatcggcctcgggcccatcttcgcgctctcggacgccgaggcgcagatccgtcgcggcctcgtgcaacggaccaagaccgtgtgtacctactgcggcgtcggctgcagtttcgatgtctggacgcgaggccgcgacgttctgcggatcgcgcccgagcgaggccccgccaacgggatctcgacctgcgtcaagggcaagttcggttggggcttcgtcgacgcgccagaccgcctggtgcggccgctcgtacgacgtgagggccacttcgaggaggcgagctgggacgacgcgctcgacgaggtcgccggccggttgcgtgcgatcgtcgccgagcacgggcctgacgccgtcggcatcatcgcctcctccaagtgctcgaacgaggaggcctatctcgcccagaagcttgcgcgggccgtcatcgggacgaacaacatcgacaactgctcgcgctactgtcagtcgccggccaccatgggcctgtggcgaaccgtgggctatggcggtgacgccggttcgatcagcgacatcgccgcagcagatctcgtggtcatcgttggctccaacaccgccgagagccaccctgtcatcgcgacgagggtgaagcgcgcgcacaaggaggggcgatcgaagttcatcgttgccgacctgcgccgccacgagatggcggagcgagcggacctgttcttgcgtccccggccgggtacggacctcgtgtggctggcggccgtgacgcgactgatcatcgaggagggactggccgacacgagctttctcgacgagcgcgtcgagggtttcgacgcctacgtcgagagccttgcggccttcgacctcgcgaccgcgacgcgcctcactggcctctccgaagagcagctgcgcctcacggcgcgcatgatcgccgaggccgaacgcgtgtgcgtgctctgggcgatgggagtcacccagcacgagggtggttcggacacctcgacggcgatctcgaacttgctcctcgtcaccggcaactatggccgaccgggcacgggggcctaccccttgcgtggccacaacaatgtccagggcgcgagcgactttggcgccatgcccacgtacttgcccggctatgagcccatcgccgacgacgaggtccgccagaagtggtcgacgctgtggggtgtggaggtcccggatcgacccggactcgacaaccaccagatgatcgacgcgatccacgccggctcgctgcgggcgctcgtcgtcatcggcgaggagctcggcatcgtggatgccaacgcgacctacgtccaagaagccctcggctcgctcgagctcttggtggtggctgatctcttcctgtcgcgaacggcgtcgtttgccgacgtcgtcctcccggccgcgccatcgctggagaaggaggggacgttcaccaacaccgagcgtcgcatccagcgcttctatcgggcgatggatccgctcggtgaggcacgtgcggactgggtctggctctgcgacctcgccaaccgcctgggcgccgggtggagctacgaccatccaggggccgtgatggccgaggctgccgcaggggctgcgatcttcgctggcgtcgactacgaacgactcgaggggtatgcgtccctccagtggccggtggcggccgacggaaccgattcgcccctgctctataccgagcgcttcgcgttcccatcggggcgcgctcgcctcgttcccgtgccctgggtcgagcccaccgagcaggtcgacgatgacttcgatctccatctgaacaatggccgcttgctcgagcacttccacgagggcaacatgacctatcgcaccgccgggatcgccgaggtgacgccggggcccttcgtcgaggtgtccgaagagctggccgccgaacgacacatccgcgacggagcgctcgtgcgcttggtgtcgcgccgaggtgccgtccgggttcgtgccctcgtgacggaccgtgtgcgaggacacgagctgtacttgccgatgaacgggcgtgccaacgaggaggcggtcaacgtcttgacgagctcgtcgaccgaccgggcgacccacacgcccgccttcaaggagctcgcggtgcgcctcgaggtgctcgacgaccccgtcgccgtcgcgctcccgaggcggaactggcgctacggccagcggacgccgcaacgaggcgtggacatcgccgctcgccgtgcccgacccgactacgtcgatcccacactgatccaaggaggtcgtcgccgtggctgaaccgctgacacgtgtgcccgcccgcgcggtggcgagctcgctggagcgcgagcgagccgacctcgcgcgtctcgtcgagacgatgggcgccccagcacgcgacgccgtcgcagcactcgctgcacggctcgacacgcccgcaggacgtcggggtgtcgagacgttgtcgtggctcgtacggctggtggtgacgctgccaccggagatggtcgctggacttgcgcgaggcctcgcagcggcgaatggcgccctctcggactcgtcgccgccgacggtcgccgagctcattcggctggcgagaagccccggggttcgtcggggcgtcaaggcgatcctgagcatcgtccacgagctcggcaccgccgaagcggcgcgtcggctgtaaccgcggacgcgtttcgaacgtcggacaagaggtgctgtgtcgaccgatgtcgtcgaggtgacatcgagcggcaacagggcgccttgcccgagcggcgttctctggttaccatgaggacgtggctcgggcggtggtgatcccacgcccgcggcccaccagcgcgggcggctccgcacagagcgtccggtggcagagcccagaaagggggtcggagccgatggaggctggcacgatcgaggagcagttcccgctcctccagcgcctgaacgaggatggtgaactcgtcggcgatctcggtgtggtcgacctcgaccgtctcgccgaggtctatcgccacatggtgatgttgcggcgcttcgacgagcgcgcgtggaacctccagcgtcaaggcgtcatcgggacctacgcgccctacaaggggcaagaggcggcgcagctcggtgcggcccacggcctcgcggagcaggactggttggtgccgacctatcgcgactgggccgcctcctgggcacgaggggtcccactcgagcacggcctcttcttcgcaaagggccatccccgtatgggcctggtgccagaggaggcgaccgtgctcccggcccaggtggtcatcgctgcccagacactccacggcgtcggtgtggcctggtcgctgaagctccgccacgagccgaaggttgcactcgtgacgttcggcgacggggccgccagccagggcgacacgcacgaggccatgaactttgcatcggtgtttcgagtcccgctcgtgttcttctgtgagaacaaccactgggcgatctcggtgccgctcgagcggcagatgcattctgagaccatcgcccagcgagccgtcgcctacggcatggagggcttccgtgtcgacggcaacgactacgtcgcggtcgtcaacctcgttcacgatctcgccgaacgcgcgcgccagggcgagggcccgttcctcgtcgaggcggtgacctatcggctcggggcgcacaccaccgccgacgatccctcgaagtatcgagagagcgcggaggaagagcgctgggaggcgaaggatccgatccggcgcatcgagcggctgctccagcgagagggtcgcctcgacgatgacgccatcgccgctgcggaggcgagcgctgccgaggcggtcgaaggcgtgctggagcggttccacagcgcgctcgacgacgagccggccacgctgttcgaccatgtctatgccgagctgaccccgcagctcgcggcccagcgcgatcggttcgtcgcgcgggtcaaggaggtcgagcgctgatggcgaagctcaccatggcccaggccctgaatcaagcgctcgcccaggcgctcgagggtgacgagcgcgtgctgatcctcggcgaggacgtcggacgcgacggcggtgtctttcgcattacggacggcctgatcgaccgattcggtcccgagcgggtcgtcgacacgccgctcgcggagtccgggatcgtgggaacgtccgtcggcctggcgatgggcggcatgcgacccatcgccgagatccagttcttcgggttcatctacgagaccatggaccagatcgcctcgcaggcggcccgcgtgcggtttcggtcgatggggcgcttcagcgcgccgctcgtgatccggaccccctacggcggtggtgtcaaggccccggagattcactccgattcactcgaggccttgttcgtacacacgccgggtatcaaggtcgtcacgccgtcgaacccctacgacgcgaagggtctcctgctcgccgccgtcgacgatcccgacccggtgctgttcctcgagccgatgcggttgtaccgtgcgttccgcgacgaggtgcccgaggaaccctatcgggtgcccctcggcgtcgcgaatgtcgttcgcgaggggcgcgacgtcaccttgatcggatggggcgcctcgatgcccgtggtgctccaggccgccgacgagctgatcgcacgccacgacgtcatgcccgaggtgatcgaccttcggacgctctctccgctcgacgaggcgacgatcgtccagagcgtgcagcacacccagcgagccgtggtcgtgcacgaggcggtgcgcaccgggggactcggcgcggaggtcgctgcgctcgtccaagagcgcgcgttcttgtatctcgaggcgccggtcggcagggtctcgggctacgacacgccctaccccatgaccatgttcgaggacctgtggctccctgacgcgacccaggtggtgagcgccgcgctggcagcggttcgctactagcccacgggcgctgggactcgtcgtcgggatcgttgcggccgtggcgccgcgtgagaggagcgcgcatggagtggaagtttccggacgttggcgagggcctgcacgaagcacaggtcgtcgcctggcacgtccacgagggcgacgcgatcgaacgggatgccccgctggtcgacgtcgagactgacaagtcggtggtgaccattccggcgccggtggccgggacggtcgagaagatcctcttccacgagggcgacaccgttcacgttggtgaggtcgtcgtggtgttcggcgacggcagcgcgccggcgccatcgccgctccagccgacggcgtccccggctcatgtcccggcaccgccggttgctccggcgccgacgcccgcgagtgagccgctagcgcgtggggtcgatcgaggcatcgtgctcgcgacgcctgccgtgcggcgcctcgcgcgagagctcggtgtcgaccttgcgagcgtcgtcgggagcggagaacgcggccgagtcctcgccgacgacgttcggcgcttcgcggcgtcgcccgagagcaccgagtcggccgtggccgcggtgtcgacgctgtcgaccggggcgcctcgcgccgatcgaggcgccggcgacgacggtgtcgcgccgctggccgtcgaggccgacgagcgtcggccgctggtcgggatccgcaagcgtatcgcggagaacatggcgcgttcgtggtcgcacgctgtgcaggtcacggtcgtcgaggaggtcgtcgtcgacgagctcgtggcgctccgtgagcgcatcaacgcccacctcggcgagcaacgcatcagctacctgccgattttcgtgaaggccgccgcgagcctgctggcgcgcttcccagagctcaacgcatcgctcgacgaggaggcatccgagctcgtctaccacgcccatcgcaacatcgggatcgccgtcgacgatccccaaggtctcatggtgcccgtggtgcgcgatgccgatcgccgctcgatcagggagctcggcctcgagctcgagcgcctcatccaaggtgcccgggcgcacaccttggggccgcgggacctgaccggctcgaccttcacgatcacgaacttcggttcgatcggcggcatcgtggcgacgccgatcatcaactatcccgacgtcgcgattctgggcgtcgggccgattcgccgccgtgctgtcgtgggcccggacgacgtcatcgtgccggcgtcggtgctgttcgtctcgttgaccttcgaccatcgcgtggtcgacggcgggacggcctcgcgctttctcgtcgcgctctcggagctgctccgagacccggctgccctcgtcgcggagctcgtgtgatggtggtcggggagctgatcgagacggtcgatctcctcgtcgtcggcgggggtccgggtggctacaccgccgcactccgagccgcacagctcggtcgggacgtggtcctcgtcgaggagggcgccatcggtggcgtctgcttgaacgtcgggtgcattccgtcaaaggcgctcatcgagacctcacgcgcctggcacggcctcggtgagctcgccgagcggggcgtgatggtcgcagacgcgtcgctcgatcgtgcgcgcgtccgccagagcgtcgaggcggcgcgcgatcgcctgacgggcggggtcgcgcagctgctcaaggcggcgggcgtcgaggtcgtcgagggccgagcggccttcgtcggcgcgaaccacgcgcgcgtccagagcgcgcacgaggcgacccaggtccagttccgtcaggcggtcgtggcgacggggtctgcggctcggcgtgtgccggggctcgaggtcgaccacgagcacatcctcgactcgacggatctgctgttccgggacgcaccgatcgagcggctcatcgtggtgggcggcggctacatcgggctcgaactcggcgcggcgtgggctcgtctcggtgcgaaggtcaccatcgtcgaggcgatggacgatgtgctcatgggggccgagccggaggtgcgtcgcgcgctgcgcgacgggctgggtcggctcggggtcgaggtgcggacccgcgcggtggtgtcgtcggtcgaggcggtcgccgacggggtcgtcgtcgggatcgagcagggcgcgggcgtcgacaagctcgcagccgacgtcgtcgcggtggtcgtgggtcgagagcctcgcctcgagccagagctcggcctcgaggctgcgggcgtcgcggtcgccgacggcagggtcgtggtcgatgtggcgcgccgcaccacgaaccccgcgatcttcgccatcggcgacattacgcccggtccgatgcttgctcacaaggcctacctcgaagccaaggttgcggccgaggcggcgagtggccacccgagcggcttcgatgctcgcgtcatcccggccgtcgtgttcgccgaacccgaggcggcctgggccggactcggagaggccgaggcacgggctcgctacggatcgatcgtcgtcggtcgcttcccgtatcgggccaacggccgggcggttgcggtgggctcgacctggggcgaggtcaaggtgatcgcacgcgccgatggcgaggtggtcggggtctggatcgtgggtgcggacgcctccaatctcatcagtgaggcagccctcgccatcgagatgggcgccacactcgacgacatcgcgctcaccatccacccgcatccgacgctgagcgagatgctgcccgaagccgcagaggtgggtctcggccggccgacgcacatcatcgtccgtacgcagtcgggcggtcgttagggggttcccggcgcatagctccgggggcggctatgcgcgcccgtggtcggcgcgagcgtcggctgcgagttcgtcgcgagctcgcggatcggcgaccatggtgatgatgcgttgcgcttgttcagtcgcgctcgcgccgaagaggtgggcgacaccgtgctccgaaacgatcgcggagtgctggaacgacgtcaccggcgtgtcgaggcaggcgcgcacgttcgaggcgtcggttggggagtgccaggagcgcagtgcgatgatggactggccctcgcgcgcatggagcgcaccgacggtgaagtcgggttgtccgccaaagccggagatgacgcgagggccgaggtggcacgcgttcgcctgcgcgaacagatccacctggagggcggcgttgatcgcggtcatgcgtggctggcgcatgatcatggcagggtcgttgatcgtctcggtccgaaggagacggagcctcgggttgcggtcggcccacgcatagagttcagccgagccaaagaggaacgacgcggtgatgggctcgctccgatcgagggcggctcgccgctccagggcgaggacgccgtcgctgatcatctcgctccagatcctcaagccacgtcgatcctccaagcgcgccaggacgcgatcggggatggcgccgataccgagctggagcgtggcgccgctcgggacaagacgtgcgacgtgctcggcgatggctgctgcctggggatcgtcggcgttgcgcgcgtccggcgaggacagcggcgcctctgcctcgatggcccagtcgatggcgtcggtctcgatctctccgtcgccgaagacgtagggcacatgagggttgagctgggcgatgacgaggccaccgtgcgagcgaacggcctcgatcgccgcaggcaagatgttgacctccgttccgagtgagacccgacccgcgatcggaagggacgtctggaccatcacgacgtcgggtacgagcgtggtggcgaggagggtcggcaccagcgacaggcgcatgggcagatagcgcagggcgtcgccttggtcgcggatggctgggccgaggaagggcgactcgtaggtgatgcccgggcgagccgggatcgggtgctgggcgttcaggatgaacaggcgccagcgttcgagttcggcctcggcggcgccgaggagggccgttggggtgaggaagttcccgcctgccacgatgcgcggctcacgacggccgatggcggcgagccgcttgcgtaacgtgtcgtctccgatgatctccatggcgggtgctcctacgggattggtcaatggttgggatcgtggtcggacacgtcggggtcgggtcggccgaggttcgggtcgatccgatcgagctcgagcgtcacgtcctcgccgcgctggacgcgcagtgagacgtaggcggcgacgccgacggggatcgggagccagaagttgaagatccgccacgtgaggacgccgaggatcgcgacacctcggggcgcaccgaatccggtcaggagggtgatcgcgagggtctcgacgaccccgagtccgctcggcgtgagcggcagcaccgcagcgacgttggcgatgccgtaggcgacgatgagcgcgaccgggttcatgagctggccgaacgccgccagcatgatccacagggtcgttgcatcgaagagccagttggcgagcgcccacgctgacgcgcgccggaggagctgcgggtcgcgcccgagtgcgcggagtcgctcggccgtttgagcgatggcgtgttcgatggagcgacgacgatgggcgagcggagggacgtggtcgatcaccgtaccgaccgcgtgctgggtgcgacggttgccacgggtgagcaggatcacgaccgcaatggagatcgccatcagcgcgacgccgaggacggcgacgacgaggtagacctcgttgaagccgtagaacgggagcgacacgagcagggcgagccacagcagtgcgttcaagatgagggcagatccgacgctctgggtcgcgagcgcgacaccggtgtcggccccgcgaacccccaggttcgacagcagccgcgcggtgagcccgacgccgctcgcggagccaccagggaggacgtgcgagaccgcaaggcccgcgaggtcgaccttggcgagctgcccgatgctcggcgtggggcgcgggagtaccgtctcggtgagcttcgcatacgcgaacagcgacagagcctcggccaaggcggcgagcggtaccagccaatagttggcgcggtcgaggagcgacagcgtcttgcgaaagcccgcgaattcgggaacgacgaggtactcgatcacgagcaggatgacgaaccctgcgagccctcgaatcgcgaagtgtcgtatgagcttgccgaggctcctacgggttccgcgcaggaccggtcgcggtgatgctgagtgtgatgccgcacgcgacgacgcagatgacgacccagaacgtgatgacgcagcgcgcccgagcgcgggaagcgtcagaccgagccacgaggggccgagtcgagcacgcggcgatgccccccgtccttcggtgctcacaacctcgtcagtctaacctgtcgagaggcgtcttggggcaatcggcgaggaggactcgatggtcgagcgacggagcctctcgctccgtgacctcctcatcgccgaggccgtggccgccgggctcggcgtcgcggtgtgggcgttcgccgtgcttcgtcacctcgagctcgagatcgtcgtggcgggtgttctcgcgctcgtcatcgaaccgatcgtctcgaggctcgtgcgtctcggactgccccgtgtcgtcgcggtgctcgtcaccgcggtgttggtgctcgccgcgctcgtcggcctcgcggccgcgttcgtcgttccgctcgtgaacgccggtcagcggctgctcggagatctcccgggcctgctcagccgcttgcgtgcccatcgagccgcgatcgaggcgctgctcgtgcgccttcacctccagcacgcgctcgacgtgggtgcgcagtcgatcgcccacgcggcgcagttggcggtgaccccggcgctgtccgtggcgagcggtgcggtcggttcgctcgccacgctcgcggtgatcggcacgctcgccgtgttcctctcgctcgaggcgccgaaagcgatcgcctggctggtggcgcagctcgatgcgtcgcggcgtcctcgtgtcgagggcgtcctgcacgacgtcgcgatcgcggtggcgggctacgtgctcggcaacctcgcgacttcggtggttgccggtctggtgatcggggtgacctatgcgatcctcggtctcccggacccagcactcatcggactgtgggtcgggctcgtcgatctcctgccgttggtcggtgggctcgcaggcggagtaccggcggtcgcgctcgcgctcgtcggcggacccgaggacgtcgtcatcgtgctgatcgtggtcctggcctaccagcagatcgaaaatcacgtgctcaatccggtcgtctatgcgaagacggtccggttgagtcccctctgggtcctcgtggccatcttggtcggcgcacaggctgcgtcgctgccgggagcgctcatcgccataccgatcgcgagtgcgatccaggtgatcgcgcgtgagacgctgcgcgatccgttgcggcgttggcttgggcgtggctcaggcgccgtggtcgcgcaggggaccgatctgccaaccccgagcacggacacgggcgacgagctcgtccaggctggcgagggtggcaaggggagccccgggggcgctggtgacgtcggagtcgtgcagcagcagcgtggcaccggggccgagccggtgcgtgaggtcggcgaggatcgaggtgctggacgcggcaaaccgccagtcgcgcccccagcttgaccaggtgacgaggcgaacgccttgctcgtgtgctgccagtcgcgttcctcgactcacgaccccgtaggggggtcggaaccacgtcggacgctggccgaccacctcttcgatcgcaccgacggcgcgggcgaggtcataacgcaccgagcgcgcggaacgcccgagatggttgcggtgccagtggccgtgcacggcgatctcgtgtccgcgctcggccaccaggcgcgcgacccatgggtagcgctcgacctcagagccgagcaggaagaaggtcgcgtggacgtcgagccgctcgagcgcgtcgaggatccgaggcgtggtcaccggactcggtccgtcgtcgaaggtcaaggcgacgtggtcgtcgaggccgatgccagcgacggctgggttgagccgccgtgcgatccaccagtggtgggtgagcgccgggccagcgtggttgacgagcgctgccgtacccacgacggcggcggcatggccccacttcatgggtgcgacctcacgcgctcagctccggggcgcgcgcgagctcgctcaccggagcgccgacgaggtggcgtgctgccagcgcctggcgggtggacgccgcgagcgccagtgcactcgcgacggaggcggtgggatcagcgacttcgacgatggaaccgggcgcgatcgtgcttgcgagcgctcgtggcgggatgatgcgggcggggatcacgctctggtggtgcagcgccgcccaggcgagatcgaccgcgttgatggtgttctgcggcacgtacacgttgacggggctgccaaggacggcgctgagcgccgcgcgtccgagctgaagatcattgacggggacgatgaggctgaggtcgccgatacgcgaacccgcgcccccgttgacgagcgcgacgcccgctgctccggccatcgccacggcggctgggtcacgacgaaccccgcgttcggtcacgacgacggcgatgtggtcgttgtgcagggcggcgtcgagtgccggcgacgcgaggtccggtgtcggcaggagcgccgcgagataggcaacgtgggtcggccgtgcggctgcggacaggttgaggccctcgtagccgatgaggcccgatgcgacgttgaccgcgacgaagacggacgcggcgctcgcgaccccgacgagtcctcgacggagcacaacgcgctggggggagagtgctggtcgcggcggagcctctgtcagcaggtcgaggatgggtgcttcgggggttgcctggaactgtgcgagcgccgggagcgtgagctcttcgggcgcggaggcgtagtggacgaccgcgtcgcggagttcgcgtacgttgcgtgcccagaacgtcacgccgctctcggccatcgcggcgacgttctcggcaccgtggccgacgatcggttcgtaggagatcaccggacggcgtgcggccatcgcctcgagcgatgacagtcctcccgcgttctggacgaccacgtccgaggcggcgagccagaggtcgacctcgttcgtccaaccgacggcgacgatcccgtcggccgcggctgcgcgcgctcggagctcctcgttgtgaccggcgagcacgacgggcaggacgtcgcccgtgctggccaacgctgcggcggtctcgacgagtttgcccaccccccacgaaccgccgacgatgagggcgatgcgcgcgtcaggcggcaagccgaggtggcgacgcgcgctggctcgctccggcagcatccggaagcgctcgtcgacgaagggcccgacgcgcacgacgggtccacgcaggtggccgcggcgcttggcctggacagcggcggtctcggcgaccgcgaggtggacgtcgatgtcggggtggatccacatcggatggacggagaagtcggtgaggaaggtgacgaggtggcggtccgcgacgcacgggtcacgccgcctgcggaactcgccgagcagctgcgcggggaagggatgggtcgcgatgacgatgtccgggtcgatcgtctggagccattcgcgaaccttcgcgccgaaggctcgtcggaacactgcgcgcgcgaccttggtcagtgcagggatgtgtgaccagagctcgaattcgagccgatacgcccagggcgcacgctcgacctcgacgcggaagacggtctcgagcatcgtgccgagacgtggggctgcgtcgaggaagtcgacgatgctgacgtcggcgccgtgacggccaagatgatcggcgatggcccttgccgccccgtcgtggccgccgccaaggcgcgcggacacgatcaggacgcgtggttgggacatcggggccagtgtatcgcatcgccgtacactgggcgaacagtggctctcttgctcgctctcggcgcggcgctcgcgtttgcgggggcgaccgtgctgcagttcgaggcgagccaggctgcgccgcgatcggcgtcgttgcggatcggactcgttcgccatctggtcggcgatcgtcgcttcaatctcggagcattgctcgacgtcgccgggggtgtggcacagttcttcgcgctcaaggtggggtcggtggaggtggtgatgccggtggtggcgagcggtctcgtgatcgcgatcgtggcgcaccacgtccaacgtcggctcgcgatcgtcccccgcgacgccgtggcgttggcggggtcggtcctcgcgctcgtcgtcgtgttggtcgtggcgccccagggaggctcgcgcctgggatcggtcgcggcccagctcgccgtcgccgcggcgggactcggtggcggcgccgtcgcgttgacggtcgggcgtcgggtgctgctgcgtcggggttggtacctcgccgcggccggcgggctcctgctcggggtggtgagtgtcgtggaacgctcggtcgggctcgtgtggagccaacggggaacgctcggcgtcctcgagagctggcagctgtggacactgctcgcagtgggtgcgctcgcgctcctcgtcgtccagagcgcgttcggcgctgcacggctgctcaccgtggcgccgatcgtcgcggtggcagagccgatcgtcgggagtgcgctcgccgtgtgggtcgagggggctggtccaggctttggccctggcaggctcgcgatcgtgttcggagcgatcgtgctcgaggcggtgtcgatcatcgcgttggcgcgaggagcccgcgacgagggaggggtccggtgagcggagtgcgcaaggtgctcgcgctgcacggtcagccgggttcgggtcggagtttcgatcctgtggccaggtggctcgggcgtctcgaattcgacgctcccgaccgaccgggatggggatccaatccattggcgcctcgggagctcgtcgcgcaggcatcgtgggccaaggagcggatcgacggcccgacggtgctcgtgggctactcgttcggtgcggcgatcgcggcgctcgtggcgccgacgtgcccggcggtggccggtgtcgtgctggtggctcctgccgtgacccgcgccgcgttggtctggagcgatcgcctcctcgccagggccggcgtcggacacgtcgcgggatcgttgatcgccgcagtggcggagcggtccgtgccggcggcgctgagtgcgcgggctcgccaggcgttcctggtcgagcagcgatcgctgctcgacaccatcgaccaggtggagacgtcgcttcggcggctcgacgtcccggtcatcgtcgtcgcgggtgctcgcgaccgcgtggtgcctccgcgcggcgccctacggctcctcgagtgcgtgccacaggctcggctcgtcgtctcccgcggtggtcacgatcagcttgcggacgaggcggccgtcgtcgccgatgccgttcgatccctggcctccgaacggagtgcgtgaccggggtgggaggtcttctgtatacgaatgggatccgccggctcgggcgatcggataacattggtacggacgaccggagcagtgggggcgtgctgcggacgtcgtggtgcggggggcacctggagcggcgaaggagccgggtgtcgtggagtcgatgaagctggcgacgtgggactgcgaagattggcgggtgcgtgcgcactgtcgcgacgttgatccgggtttgttctttcccgtgggcgtgacgggtgaggcagaggtccagatccgccgggccaagcgcgtctgtgcggactgtgacgtgcggctcgaatgcctcgagttcgcgttgcgcaccaaccaggagttcggtatctggggtggcaaagacgaggaggagcgtcgcgtgatacggcgtatccgtcgtttgcagcggcgagccgtgtcgcgagcgatctagccggcggcccggtttcgcctcgggcacgcggcggagccgtcgcgggtcctcgggccctggcgcactgtgatgggagcgcgggcgagtccgtcgaccgatctggacagcgctgtgtgcgtccgctgcgatgcgtgcggttgcgcggagacgacggcaaccgctgacgtcgggacgtcgccccgcgagtgtcaaggaggtgagcgccgcacggtaggacgtcgcgctggcgagccccaggtgtcgacctcacaacgtcggaaccggtgctccgtgcagtcggacacggtcggcgtgcgcgtagagacgaaatccctcggcacggagtccgccgacgaggacgatcccggcgtcctcggctgtggtgatcgcgcggtggctgggcgagccgagggcgatcaccgatcgggccccgatcgccgcggccttcaagacgagatcggtgccgatgcgacccgagaggatcacgtccgaaccggtcgcaagcgtgccggccagtgcagcgtgaccgatcgccttgtcgagggcgttgtggcggccgacatcttcgcctacagcgaccggcgacccctgtcgtgcaagaatcgccgagtgcgcggcacgtgtcaaggcaaacaagccgtctgcctcgctcacgagctcgtggagcgcgagaaggtcgtcgacgtcgatcggttccccgtgcggcgacgcggagacctggtgcaggcgccgttccagatcgtcggtaccgcaccagccgcacgagctcgtccgtacgctcggctgaggtgggacggcaaccgggtggcggaggacgaccgtcgcctgacggtaggcgggttcgcccgcactcggtggcggacagagcgacactccgacgacgtcgcgtggcgagatggcgagttcggtcacgacgagacccacggcgagcgcggtgtcctcacctggcgttcgcagtgtcgtggtcacaagctcgggcgctgcgtcagggcctttgacgaggatcgcaagtggctcctccgcgatcacccgctcggcgcggagccgaacgccacctgtccgatcgacaagtgtcacgcgtcttcgtggcgacgcgctctcgactgaccggttgcgctccaccgcaccatgctagctcaccggctcgatagcctgatgaccatggatcagctcgagctcttcgtcgacccggtctgtccgtggacgtggctgacctcgaggtggctcgagtccgtggaggccgagctcggcctcacagtgcgctactcggtggtctcgctcctcgagctcaacggcgacgatccgtcgaatccgtggatcgaggcgatgcgccagggtcgacgcctccaacgagtcatggtgcggctgctggcggccggtgatgacgctcgcgtgagcgcgctctaccgtgccgcaggtcgcgcgacgttcgagggtggtcgtacgctcgacgccgagctcgtccgcgagctcggggagggcctggggctgagcgatgaggacatcgcggccgcagacgatggtcggctcgacgccgccgtggtcacagagcaccagcgcgcgatgcgactcgcaggtccggacgtcggctccccgatcctggctcgtcgcggcggcgagaggggcttctacgggccgatcgtcgaccgccccctggcgccggacgaggcggttcgactctggcacatcgtcgaaggagtgctggataccccggcgttgttcgagatcaagcgcggacgggccgtcgagccccgattcgcctgaacgagcctcctcaggtaactgtggccccgaccaggtgaccaatcccaaaggtgacggcggcggccaacgcggcgagggcaagctgtcgaagggcactcgagacgaccggccgagccgacaacgctccgagcgcgcccccgaggccgagagccgcgagaccggcgagcccgatcgagagtcccgtcgcgagggtgccctgcgtgaagatccagggaacgagcggtacggctgcaccgagggagaacagcgcgaacgatgcgagcgccgcctggacgggagatccggtggcttcgggagcgacgccgagctcctcttgggcgtgaatgcgcagggctacgtcgggatcgcgcatgagatagcccgcgacggcggcggcgagatcgctcgggacgccacgctgctcgtagagctgctggagctcgagtgtctcggcttcgggtcgatgacggatctcggtgcgttccacgtcgagttcgcgctcgaggagttcacgctgcgcacgcatcgacacgtattcaccaatgcccatggagaacgccccggccacgaggccggcgataccggtgaggagcaccgtgtgccctgcgtgggaagccccgaggacgcccaggatcaacgcaacgttggtcaagagaccgtcggaagctccgaacaccgcagctctcgcgccgccaccggtgacgtcgcggtgctcgacgtggtgtgcctccatagctcctgaggctagccgcggaggccgagttcgccgagcgattcgtgccgcggtaggctgggcgtatgcgtgaactgaagctgatcgatcggtcgcaacctcagacgctggtgatcgcgtcgatcttgctgtatctgaacgccttgttcacgctgttcgagatgctgttcgtggggctctcgccgctcgagctgttgaccatggtggtgctcccgatcgtgggcgcgtacggaatcgcgaactctcggcgcatcggctactacctcgcgatcgcggctgccgcgatcccgttgctgacctacctctacttcggcatcctcggcgggatcggaaccatcctgtcctccggcgtgatcatcatcatctttgcgatcgtcccgttcgctctgttgctgcacccgatgtcgcgtgagtatcagcgcgtctggttccactagtcctcttcggcgcccctcgctggcgccatgtgaggccgacgaggcgtccgtagcctctgtctgcgtaccgacgggtgggggcgccggctcgtggtgcattcgacggtgtctcttcacaggccgctggtcacgggcagccgtgcagccccgcgcgcatgcttggcgtgccttcccacctgacgcgagcgtggcggtagcgcgatgagccccgacggacggcttcgccgagctcggctggtggcctcgagggcgttggatggccgcggtctacggcgccgcggagcgatcgacgggcggtgggagggcggcctgggtggcgccgcgtggcgtccgctcgccgtcggcgctctcggcaccctcgacgatctcggcgcgcaggcgtggcaggcaccacggataggtgcgctgcaggtaggcgatcagccgctcacgaacttcgcactggagattccacgacgccgtggagtcccgggcgctcatgaggaggcgcagctgcatcgtggacgtcccgaggctcgtgacctggaggcgtgcggtcttgccgtcccagtcgggagagtcagccacgatgtggaggaacgcctcgcgaatggcgtcgacgggagcggtgtagtcgacctcgacgtgcacccatccgaggatgtcggcggtggtcttcgtccagttctcgaaggcgttggaggtgaagtacgagatcgggagcacgaggcggcgcaggtcccagacccggaccaccacgtaggtcaggttgatctcttcgatccgaccccagtggccgtccacgacgacgacgtcgtcgaggcggatcggctgggcaagcgcaatctggatgcccgcgatgacgttggaggcgatcggtcgcgacgcgacgccggcgacgagggagacgatgccagcgctggcgaggaggccggctccggcgatgcgaacgctcgggaacgagaacagggcaagggccagtgcaacgatgacgatcacgacgaggaggatccggcggaagacgcgcagctgcgtctggaggcggcgggctcgaaggttgtccggaccctcgatgtggtagtggtacaagatggcgtcttcggcggcttcgagcaggcgagcgagggcccaggttccgaccgcatcgagtgcgagttcgatcccgtgggtgaggtcgccgatggtggcaccgggcaagcgcagcgagcgcaccaccatggccatggcgaggagcgggatcccggagcgcaccggtccgatgagtcggcgcagcgcggcggtgcgcacgctgttcgggtgccgacggttgacgacccgggtgatgcgcacgagggcagcagcgatgacgagccccacgacggtggcggcaccgagcgacggtaggatcaccaacagctggtgggcgatgctcacggcctgctcctttggctcgcacctcggcggcatcaggctagcgttggcatcacggctgacgaggcggcttcggagcggcctgctaccatcggctcatggcgtcaacgtctgtcgactcgctcgaagcgctccacgggctcgtcggtacccatctcggctactcggcctggttgacgatcactcaagagcgcatcgatcagtttgccgaggccacaggtgaccaccaatggatccatgtcgacccagtccgagcagcgtcgggaccgtttgggaccacgattgcccatggctacttgacgctgtcgctggtctcggccttgttgccggaggtgctcgacgtacgaggcgtcggtatggtggtcaactacggcgcgaatcgcatccggtttccagcgccggtgccggtcggatcgcgggttcggcttggggcggtgctcgcgagcttgagcgaaattgccggcggtgcgcaatcgcaggtcgacgtcacgatcgaggtcgagggatcgaccaagcctgccttggtcgccgagatcttgtttcgctactaccaggtctgacgggacaccgagccagcagctaggctcgtgtccgtgaagcggcgcgtgctctcagctgctctcgcggatgcgaccctcgtgccgcctcgccagggacgatctgaccgtatcgacggtgtcgatctggatcgcaccgaggccaagcgcctgcgtgcctgggcgacccgtcacatcacggcgcggcaggaggccttgtgggccgaggggcgacgatccctccttgtggtgctccaagggcttgacacggcgggcaaggacggcacgacgcgagcggtgtttcgcggggccgatccacaaggcgtgcgggtcgcctcgttcaaggctccgaccgcactcgagcttcgtcacgatttcctctggcgagtgcacgaggtcgccccagcggccggcgagatcgtcgtcttcaatcggtcgcactacgaagacctcatcgtgccgttggcgaacgggcagctcgacgacgcgggactcgacgagcgtgtggccgcgatcgaggcctttgaacgccatctccttgactcggctacagcgatcgtcaagttcttcttggacgtctcctacgaggtccagggcgagcgactgttggctcggttggagcgcccggagaagcactggaagttctctgagggtgaccttgccacgcgagagcgcttcggtcggtttcgggcggcctacgacaccgtgctggctcggaccagcttcgacttcgcaccgtggcgtcggatcccggctgatcgtcgctggtatcgcaacgcggtcgcggccgccatcgttgcccacgtcctcgaggtgatggatccggcgcctccggccgtggcgatcgagcatctccaccacatcgagcacgtcttgcgttccgaactggcgacgccgggagctgagccgtgatcgggttcgtcgttcgcaactggttccgtgactcgctcgagaccatgttcgtgatcgctatcggtggcatggtgacctcggtcctgcgccaggcccggcgtgggaacctgccgatctatcgctgcgaggcctgtggcggtgtgacgtcgcgtgcgtacgcggtgtgtcgtcactgcggtgcgccggtgcgctcctgaccgttgtggccgatgcgcaggaatgccacgccgggtgcgtaggttggcgggtctgatgagccaactgatcccgcccaagttcgagtcgcccgacgcaaagttgcgcgcggtcggcgcgatgttcgatcgagtcgcacctcgctacgacgcagccaatcgtgcgatgacgctcggactcgatctcaggtggcgtcggcgtctgctgcgtgagctcgccctggcccccggtgcccgcgtcctggatctcgcctgcggtacgggcgatttcttgcgcctgctcgccgaggagggtgccgcgccgatcggcctcgacctctccggtagaatgttgcgtgaagtccctccccacttcgatcgggtccaagccgcgggtgagtcgctcccgtttcgcgatgagagcttcgatgctgtggtgacagggttcgctgttcgaaactttgcgtcgccagaagcggtgttctcggaggtggcacgggtgctacgaccgggtggagcgctcgggatcatcgaggttgccactccacactggaggccggctcgtgccgttcatgcgtggtacttccagcgcgtggcgccgatcatcggctgggttgtcggtcgcgaccgtgaggcgtatcggtatctgcccgcgtcggtggcgttcttgcccgagccgttcgcgttcgctcgcatgctcgtcgaacgggacttcctgccgccgaagcggatgctggtcggcatgggtgcttcccagttgctcgtgacgcacaagaggcacggatgaggcagctcgtcggcctccgcgaggtgcgctcgctgggagggatgcggtccctctacggcatcatccatcgggccgagcagctcggtcggcccttcgaactcgtggaactcgacggtggtatcgtgctcggactcggggagccgagggtggccgagtccggagctccgggtccacggttccatgcgctccggttcggcgagtcgaccctcggccctggtcgctggtatcccgtggtcgtcgcggcggattggtcgcgcatcgccgtggtcggctacgaggccgaggacggcgcgttctcgagcgagcctgcggtctgggacatcgaggagcttgcctacgaccgagcgccgctcgtcggagcgttgatcgaccacgacctcgcgggtgcgcgagcgcgcatcgaggcggccatcgaaatggtgcgccagggcgcgctgcgcaagatcgtggttgcgagttgggcgtgctggcaaccctcggagcgtttctcgatcgctgcggcggcatcacgcctgaagcgtgagcacccgcacgcgcacctctatgcgagcccccactgggtcggtgcgaccccggagctgctcgcgaagacgtcggggtcgtgggcgcgtctcgagccactcgcggggacggcgcgtcggggggcgcaggcacgcctgctcgcgtcccgcaaggaccggctcgagcacgagctgatggtccagcagctcatcgaggatctcgctcaggtggccaaggagctgaagcgccccagcgcgccgttgctcttcgatgccggcccgtttgtgcatctcgcgacacccatcgcggccacgctcctgccaggtctcggttacgccgacctgctcgcggcgatcgtcccgaccgcagcggtcggtggtgtcccgcgtccggtcgctgctgacctcctcgccacgtgggagccgtggcgagggcagtacggaggcgccgtcggcgtgagcgatccgtctggtgacggcgagttctacctctcgatccgaggtgcgacgatcgacgacggcgggtgcgtccgcgtcgcagccggcggaggagtcgtcgagagctcctcggtcgatggcgaactcgccgagaccgtcgcgaaaatcaatgccgtcgctggcgtgttgggcgccgccaccttgtatgcctgagtggatccgcgttcgcggcgcgcgagagcacaacctccagaacgtctcggtggacgtgccacgcgatcgtctcgtggtcatcacgggtctgtcgggctcgggcaagagttcgctcgcgttcgacacgatcttcgccgagggacagcgtcgctacgtcgagtcgctgtcgtcgtatgcccggcagttcctcggtctcatggagaagcccgacgtcgatgtcatcgatgggctctcacctgccatcgcgatcgaccagaagtcggcttcgcacaatccccgctcgaccgtcgcgaccgtcacggagatctacgactacctgcgtttgctctacgcgcgcgtcggtcatccccactgcccatcgtgcggacgtgaggtgagccggcagacgccccaggacatcgtggactgggtcctcgcacgttatgagaacaggcgtttgctggtcgtggcgccgctcgttcgcggccgcaagggaacctacgacgagctgctcgaccgactggcgcgcgagggatggtcgcgcgtgctcgtggacggggtgctgtggtcgctcgacgaccgaggctccatcaacctggcgcgctacgaggcgcacaccatcgcggtggtcgtcgaccggatcgtgcccaagtccgccgaccgccagcgtctgaccgagtcggtggagacggcgctcaaggccgctggcggcgtcgtcgaggtcgtgccggtcggcgacgacggcgagctcggagcgggcgagcgcttctccgagacgctcgcctgtgccgtctgcggcatctcgctgggcgagctcgaacctcggagcttctcgttcaacagccccttcggtgcctgtccggcttgtggggggctcggggtccgcttcgtcgtcgacgaggatctcgtcatgcccgacccgaatcgctcggtcctccagggcggcgtcgtcgcgctcgggacgctgcgggccgatctcgttcgtcggcagatggagcgcgccctgcgcgccgcgggtttctcgctctcgactccggtcggcaagcttcccgaggcggcccgacgcctcatcctcgagggcgcttccgagccgatcgaggagcgctgggtcgatcgtgccggtcgtgagcgcagggcccaggtgacgttccagggcgtcgccgccttcctcgagcgacggcggagcgaggccgagtcggaggtggctcgtcagctcgccgagagcttcatgcgtgaggtgccgtgcgatgcctgcggcggcacccggttgcggccagaggcccggagcgtgaccgtcgatggggtgagcctcgacacgctcgtcaacgcctcgatccgccgtgcggtcgaggtggtggatgcgatgcgcttcggggagcgcgaggcgaccatcgccacccctgtgctgcgcgagattcgcgcacggctgcagttcctctgcgacgtggggctcgactacctgacgctcggtcgggcggcgagaacgctgtcgggcggggaggcccagcgcatccggcttgcctcgcagatcggctcgggcctcgccggggtgctctacgtgctcgacgagccgtcgatcgggctccaccagcgggacaatcgacgcttgatcgacacgctggtgcacctacgggatctcggcaacacggtgatcgtcgtcgagcacgacgaggagacgattcgcgccgcggactgggtggtcgatgtcggaccgggcgcgggcgagcacggcggcacgatcgtgcacgccggcacggtcgccgaactcgagacggtcgagtcctccctcaccggtgcctacctctcggggcgccgtgcgatcgacgtgccggtggctcggcgcatgcccgagcggggatggttgcgggtgctgggcgctcgcgagcacaacctggccgacatcgacgctgcgttcccgatcggccttttgacctgtgtgaccggggtatcggggtcgggcaagtcgacgttggtgaacgagatcttgttccgggcactcagggcgcagctgcaccgctcgcacgacgtccccggtcgccacaaggccatcgagggcatcgaactcgtcgacaaggtgatcgacatcgatcaggcaccgatcggccgcaccccgcgctcgaatcctgcgacctacaccggtctgttcgaccacgttcgccgtctcttcgccgagacacccgaagcgcgggctcgtggctatcgaccaggtcgcttctcgttcaacgtcaagggggggcgctgcgaggcgtgccaaggcgagggaacggttcgcatcgagatgaacttcctcgccgacgtgtacgtgacctgcgatgtctgtggcggctcgcgctacaaccgtgacaccctggagatccgctaccgtgggctcaccatcgccgacgtgctcgcgctctcggtcgaggaggcgttggcgttcttcgcgaagcagccggcgatcgcgcgccacctcacgacgctggccgaggtgggacttggttacgtccgtctcggtcaggcggccacgaccctttcgggcggcgaggcccagcgcgtcaagctcgcaaccgaactcgcgcggcgagcgaccgggcgaacggtctacatcctcgacgagccgacgacgggactgcacttcgaggacgtgcgcagcttgctcggggtgctgcactcgctggtggatcagggcaacacggtgatcgtgatcgagcacaacctcgacgtgatcaagacggccgactggatcatcgatctcggacccgaaggtggcagtggcggcggcaccgtcgtggcgcagggtacgccggaggacgtggcccaggtgcccagctcgcacacgggggccttcctcgctccgttgcttgggcgatgatggaccgtccggatctcgcagcgattcccgaggcgccaggcagctaccagttccgcgatggcgaggatcgggtcatctacgtcggcaaggcgcgcaacctgcgcgcgcgggtcggaagctacttccaagacccccgtcagctctcgccgaagacgcgggcgatgctcgcggtcgcgagccggctcacctggatcgtggtcccgagcgagcaggacgccctgctcctcgagtactcgctcatcaaggaacaccatccgcgctacaacatccgcctgcgagacgacaagtcctacccgatgatcgccgtgacggtcggggagcgctggccgcgcgcgatgatctatcgaggcaagcgtcgacgtggcgcccgctacttcggaccctacgccgacgccggggccgctcgcgaggtcctcgagctgttgcgtcgggcgttgccgctgcgcacgtgctcgccggccaagcttgcccagcacgaacgggccgggcgtccctgtctctacttcgacatcggacgctgcgtcgggccctgcatcggcgccgtggacgaggcaacgtaccgaggcctggtggacgaggtgacggggtttctcgagggccgagccggctcgctcgtcgacgccctcgagaccgagatgcacgccgccgcctcccgcctggagttcgaagaggccgcgaggctccgcgatcggctctcggcgatcgaagcggtgctcgagcgccagtcggtggcgctcgggcacgagcgagacctcgacgcgatcggggtgcatcgcgacgaactcgatctctacctcgaggtcgtgcgcgtacgccacgggcgcatcgtgggcgtgggtggcgcgcgggccgagcgagactcgggtgcgatgctcttcgacgaactcctcgacctggttcggagctactacgacgaccaggccatcgacgttcccccgaggatcgttgcgcgggtcgaggtcgccgaggcgagggaggcgacggacgccctgacctcgctccttggacgcccggtgcgcgtcgtgacgccgtaccgtcgtgagctcgccgtgctcgtcgagatcgccgagcgcaacgccgccctcgcgcaccagcgtgcccgcagagaacgcgccactgacctcgcgacgcgttcgaggggcttgaccgagctcggcgagctggcgggccttggggcgcctccggtccgcatcgagtgcttcgacatgagccacctgcaagggcgctcctacgtggggtcgatggtggtgatggaggacggcctcatgcgccacggggcctatcggcacttccgggtcagcgtgccgcacaacgacgacgtcggggccatgcgcgaggtgctctcgcgacgtctcgatcgtctcgatgaccggcgcttcggtgggcgccccgacctcatcgtgctcgatggcggggcaccgcagctcaacggcgtgctgcggctgctcgaggagcgcggcatggccggcacggtgcccgtggtcgcgctcgccaagtcgttcgaagagctctatgtccccgatcggagcgagccggtgcgcgtacctcgcgggacgctcgcgctctacctgctccaacagctccgggacgaggcccatcgcttcgcgatcacctatcaccgccggcgccgccagctcgatgccgagcgctccacgctcgagtccatcccgggactcggaccggcgagacgggcgcgcctgctcgccgagttcggatcgatctacgagatcgccgaggcaagtgaggcggagctcgtccgtgcgggtgtgccggctcgggtggcgagtgctgtccgcgagcgtctcgggccgctctatcgtcgagagcctgagagcgaccccgatgaggaggtcagatgaacctcgaggagttccgggccatgccggacgccgaggcgatggtgcgcgacctgtgggagacgcacgctcgctggtggcacgaccacttcaccgagggcgctgacgtcgagtacgtcgatcaggtgatccccgaggtgctggctcgggtcggtcaccctcgtcgcgtcgccgatatcggtggcggtgaggggcaggtcgcgagggcgatcgcgcgcgcgaccgcggccgaggtcgtggtcgtcgagccaagtggagcccaggcggccgcggcacgttcgcgcggatcgcaggtcgtccgtgggagcgccgaggccgttccgctcgcgtcgtccagcgtggacgtcgtcaccatcgtgctcgtgctcgagcacgtcctcgaccatgcggcggcgatgcgcgaggtcgctcggatactgcgaccgggaggtcggctcgtgttggcgctcaaccatccgatcatccaggtgcccgactctggactcgtcgaggacgtcgacgcgggcgagacctactggcgctttggtcactacctcgcgagcgacgcatcggtcgaggaggttgccgacggggtgtacatcccgttcgtccatcgtcccctcgaggcctacgtgcgggccgcgctcgatgcgggtctcgtgctgcgcgacttccgtgaaccggcgccgccggagcgatggctgcgcggccagagcggcggcggcttgctcgctgcgttgccgcgcctgctcatcaccgtgtgggagcgtgcgtgaacgcggtcgccttcgtcaccggcatgtccggagcgggccgctccacggtggccgaagcgctcgaggatgccggctggtacgtgatcgacaatgtgccgctctcgttggtgtcgaaggtggtggagctcgcgacccagggcggtgaggagcgcctcgcgctcgtcgtcgggcgcccgtacggggccgagttcgtgcggctcacggaactgctcgacgagctgcgcgctgccgacgtcgcggtgcgcgtgctgttcctcgacgccgaggacgacgtcttggtcgctcgcttcgaggcgaccaagcgccctcacccgcttggcggctccggcgggatcgccgccgccgtggagcaggagcggcgcctcctggagcccgctcgcgaactcgccgacaccatcgtcgacacctccgagctctccacgcacgagctgcgggcacgggtgctggccttcttcgagggccccggagagcggccgtcgctgcgggtcctcgtgtcctcgttcggtttcaagtacgggacgccccgtgacctcgacctcctcttcgacgtgcggttcctgcccaatccctactggcgccgcgagctgcgagcgctgagcggacgcgaccaggcggtgagggagttcgtcctcgagagcgccgatacgcgtggtttcctcgagcggctcgatgggctcctcgccttcgtcgtgccgcgctacgtggccgaggggcgggcctacctccacctcgggatcggatgcacaggcggtcgtcatcgctcagtcgtggtcgccgacgaggttgcgaccatgctgagcgctggggggctctcggtcgaggtccgtcatcgtgacatggagcggggctcgtgaacgcggtcgtcatcggcggtggccatggcatcggtgcgaccattcaggccatgcgggcgctcggcgcctcgatgagcgtggtggtcggggtagcggacgacggcggttcgacgggcctgctgcgcgctcgcgaaccggcgctccccgggatcggcgatgcgcgccacgcgctctcgagcttgatcggtccggacgagccgttcgcgcgcctcctggagcaccgtgttcgccacgcgtcgctccagccccatcccatcggcaatgcggccctggttgcgctctgggagcagacgggctcgctcgtggaggcactccgcgtgctcggggacctcgctggcgtgacggagcgactgctgcccgccgcagaggcgccgctcgtgctgcgagcgacgacggccgatggcgggaccatcactggtcagctggccatccaccttgcccggggcgttcgggaggtctcggtggatcccgcggacgcggtgtgtccgctcacggtggatgccatcgtgcgtgccgatgtcgtggtgctcggtccggggtcgctcttcacgtccgtcctcgcggccgcggtgtcgccggggatccgcgaggcgctctcgatcgcccgggcccgcgtcgtgttcgtcgccaatctcgcgcgccaggaggccgagacgatggagctcgatgccgacggtcacctcgagcgggtcctcgcacacggggtgcgcgtggatgccgtggtcgcggaccacggcttcacgccgagggctgcacgccatcgcgacgtgctcgtacgctcgtggcgtcttcgcggccaggagggcgcgcacgaccccacgcggctcgccgaagcgctcggggaagtgctcgacgcgctcggcgtccatcgatcgggggatcgcaaggggtagcgcgctgcgacgccacgtggtgtcaccaccgtgcttgactaaccttggggcggcgagtgggccactcggctgctcgagggaaaggagaggcgcatgcgggtcgcgatcaatggctttggtcgtatcgggcggatgttcctgcgcgcgatcgagcgaaccggttcggatctcgaggtggtggccatcaacgacctgacctcaccggccgtcaacgcgcagctgctgcggcgcgactcgacgcatgggccgttcccggcgcacgtggcgatcgagggcaacgatctcgtcgtcggagagcggcgaattcgtgtgctcgccgagcgtaaccctgctgacctgccgtggaaggagctcgaggtcgacatcgtcgtcgagtcgacgggcatcttcaccgacggcgacaaggctcgggcgcacctcgaggcgggcgctcgctccgtggtgatctcggcgcccgcgacgaacgtggacggtacgttcgtggtcggcgtgaacgacacgctctacgaccccgaacggcaccacatcatctcgaacgcgtcgtgcaccacgaactgtttcgtccccatggtcaaggtcatcaacgacgcgttcggtatcgagcgcggtctcatgacgaccgtgcacgcctacacgaacgaccagaacctgctcgatctgccgcacaaggacctgcggcgcgcacgggcggcggcgatcaacatcgtccccaccagcacgggcgcggctcgcgcgacgtcgctcgtcatccccgagatgcaggggcgtctcgacgggggcgcgatccgtgtgccggtcgtcgatgggtcgatcaccgacgtcaacgtggtggtgcgggccgaggtcggccgcgacgacgtgaacgaggcctttgcccgagcagctgcggcgggaccgctcgtcggcaagctcgtctactcggaggagccgctcgtctcgagcgacatcgtcgggtccccggcctcgtgcaccttcgatgctccgctgaccatgacgatgccgctcggcaacgggacgacgctcgtcaaggcgttcggctggtacgacaacgagaccggctactcgcaccggctcctcgacctcgtcgagatcgtcgccggtgggctcggagcgcgttgatggagctgccccgcatcgaggacctcggtgacctcaggggacgtcgggtcctcgttcgtgctgatctcaacgtcccgctcgccgtggaacgcggtgagtgggtggtggccgacgacttccggatccgcgcggcgttgccgacggtggagttcctgcgcactcgcggggccgacgtcacgctgtgctcgcacctcgggcggccgaagggtatcgatgctcgctactcgatggcgccggtcgccaaggttctcgagcagctcgcgcctggggtcgaggtactcgagaaccttcggttcgacccccgagagaccgcgaacgatccgagctttgcccaggagctcgcccacggccacgatgcgttcgtgctcgatgcctttggctctgcccaccgagcccacgcttcggtggtcggggtcccagcgctgctgccatcggcggcagggctgacgttgctggacgaagtagagcacctcagcgtgctcctcgaggacccgcctcggccctacgtcgcgatcgtcggtggcgcgaaggtctccgacaagctcggactgctcaccgcgcttgccgagcgtgtcgacgcggtgctcgtggggggtgcgatggccttcacgttcctcctcgctctcgggcacgaggtcggggactcgctggtcgaggaggaccatgtggaggcgtgtcgtgccctgatggaccgcgcgaccatccacctgcccgaagacctcgtcgtcctcgagagcaccgagccggtcggggccgaggtccacggccctgccggcagagtggtgggccgtgacgtgccgcgtggcacgcgcggcctcgacgtcggtcctcggacggtcgagcgcttcggcgaggtgatcctcggggcgcgctcgatcctctggaacggcccgatgggcctcttcgaggatccgcgcttcgccgtcggcactacgggtatcgcgcgagcggtcgctggttcgtcggcctacagcgtcgtgggtggcggcgactcggcgcgagcgctgcgcgaggctggcctcgccgaccaggtgagccacttgtccacgggcggtggggcgtcgctcgagttcctcgaacacggtgatctaccgggcctcgccgcactgcggcaagcggcggagcggcgtccatgagtcggcgggctcccgagcccgagccccaggcgggatccggacgggtgcgtctcgtcgtcgccaactggaagctgcaccacacgcacctcgaagccatcgcgttcttggagcggctgtggcacctgttggatgtcgaggactaccggcgcgcggagatcgcgatctgccctgcattcacggcgctgcggtcggcgcagctgacgatcgagaccgatggcatgccctatcggctcggtgcccaagacgtcttctgggaaccctcgggggcctacacgggggaggtgagcgtccccatgctcgccaagctggacgtcaagtacgtgatcgtggggcactctgagcgccggcgcttgttcggcgagaccgacgacgtggtcgccaagaaggcggcggcggtcgcgtccggtgggttggtaccgatcgtgtgcgtgggtgaggtcgccgaagagcgcgctgggggtaccacggaggccgtgctcgagcgccaactcgacacggtgctcacgacgtatccggtcgaggcgctcggagagctcgtgatcgcctacgaacccgtctgggcgatcggttcgggaacgcccgcgacgcccgaagacgccgagcacgtcgctcgcttcctccgggaccgcctcgcgcgccgggcgagcgaggcggtggctgctcgcgtccgcatcctctacggtggctccgtcgacgtgggcaatgcggtcgcgttcctcgcgcaggccgacatcgatggtctcctcgtcgggggtgcctcgctcgatccggagcgtttcgcgcagctgctcggcggccgaccccgcatcgcgtcgacgtcctagactgccattgttcgcagggaggaggactcatgttgaccgtcgtgctcgtcgtcgtgcaggtcgtcagcgcgatcgggatggtggtcttcgtcctgctgcactcgggcaagggtggtggattgtcggacctcatgggcggctcgagcttgagctcggccgcgagttcgtcggtggctgagcgcaatctcgaccacatcaccatcgtgctggcactggcgttcgccctgtcgagcatcgcgctcgggctccgcctgtagcgcgctcgggctccacggcgtgcgctggcgctgtcgtgcggctgtggcgggttctcgggtccctagggttgcgggtactgcggcgtgcgtctgctccggcggccagcgggtgcgggtcgagcagcacgggagcacggcgcgaaggtgtcctctccgccggcgggcatctctggggcgttctcgtccgaggtgcgcggcggggtggtggctctggcgggtgctgtcgcacgggtaccgacgccttcgggcgatgccacggccgaccgtcgtgggtgaggcgagatccgacgtcgcgcatgctcgtggcgaccccggtgagcagggtattgttggtgctttgcgactcaacctttggtgaaagtcgtcgatacgtccactatggaagcgttcgaggcatacctagctcggtgcccacgcgcactggtgctcctcgaggaggggctcgtgcgctgggtgaacgaggccgctgcccgattgcttcttcgtgacgcgtccgcgctgatcggtcagccattggacctggtcggaggggttcgcctcgaagagcttggcgatacgagtgtcgaggttgcgctgtgggcaggcgatggatcgctcctcgactgcatcgccgaggtcaccgtgctgggagaggcggtcatggtcgagctggacctggtcgagctgagtggtgtcgacgatgccggtcgagcactgcgggcgctcgccgatacgttgtcgctcggcgtgttcatctccgatcggggcctgcgactcgggtatgtgaatgcggggctcgcgacactgctcgccacgtcacgtgagcgactgagcggagctggctgggtggacatcttcgcaccggaggatcggcctgtcgttcgggagctggcgctgcgcgcactcggtggtgagcgcgtggaggcgatcatcgacgtgcagctcgagtccggtccacggcgtgcattggaggtcacgatcatgccggttcgtgcgagcgatggacgtttgagcttcgtcggcacggtcgctgaccggagtgtgcagcggcgagacgacgagcttgggagccggcccgcgacacgacaaggatgagcgtccatggagattcgcttcgatatcacctccggggatgcggtcgtcctcgctcgcttccttcggaccctcggcgatgacgaggccggcttcgccgagctcgctcaggtggcggctgcagaccccgggctcgctgcgagcatcctcaagctcgcgaactcgtcgtactatggactcgccggctccgtcgagcgactcgagttcgcgtgtgcgatcgtgggcatcctggggcttcgctcgctgaccgtggccgaactcgcgcggcgccaggggccctatcccgaggggcttgcggccttcacgacgttgctggccgcccagatggcggagcgctcgccccacacgagcgtcgacccgcaagtggcgctctcgaccgggctcgtggcgacgctcggttggatcctcgccgcgcagcaagatcccgtcggctatgcgacgtggcacgacctcgcgctcgaggatcgtcgagccttcgaggtggagcgttggggacgaccacttgcgagtctctcccaagaggcgcttcggcactgggcgtttcccgaagtgatcctcgatgccgtcggcgaactcgacgcggccggcgacgtgtcgaccctcgggcgtctccttcgagagagctggcgcgcggcgagcgagcgtctcgggcccgatggggccatgttgatgagcgtgtgagtccaaccaggcacgcggtcgccggaggcggcgtgcctagctcgggagtaccgtcaccagcgtgccgatgtggacctgcggatagagcacccccgcggtcgcgatgggcagctcgacgcagccgaggctctggggaaagccgtacgaggcacgggggaacccgtgcacggcgacggagccgttgaagtagttgatccagtgcacaaggtcgtggtagggggtgccgttcgggttcgtgccgctcatgtagttctcgacgaagcggaggtagatcggccaggtgccgacgggggtgttgagcccagcgatgccggtattgaccggactcgtcagcgtcacctgcccgttcacgtacagccagagcgtctccggtcgaaccttggacacgaggatgtaggagtagggatgcggatccatcgtccccgtcatcgcgtcgtgaatcagggtgggccagaggagcggattggagagcccggtatcgtcgaggccctcggcgtgctcgaacgacatgatcgcaccttgggtcatcaccgtgtcctggccgggctgccacaggctcgtgagcgcactcggcatcgtccagcgccatgagaacgtgccttgtggcgcgtccacgctcgcggcggcctgcgccgccagcgtcgatggggccgcctgggtcggcgtgaaggtcaaggggaggtagccgagctgagcgagcagctcctggaggcgcaggatcgacggggacgctccagcgagggtcacggcgtcggtggtctggccgagcgtaccgctcgagctcgccaacgtgacggcgtgagggaggtgcagtgtgaacgtctcaccgggccagaaatcgggcgtctggggggtgaagacgagggtgtagggggtcggtcgactccaggatcccgagaccgggtcggcgccggcgacagttggcgtgatggtggggttggtcgcgccgaagaccgtcgaggtcggggcggacagcgtgatcgagatcggcgtcgacggcgtgagaccggaggttcccggggagataatcgcgatcggagacgccgacccggtgcggaagaacgtcagctcgctcggtgcggcgagtgactcccacggggctggggcggccgcgatcgtgacgacgccagcgtgcaggccgctcgccgacgacacgacggtcaggcgccgcgatggctttgcgaggtggatgacctgcgaactcgtcggcgtcgtgatgcgcacggtactaacgggcgtcgagaagtagccagcgatcgacccatgggtcgagatcaccacgggatcgaggaggcgcgtcgtcggcgcgatgatcgtctgggtgacgttggtgcgggacccgaggagccaacgcagccagctcggcggtgcgagcgtcgcacgcacggtgatggtggtgccctgcgcgatggcgacacgggggacgatgcggccccggcgatcgacgacggagatggccttgccattcgcctcggccgagatcgccacgatgcgctcggcgatgccttgatgttccaggcgtacgatcccacgctcgctcgcactgagggacgttcgtggcagttcgagatacgcgatgccagcggcggccgcggcaacaacgacgccggccccgaccacgatgcgggtgttgcgccttcggacacgtctcgaacgatgcacgcccctcggtacctcctcgtcccctcgcgcagtcaacggcgcgggtggagtgtcgttgctagtgtaacgacactcggtggcgatttcctgagagacagggcggctgggaggggatgtggtcacgaagttcttcgtcgaggctctggtgacgttgctcgtgatcatcgatcccatcggcaacatcccgaccttcctggtcgtcacccgtggtcgggaccagcgtgcgcgccggcgcctcgccacggaggcggtgctcgtcgcggcggcggtgctcgcggtcttcgcgctcgccggttcccagatcctcgactatctcgggatctcgattcccgctcttgaggtgtcgggaggcctgttgctgctgatcgtggcgctcgagctgctgaccggtcggggtgggtcgatcggtaccacggaggagggtatctcggtggccgtggttccccttgcaaccccgctcatcgcgggtccgggcgccattgctgcggtgttggtgctggccaagcgagctgcgacagcgccactttcggtggcgctcgctggggcgttggtcggttcgatggtcatcttgtgggtcgtcttgcactacgcctcggccttggtccgcatcctgaaggagtcgggcatcgcgctcttgtcgcgggtgttcggcttgctcctggccgccatcgcggtccagctcgccgccgagggaatccgcggcttcgggctctagctggtccacggcggcctcgcgcggagccctcggtctggggggtcgggcaagaggacgtcgaacgagtctcgctggcgctgtggagtcgcctgtgatcgggatcgaggacgtgccccgatcggcccgaccgcgaccttggtgcgcggtgacgtacatccatggcgcagcccatcgaggcgagcgcacgagcgtgggctgggcgcagcgtgccacgttctcacgggaccgcgacgctgatcgcgtcctgcccacccgttcggcgagcacgcttgccgggaggtcgtcgaactctgcgcgcagggcccttatccgggtctcgtcgctcgcgaaggatctgtcggtcggggttcgccgagagctcggcggctcgctccgagcggccagcttgatgatccttgtgcgcgagatccccagacgcgcggcgatgcgagccttggggacgccctcggctaccagccgcctgacgagtgctcagtcttccacggtgatcacccttccctgttcgggtgttcactgttcaccggcgaagtcgttcagtccttgaacggctcgacagtcgcggccgggggccacccgtgtggggccgtgacgatgaccccacggcgtcgtgggagcgaggctctcgcgacgatctgtgcccgagcctggtgtctcggtgcgctggtcgagccgcgcgcctgtgtgctggtgaggtggccgggtgctcgcgcacgacgatgctcgcgcgccgcagcgagccatgaggtcggggcgccagctcctgggccgtcgagagcacgccgcacgcgccccaggcagcagcgtccctggcgtcgctcacgatcgcgcgtgcatgcgcctcgatgcggtcgcgcacgcgtcatctcagcgaggatggcgcgagccgcgatctgcgctcagaaggcctcatgagctccggtcggcgggtgggagcccgtgcggcgcgatctggtcgtgcgacgatgtcgaggctccgtgggaggctgcctcgcaggcgtggcattcgaactcgagcgtcgcgtgggtgatcccgtgcgcacgcgcgagccgttcgcggatcatgtcggcgagcagctgcgtctggtggagactgagacccgagcgtgcaacgatgtgggccgagagcgcattcgtctgttcgtcgaggcgccacaggtggaggtggtgcgccgcgatgacacccggcgtcgcctcgatcgtggctcgaactgcgctcggcgcgacaccacgtggtgcgagatccagcgagagtgcgacggcatcgcggatcatgcgccatgacgtggcggcgatcgtcgcggcgatgatggtggcagccgccgtttgggcgtcgtgaccgaggcgcgtctgtgtgagggacgctgcaaccagtgttgcgactccagccgcgaggtcggcaaggccatggaggccgagcgctcgcgcggttccggatgtgcggtggagccatgcctgcacgatcagcggagccgcgggcgcgagtgagagaacgcctgcgacgacgaggaccgagacggtgctcggcgtcgcggcgcgagcctgaacgacgacgccccacacgctcgcgagcgtgagggcaagggcaagggtcgcgcccacgaacgcgtccacgcgatgccagccgaaggtattgcgctcgtcgggcccgtgctcggcgaatcgtcgcgctgcgaccccgagggcgagcgtgccgaggtccatcgccacgtgcaccgcgtcttcaccgacgagcgcactgtgggctccgatcgcgagcaccacgagcgcgacggccgcgacgacggcgagcatgacgctcccgatggcactcgcgtggcgatgcatggctcttctagtctaggtcgtcgccgtgggcgacctcggggaatgatcggccgcgaccatcccgcggcgcgtgtggccccgccttcaggtgggagtggagtcacggtcgcgaggtggttgctcccgcgcacgagcgcgtgaatctggtccgtacgcagcgggctaggatcgtcgttggtagatgtccgggtgagccgacgaaaccctaggaggatcgcagtgacagcagatgctcagacgctgggcgtgatcaagcttggtgatattgcgcccgactttgaggccgagacgacgaagggcaagattcgcttccacgagtggctcggcgatgcctggggcatcttgttctcgcacccgcgcgactttacgccggtctgcacgacggagctcggtgaggtggctcgcctgcgctcggagttcgagtcgcgtggtgttcgtgtcatcgggctgtcggtcgacgacgtcgagtcccaccacacgtgggaggccgacatcgccgacatcgccggcgcggagatgtggttcccgatgatcgcggatccagaccggacggtgtcgtcgctctatgggatggtgcaccccaacgagctcgactcggcgacggtgcgctcggtgttcatcatcgaccccgccaagcgcgtacgcctcatgatcacctatcccgcctcggtgggtcggaacttcgccgagatcgtgcgggtgatcgatgctctccagcggacgtcgcgctacccagtggtgaccccagccaactggacgccaggccaacgtgtcatcctcgcgacctcggtgccgaccgatcaggcgcgtgcggcggtgggccacgacgccgaggagattcggccgtacctgcgtctcgtcgccgacccaggcaccaactagtcgacgacgctcgagcctctctccgtcgagtcgtgccgcggggccgtcccgcggcacgacggtattcggggcccctgcgaggtcctggaggcgtgggcgctgtcgtggcgctggccgagtcgttcaccagtcggttccagcgcgccgggttgcccaagcccagggctcggcacgtgctagcgtcgagcgcggagaggaggggcagtgcgtatcgcggcccaagtcgactacgccggggacgtgcgccaggcggccgacacggtcgctcgctgggaggatgcgggcgtcgacgtcgccttcgtgccagaggcctacggtcaagatgcgatcagccttctcggttacctggcggctcgtaccgagcacatgttgctcgggcccggcattcttccgatcttctcgcgaacgccagcgctgattgcacagactgcggtcggtctcgacgtggtctcggggggccgtgcggtgctcgggctcggtgcatcgggtccgcaggtcgtggaggggtggcacggggtcgcctacgatcgcccgttggctcgcacgcgagaggtcgtcgagatttgccgtacgatctggcgccgcgagcctctcgttcaccacggcatctacgaacttcccgcgaccgggcccggcacgacggggctcggcaagccgctcaagctcatcacccacccgccgcgcgagcggatcccgatctacctggccgccatcggggcgcgcaacgtcgcgctcgcggcggagatcgccgaaggttggcttcccatcctgttctcaccggagcgtgcggatgcggtgtggggcgagtctctcgaagccgggcgtgcggcgcgcgatgcctcgctcgggccgctcgacatcgtcgccggggggatcgtctcgatcggtccggatcgcgaggcgctccgtgatctcgctcggccgttcgtcgcgctctacgtggggggtatgggcgctcgcgggcgcaacttctaccacgacgtgctcgtacgttacggattcgaggaggctgcggacgcgatccaagagcgctacctggcccacgatcggcacggcgccgaggcggcggtgcccgaggcgttgctccgcgaactcacgctcgtcggtacggaggcagaagttgcggcgagactcgatgcctgggcccgagctggggtgacgacgctgctcgcgacgccggtcggtccggacccgctcgggacgctgaagcgtctcgcagcgctcgcgcggtagcggtgacgagtcgatcggtgctcgagcgctctctgggtgtgctcggcgtcgtggcaggtgcgtgtggtcttgctcgacttggcgatccgttgcccgtggcacgcgagacccctcgcggccatgtggtggtggccatccctgctcacaacgaggcacgacacatcgatgtcgtgctcgcctcgatccgacgacagcgctgcgagcacctcgatgtgcgcctggtcgtggtcgacgacgcgagcgacgacgagacggcggagcgcgcgcggcgcgccggtgcacacgtcatctccgcgggtcccgtcgccgacggcgtcaatccgaaggcagccgccctcgcacacgtcgacctcggtgatgccgactgggtgctgtttgtcgacgcggacgtcgagttcgttgcggacgacggcctggcgcgcttgatcgcgatggtggagaccaacgatggggggctcgtgtcggtccagccgcgcccacgcctcgacggctggtgggcaccactgacggcctggctgtggctggtgccgatggttgcgagtggggccttctggccgggtgcgcgccatcggtcgcgggtggccttcggcccggtgctcgcgatgcggacgtcgacctgtcggagcatcggtggtcacgcggcacttgcgagtgaggcggtcgacgacgtcgcgatggcggcggcggtacgtcgtcgtggcgagcgcgtcgtggtctgggctgggggcgatgccgtgcagatggacccgtacgagggcctcgccgagacggtggctggtctgcgcaagaacatcgtcatcggcgccggtgcggccggtgcgctcccatccttcggtgcggtcgcttgggtggtcggcacgatcggggcactcgctcgactgcgccgcggtgactggagggctctcccgacggcgctcggaggtcttggtgtcgcggtcctcggagcgcgtcggcttcgacttgctcgttggaggcacgtgtgcctggtcaccgcgggcctgggcctcctcgtcgcgacgaccgcgctgtcggtcgtcgacatgctccgggggcagacacggtggcacgggcgacggctacggcttcgctagcgattcgcgtcgctctcgccatcggctggtgggtgggcctcagcgtcgtggtcggctgggtcgcgtcgcgcctccggccccgaggcctcgcgttggtcggcaccttcttggcgactcgttcgttcgagggcgacggccatggctacgaacggctcggggtgcgtcgctggaagcgcctcttgcccgatgccggcggagccttcggaggccgccgcaagcgtctcttcgggccccgtgggaccggtgggcgcgaggcgctcgcgcgcgaggtcgaccgcgccgaggcggtgcactggtgcctgctcgtcgtgcaatgggctccggcgctctggttgggtccgctgtggtggctcggccctgcgtatgcgatcggtgcgaatgtgccgttcatcttggtcctccgctacgtgcgggcacgattgaccgcgctcgggcgcagacggccctgagtcggcgctgcagttccatgcgatcgtgcgagcgaccgtggcttcgcgtcgtcgagcagggctcgcgcgtgccctggccgccgcgtactgcgtccgccggcgagcgagggaggcggctccggcgcgctgatcgtggccgggctcctctgtgcgcgaggagtcgaacgtcctccgaccgactccggcgccggtgcacgtctcgatcaactctcggaggaggcgaaggtgacgactccgggaacgtcgagctcgccgtgtctctctacgacgattgaccgtctctgtgcagacggggctcggcggcttgctcattcctcgccgtctagcgggtagcaacccggagaagtgttggccaaccaccgggtgcgtccggtaggtgagcggtccccacagccagacgccccggtgcgagcccgggatccccacgccaactctcgctggtgccgctgagcgccgatcaggtcatgggtgcgcagtgacaccagtcactgcgacggcgaggacggaatcgagaggagggcctggttggcgggtccagatccttgcttgccggtgtcgcagacggcttggccgttggcggtgcggtgacacgcgccgccagggagcttggtctggatgacggcccggggtgacgggagcagcctcggaggcgtcggtctcggccggaacgtcccatgcgtgcacgagagagtcgaagtccccggccccgaggcgaggcggtgtcactcgcctcgtgcgtcgacctgtccgccttcgcgagggcgcagcatagagctgcggtagtagcgcagctcggcgatcgagtcccgtacgtcgtcgagcgcgcgatgcgcggggttcttctgcggcatgtgctcgatgacctcggggtaccagcggcgcgcgagctccttgaggctggagacgtcgatcgatcggtagtggagcagggcctcgaccttgggcatgtggcgcgcgagaaaccgacgatcggtgccgatggagttgccgcacaggggcacctggtggggatcgggaagatgggccttcaagaaggcgaggacggtcgattcggcctcgtcgatggtgagcgacgctcgccggacgtcttcgaggaggtggttggcagagtgcatctgcacgacgacgggctccatcaccgccagctcctcgtcggttgcgtggaggacgagcgggccgagctcggcaacggtttcgagttcgtcgtcggtcacgatggcggcgatctcgagaatgacgcaccgctcagggtcgagacctgtcatctcgaggtccatccatgcgagcacgcgcccaggctagccaacgaccaggctaccctggcccgtgggtcaaaggaggacgcgtggaggaggtgccgtcgtcacgaccatgggtcgtgatcccgacgtacaacgaagtcgacaacatcgggcccatgctcggagcggtgctcgcggcggtacccgaggcgcacgtgctggtggtcgatgatggctctcccgatggcaccgcggcggcggtgcgcgccgtctcggagcgggacgagcgcgttcgtttgctggcacgggaacagaagacgggactcggcggcgcctatcgagacggcttcaaggtggcgatctcggagggagcgaccagcgtggtcgagatcgacgccgacttttcgcacgatcccgcggcgattcctgcgctcctcgcggcgctcgacgacggtgccgcgctcgcgattgggtcgcgctacgtgcttgggggtcgctcgccaggattgtcgagagagcgtcttgcactgtcgcgcgggggcaatctctacgcggcgttcatgctcggcctaccggtgcgtgacgcaacggcagggtttcgcgcgtatcggacggacgtcattcacgaggtcggctttcgttcctcgcgtgccgatggctacggcttccaggtggaactcacgcgcctcgtcaacgacgcaggctatcggatcgtggagattccgatcacgtttcgtgatcggcgagcgggcacatcgaagatgtcggccaagatcgtggtcgaggccatggtgctgtgcacgatttggggtatcggacgtcggttcccgtggctcaacgagcaacggcaggaggcgctcatcgaccgcctcggcgccgtcgtcgatcggggagcgcgcctgtggtcgacgaggcgttgagtctgcgggtcaagcggctcagtcccggcgcagtgctgccgtcgtatgcacgggcgctcgacgcggggctcgatctcgccagcatcgaagagaggacactggcgccgggggagcggcacgggtttcgaaccggtctcgcgctcgagcttccggtcgggacgctgggactcgtcttgccccggagtgggagggcgcttcgagagggcctcacggtggtgaatgcgccgggcctgatcgacgcaggctatcgaggcgaagtactcgtggcgctggtgaaccttggcgaggctccagtcgtgattcggccgggcgagcgcatcgcgcagctcgtggtgctgccgttcccgagcgtacgggtgctggaggtcactgaacttgcggcgagcgaacgcggatccggaggctttggccacagcggctgagctcacgtgtgaagcaggctgccgacgcagctgttcgatcggccgggggcctcgctcgctatactgaggggcgctgcggacgtggctcagttggtagagcatcaccttgccaaggtgagggtcgcgggttcgagtcccgtcgtccgctctcagacgacctgcagcgatgcgggtcgtcgttcgttgtgggctgggcctgctcgtgagcaggcgtcgtgtgacgcgcggggatgccttacgccggcccgtgatccacggaagccggccgctgtgtcgttcgaccgctgtcgccgtgatgtggactgttctgcggacaccgcacgcactccttgcgccggagggcgtggccgtgacggtcgcgtaccgcgatggagcggccgtggctcggcgctcgctcggcgcgtcgtggcaggccattcaccgcccgaaccagcctggcgagtgtaacgggcgtgttacgttcgtcgggtggccttcggcgacgctgtggatcgtcgctagggtcttctcgggagggtgagggtggatgcatgtagatgatgcgcaggccgcgacggccacggttgatgatgagtatcgggcgtttcgggtcgagtcacgaggtatcgagctcatcccggagacggagcgacccatgcggccggcagacctgttctggatgtgggctggcggcatctggaacgtcgaatacctcgtctacggcgcgctcatcgtttctttcggtctgtcgttcgctcaagcagtgctggcgatcatcgtcggcaatgtgttcttcgcgttccttggtctcgcgtcgttgcaggggccgctcgcgggcacgactgcgttcggtgtgagccgggcgccctttggtcggctcggcaaccggcttccatcgctgttcaattggatcacccaggtcgggttcgagatcgaagggcttgtgctcatcgtgctcgtcgtcgaggcgatgttcgcccacgaaggcgtgtcggtcggcaccggcctcaaggttgcgctgatcgtggcggctgtgctcgtccagttcatcgtgccgttcctcggtcacgcgacgatcgccaagctgctcaggtacctctcgatcgtcttcatcatcgtgtttgcggtgatgggcgtgctgattgcgccgcacgtccatccctcgagcgaccacaagcatgcctcgtgggccatctggacgaccgccgtcgtgctgttggtctcggctggggggctcgggtggaccgagaacgccaacgactactcccgctatctcccctcatccaccccgaaggcctcgatcttctgggcggcgacccttggcggtgcgatcccagcgatcttggtcgagctcctcggtgctgccgcgttcttggtgagtccgcaggcgacggcggtcaccggcgtcccctcgtcgtttgcgagctggttcttctggccgttcatgatcctcgtgcttccgcaggtcttcgcgatcaactcgctggacctctactcgtcgggtgtcacgctgcaggcgcttggcatcccggtgaaccgctggggtgcggtgatcatcgacaccatcatctccgggctggtcacggcgctcgtcatcttcaagggaaacttctataccgatctgtcggggttcctcgactacatcgtcgtctggctcgcgccgtggttcgccatcgtcttcgtcgactatctgctgcggcgcgggcgctacgaccgtgcgggtcttgccgccgtacgcggtggtgtctattggcgcaatggcggcatcaactggcgtgcgatcgctgcgctcatcgtcggcatgggtgcggcgctcctgtggatcgatgcccagttctacgtcccctcgttcctcggaccgatctcgcgtgcgaccggcgggtctgacctcagctgggtgctcgggatcgtggtgggcggtctcgtgtactacgcgcttgcgcgaggtgaggtgcgccgggaggtcgaagcaaccgagcgaggggtggccggcgcagaggcggtggagtaggacgcgacgcggttcggcggggtcggtgctcgggcgatcgagggtcgaggaaggtcgctgacgcatgtcgccggagactcgctaaggtcctgttcgtcgagggaccagacggatcgcaggaggagttgacggtgggactgaccgctcgcgttggacgcttgctcggacgagtcgcgctggcgcccatcttcatcgtcgctggcttcgaggccctgcgagaccctgggcatcgtccggaggtcgccgcgaaggcgggcctcccgagcccggagctgctggtgcgcctcaacggggctgcgatggtcgcaggcggtcttggtctcgcgaccgggctacggcggcgtctcgcagcccttgggctcatcgcatcgctgggagcgacgacggtcgtcggtcatccgttctggcgcgaggagcccgggccaggccggacgatgcagcgagtgcagtttctgaagaacctcggacttctgggcgggctggccctcgtggtgtgcgatcctggtcgcgaccgcgacgcgtgacgtgtcgttgatggggagccacgtgggtgctccgcgacgttcgctggctgccacgatcgcgacgagttgtgacgctgcgttcacaggatgggactcggccggccttggtgtcggctctacgctggcggtgtgaaggagtggtcaggccgagcgcgtcgccagcaggctcgacgtgctggcgcatcacccgttggcggggcggggatggttggcttaccggcgcgtgccgtcgtctcagcggtggcggcggtgagctggatgatcgtcggggtcgtcatcgtggccgccgttcacgcgagctggcatgtcgaagccggactgttcgcgttcggcgtcggcgtcgtctgggcacggggggcgctcagagccgtcaacgcgcgttgagggcggaggtggcgtgaaccacgccgagggatcggtggtcgatcacttccagctggtggcactgctgggggtcggaggtttcgcggaggtgtggcgagcacacgatctcacgaccggtggcgaggtcgtcctgaagttccccactccacagctggttgccgaccccgtcctcttccagcgctaccagcgggagatcgccatctggcggaagctcgaccacccgggggtcgtgcggtgcgtcgacgatggccaacggcggagcgagccgtatctcgtgctcgagttcgtcgacggggtcacgctgcgacggtggctgaacgatcatccagggccggttccggtgaccctcgtcgtggcctgggctcgtcagctcgccgaagccctcgactacctgcacgggcgtggcgtcgtgcatcgcgacctcaagcctgagaacatcttggtgtcgtcgtccggggtgctcaagatcggcgatttcggaactgcggtcagtcgaggggcgcggaggctgacctgggggcagttgtctccggccatggggacacccgactatatgagccctgagcaggtgcggggacggcgcggcgatgagcgcagcgatctctatgcgtggggtgcgatcgtctacgagcttgcgaccggtcgacctccctttcgtggtgattcgtggctggcggtgatgactgcgcacctgcagcaggcgcccgaaccattgcgccaacggcggccggaactgccgccgggcctcgaggccatcgtcctccatgcgctgcggcggttccccgagcaccgttaccagcatgcacgtgaggtgctggaggatctcgaacgcatcgatgagcttggcagcgatacgtactcgttggcgccggagcagccgatcggtgacgtcgtggccgcgaccacgagcgggcgtcggctggtgtggttcgtggtcggggtcgccgtgggctttctcgcgctcgccgcggcggtgctcgtcgtggcggcgcaccactagggcgagccggttgaaggagggagcagggtgacgggacagcgaacgtggatgcgggcgtgtttcgtggatctctttggcgagctgcgctcggtgacggtgtcgggggtggaggtgacgagccacctggtggtcgatgcgtcggccatcgagggcgggatccgcgtcctcgagtctgactgctcactggatctcaccgccgcggctcgcctcgtaggtccggagggggagcgtctcgtcggcatcgtgcgctcaccggacggggtgccgtcgccgttggatacgcgcgccgcactcgcgcgcatcagtgcggagctcgatcccgagacgcgttggcgcgggatcgcggagctcgagtggtactgcttcgacgagcacggcgatccggtggacgaggcgggctacttcgacgatgtggtgggcatcggtggcgcgatcgcgcgagccgcctacgccaggttgtccgacagtggcataccggtgctagcgtcgcaccacgaggctgggcccggtcagtgggagctcgatctcggcccgctcgatgcgtgtgcactcgccgatgccgtggtgctcgcacgagctgcagtgcgtgacgctgccgtggagttcggggccacggcgtcgttcgcggcccgtccgctgccgggacaaccgggttcggggctccacctccatgaggtgctcgcgcccgaggtgaccgagtcgctgatccgcgcccgtgttgggggcctgctggatcatgcccctggcctgtgcgcgctcgccgctccgacggtcgggtcctatcggcgtctccacgccggcccggaggcaccgagcgcggcgctgtgggcgcacgagcatcgcggtgcgctggtgcgggtcgcgacggcggtcgacgggacccgatccatcgagtaccgcggtgcggacccgtcggcgaacccgtgcatcgcgatcgcagggatcatcgtcgcggcggcccatggcgcccaggagggtagcgaccctggcgaggcgatggacgaagatccggagggcttcgatcccctggcccgaacggcagccttcacgccgctcccgaggagtctcgatgaggccgtcgacgcgctcctggccgatgacgtgctcgtggacgcgttcgacgaccggctcattcatcgcatcgtcgatgccgagcgggcgcttgcccgccgcgcactcgcgggaggtcgtgatccagacgtgcgcccgggatcgatgtcgacgcgtgtgatcgatcggtaacgagctggtaacgctacctcgatgggtggcgtgtgggcgggtctacgatgcgcctagctccgctgcgatcggccgaccaggggagcgaggccagacgccgcaacggcgcggcctggcggtcgtccgaagggtgtcaccggaggtggcgtcctgatcgcgtaccgacaggtgaggagttgtgccatggcagcgagcgagcagcagatgcaccgaacgctcacgctcaccggtgtcacggtcaatgggatggccttgatcgcgcccggagcgtttctttggacaacgtttcaggaacaggcggcccagacgaaccacggtcagccgacgggccttgacatgtggacagggctcctcttcgccttcatcctcgccatgctgaccgcgtggagctacagccagctggctcggatctatcccgatgcgggcacgggctcgacctactacttcgccgaagccgccttcctcgaccagaaccacccgcgcttcaccgccaccgcgagagcggtgaagttcgccttcggctggatcagccacctgtactactggatctatccgggcatcatggtggcgttcatcggtaccctgatcggctacatcatcggcgcggtcggaggggtcacgctgtcgtggctcgaactctcggtgatcgccgtcgtcgccgccgcggggatcggctacatcgcctaccgtggcatcacggggtccacgatgacggcgctcgtcatcaacgtgatccagatcgtgaccctcgtcgcgatgacggctctcttcttcatcgcgttccgcgtcgcgcacccggacggtggctacgtgcaagcgagcgcactctcggtcatcctcccacacagcttcgtgaacctgctctaccagtcgaccatcgccatcttgttgctcgtcggcttcgagtccatcacggccctcggcgccgaggcgcgcaatcccgagcgcgacatccagcgtggggtcttgatcgcgctcgccatccagggaggcttctcgtacctgttggagtacttcggtgcgaacttcgcactcggctctgcgaccatggcaggtcaaccgggcgcaaacgtctttgccaaggccggcaacgatgcggcgccgatcggcacgatggtccagaacgctgccgatcgcatgttccatggcggcggagaggcggctgcgttgatcgtggccgccacggtcctcatcgcactcatcggcacgacgctcgcgtgcatcaacaccgcagttcgcgtgagctactcgatggccagggaccgtgagctgcccagcgtgatcgggtggttgcacgggcgcttcgccacaccccacggcggcatcctcgtgatcagcgcgatcagcgccgtggtggcgatctacggggtgcacacggtcgacaacctgacgcagatcacgctggcgtccaacatcgggacctttctggtctatggcatgacgtgtgtgatcgcgatcgtggcgttctcccgtcgcgccgatcgttccctgctcgctcatgtgctcgcccctggccttggggcgctcatgaatctggccgagctcgctggcgtggtctatctcgccatcgctggcggcggctcgggtgcgaccgatgcggtgaaggccatcggtgtggtgctggcctggaccatcgttgggctcgtgtggtactgggcgaacccgcaccgccatcatgccaagagcatcgtcggcgagcgcgccacgaggcgactcggcggggccgggcgcggcgtgtcggccgcggcggagacgccatagcgttcggtgctccggggggagctgccagctggtgatgcctctggcccgcaagggctggaggcatcacccatgaggaggagacgatggtacgacgctcgctcgaggccgacgagacgagtgggtcgcttcgggcccacgacggctcggtggcggcctgggtgagcgtgcggggtgtggtgcgggctgggaacgaggacgcggttgcggtcgtcccccctggcacctctggcgaggtgctggtggcgtgcgtggccgatggtgtcggcgggcaggcggctggcgaggtcgccagccaggcggccatcgaggcggccacgagcgcgatggggagcgggcgaggggcggtgcgggctcgggtgcgagctgcggttcgggctgcgaacgcggcagtcatcgacgcgcaacatcgcgagcgggctcggatggcaaccacgctcaccctggtcggggtgagtggccgcgacgtcgtcattggccacgtcggcgactcgcgtgcctatcgtgtcggcgacgagcggatccatcagctgacgcaggaccatacccaggcggccgagctgttgcgggcgggcttgatcgatcaggaggaggcagctcggcatccagcgcgctcggtgctgacgcgaagcctgggagcacagatggcggtggcgccggatctcgtcagcgtggcgctggaggatggggagcggatcctcgtctgttcggacggcttctgggggacggttccgcgcggcgcgctcttcgaggcgctgcgcggcgcgcgagagcccgacgcgctcgagggtgcgctctggcgactcgtcgggcttgcctacgaggcgggtgcgcccgacaacgtctccgtcatcgtggtgatcccgagtccgacggccacgagttcgggcgcgagcgtgcgcacctcgtggtggcggaggagccgaggaacctaggcaaggccgacgatacgcgccgccgcgtctcgtgcacgctgagcatcgctcgcggtgcggaccgcttctgctgctcggcgagcggtcgtacgctcgacggaagcgagcagacgggtgacgggtgcgatcgcgctcggcgtcatggacaagctcgtgatgccgaggcccgccagccagacggcggcgaggggatctgcggcgagctcgccgcagacaccgatggggatgcgaccgtcgacgtcgtcgacgaggcgagcgaggagtcgagcgagtggcggcgagaagggatcggcgagggctgcgaccgccgactcctcgcggtcggcggcgaagaggtactgcgcgaggtcgttggtgccgatcgagacgaagtcgacgctgcgggcgagctcgtcgccgagcaggcacagagcagggacctccaccatgacgcctgcactcgggatccctgcggcgtgggctcgctcgaccacctcgcgcgcttcgtcgatcgtcgtcaccatcggggccatgagaccgacctcggcaccggtcgcgcgctgggcgtcggcgatcgctgcgatctgggtgtcgatcacggccggcgccacggcgcgtgccctccatcctcggacgccgagcgcggggttggccgagcgaggcagatcgatgaacgcgagtggcttgtcggcaccggcgtcgagcgtgcggacgatgcaacggcggccccggaatggggtgaggatctcggtgtaggcctcggcttgctcggcgcgagagggagcctcgtcgcggtcgaggaacaagaactcggtgcgcaaaaggccgataccgaccgcgccggcgtcgatcgccccctgcgcgtcggcgacgccggcgacgttggccatgatggcgacggcgccgatggcggcacggtctcgagggagcgtcgttcgcgcgggcgtacgctctgcggctcgcagcccagtgacatcgtcgtcgttggggttcacgatcgcgaccgcgcgcacggtatcgacgagcacggtgtcgccgtcgtgcaccccgtcgaggcccaccacgccggtgagggcggggatgccgagtgctcgggcgaggatggcgacgtgggcggtcgggctggcgccagcgagcaagagcgctgccggccgttcgtgctcgatcgcgaggagatctgctgggccgagctcgttcgcgacgacgaccttgccttcgagcatcggtccttgggtgcccctgaggcgggcgatgaggcgccgttcgatcgcgccgaggtccgccgctcgttcggcgatcgcgccgccgacggaacggaggacgcctgcgacctcgtcgaaggcgtcgtggaccccgacggtggagggatcgtcggcgaggtgacgctccacggcatcgacgagcatggggtctcgcgcgatggctgcgtcggcggcgaggatctgggacagctcgccgctcgcacgtcggctggaagcctcgaggtcgtcggcgacctcctcgagcgctcggcgcacgctggcgggatcgacctcggtgcgctcggcgaccgcgtcgacgcggacggctgtcccgacgccggctccctgggagcctggttgaccgcgaagggtgtgacgttccggcatggaccctcctctccgggcgaggcgcctcgggaccaaagacccttgacgtcgtccacgacgcctgtcatgatacgagcgggcagagtgcacgagagcgcccggacgtgagaggtcgcgtccgggcgctcttcgtgttctggcccgggagcgatgcatgacagggggaaggaggccgtaggtggccacaacacaggcgcgaccggccggcaagaccggctggcgcgcaacgacatggggagagctgctctccgaatatctcggtacgttggtgctgctcgccttcgggacgggctcggtcgcggttgcagtggtgggcctcaccatgtccggccgcaccgtcgtcatcttccagggagcgggcggctggctgctgatcacctggggctgggccatggcggtcgtgatgggcgtctacgtggctggcggggtgtccggcgcacacctgaacccggcggtgacgctggccatggcgatcaagggctcgctgccgtggcgtaaggtgccgggctactggatcgcccaggttctcggggcattctctggcgcggcgatcgtctacctggactactacaaggcgatcgatgcgtggaaccttgcgcaccacgtcacgcgcgccagcgccggtgggttgacgaccttctcgatctttgccacgttccccgcgaagtacttcggcacgagcctcgtcgggccattcatcgaccaggtgatcggcacgttcttcctgctgctgttcgtgctcgccatcaccgacgcgacgaactcggggccgggttcgaacatggcaccgttcctcgtcgggatggccgtcgcggcgatcggcatgagctttggtacggacgccggttacgcgatcaaccctgcgcgtgacttcggtccgcggctcctgacgtggttcctcggctggggacacaacgccttcgccggtctcaacggttactggtgggtcccgatcgtcggtccgctcgtcggtggagcgatcgcggttggggtctatcgctggttcatcgaggacacgattcgtgcgcgcttcgcgcgccagagcacggaaggaggggcgcagtgaccacccgtatcctcgctcttgatcaaggaacgacgagctctcgagcgatcgtcttcgatctcgacggcaccatcctcggcctcggccagcacgagttcccgcagtactacccgcagccaggctgggtcgagcacgaccccgaggagatctgggagtcccagcgccaggccatcttcgacgccctgcgcgccgccggcatcgcgccaggggacctcagcgcgatcggcatcaccaaccagcgtgagaccaccatcgtgtgggatcgccaaaccggcaagccggtcatgaacgcgatcgtgtggcagtgccgacggacggcgccgatgtgcgacgaactccgtgcggccggccgcgaggatctggtccgttcccgtaccggtctcgtcatcgacgcttacttctcgggaacgaaggtggcctggatcctcgagcacgtgccggaggctcgtcgcctggcggacgagggccgattggcctttggcaccgttgatgcgtggctgatttggaagctcaccggcggacgggtgcatgcgacggacgccaccaacgcctctcggaccatgctcttcaacatccacaccggtgagtgggatcccgaactgctcgagatgctgggcgtgcccgcgtcgatgtgcccgacggtcgtcgactccgcaggcgtggtcgccgagacggaccctgagatcttcggtgccagggtgcccatcgccggcatcgcgggtgatcagcaggccgctctcttcggccaggcgtgcatcgagccgggcatggcgaagaacacctacgggaccgggtccttcctgctgcagaccacgggccacgatgcggtcgcgtcgcactcgggcctgctcacgaccgtggcgtggagcatcgggggtgagcgcacctacgcgctcgagggctccatcttcgtgaccggagccgtcgtccagtggctgcgcgacggactgcgtctcatcgcgcatgccgaggacaccgaggcgatcgccgccgaggtccccgacaccggtggcgtcgtggtggtccctgccttcgtggggctcggcgcaccggtgtgggacccgtacgcgcggggcaccatcgtcggcatcacgcgcgggacgacgcgggcacacatcgtgcgggccgcgctcgaatcgatggcctaccagacgcgtgacgtcgtcgaggcgatggcggccgactcgggccagcgactcgccatcttgcgggtcgacggcggtgcggtgcgcaacaacgtggtcgcacagctccaggccgacgtgctcgggatcccggtcgagcgtccgaaggtcaccgagaccacggcgctgggtgctgcctacctggcggcggtcggcgtgggtgcggtggcaggtcctggggggctgcgcgacgtgtggcaactggagcggcgcttcgagccaacgtgggacgaggcgacgcgagccgcggcctatcgcacgtggcagcgtgcgcgggaccgcgcccgagcgtgggtcgaggcgtaggctgcgagagggaggtagtcggatgaagaaggtcatcaacgaggtcgaccacgtcgtcgacgagtctctcgatgggctcgcggccgcgttcgcaccgtgggttcgccgcatcgagggtacccacgtgctggcgcgcgcggtcgcgaagccatcggggcgcgtcgggctggtctcgggcggcggatcgggccatgagccggcccacggcggctacgtcggtgagggcatgctcgacgccgcggtggccggcgaggtcttcacctcgccgacgcccgatcagatcctcgagggcatccgcgccgccgaccacggcgcgggggtgctgtgcgtcgtgaagaactacaccggcgacgtcatgaacttcgacatcgccgccgagctcgccaaggaggaggggatcgaggtgcgccaggtcgtcgtgaacgacgacgtcgcggtcgaagactccctgtacacctcggggcgacgaggcatcgccggaacggtgttcgtccacaagatcgcaggcgcagcagccgaacgtggggacgatctggcgacggtggcggcggtcgccgagcgcgtgatcgcgaacgtgcgctccatgggcctcgcactcgcaccgtgcacggtgcccgcacgtggagagcccaccttcaccttgggcgaggacgagatcgaggtgggcatcggcatccacggcgagcctggggttcggcgcgaaccactgcgtcgtgccgacgacctgaccgacgaactgctcgatcgggtgacgagcgacctcgggctcgagagcggtgcatccatcgcggtgatggtgaactcgatgggagcgacgccgctcctcgagcttgggatcgttgctcgccgcgtctaccaggtcgcggccgagcgcgggtggcacattcgcaccgcctgggttggcgagtacatgacgtcgctcgagatggccggctactcgatcacggtgcttcgactcgacgacgagctcgccgcgctgctcgaagcccctgcgtcgacggctgccgttcgggtggcacggtgagcgagcccggttcgctcgcctggtggcacgacgtctggcgctgtttcgcggcgtcggtgcgcgaccagcgcacctggctggacgatctcgacgctgcgatcggcgatggtgaccacggtacgaacctgaaccgaggtctcgagcgcgccctcggggccctcgagacctcgcagacgccgcgagcggggctgaggagtgttgggatggcactgctcggcacggtcggcggggcatcaggcgcgctgtggggctttggctggaccaaggcctcggcggcagccggcgacgggaccggcgccccaacgcccgacgaggtcgtggccacgctgtcgctattccgggacgcggtgctcgagcgtggccacgccgagctcggcgacaagaccatggtggatgtcctcgtgccggcgctggcgtcgctcgctgccgagctcgggactcagcgctccttcgccgaggcagccgctaccgccgcgtccgtggcctcggagcgtgccgagtcgaccatccccctcgtggcgcgcaagggccgcgcgtcgtatctcggggagcggagcgcaggtcacgaagaccccggtgcggcctcgatggctctgttcttcgcatgccttggcgaggtgagctgaggtggtgggcgtgctggtggtgtcgcactcgcggcgattggcgcagggggcgtgcgagctcgtcggcgccatggccaagggggttcggctcgagtggcgaggaggtgagccccccgagcttggcgtgagtgtcgagctggtggcagatgcgctcgagggcctgctcgaagggggcggtgaggtggtcgtggtcgccgacctcgggtcctcggtcctggcggcagaagcggcggtcgagctgatcggggcaggcccacgcgtccgcgtcctgcgcggcgtcccgatgctcgagggcttcatcgcagccgcgatggcgctcacggtgggcggaggcctcgccgaggccgtcgccgcggccgaggcggcctgtggtgcgctcgagggcgggcgatgacgcgccgccgggtcgtcgtgatcggggccggggccaccgggctcggcgtcggcgtggatttggccacccgtggcatcgaggccgtcgtcgtcgagcgtcacgcggtgggggcagggacgtcggggcggttccacggtcttgcacactccggcggtcgctacgccgtcaccgacccgctggccgctgccgagtgcgcccgcgagctcgcggtgctgcgccagatcgcccccggtgccctcgaggccaccgggggatggttcgtacgcacgagcgacgatgacgccttcgagcaggcgtggctgcgtgggacggcgtccgccgggatcgaggtccgcgaggtcccgctcgacgtcgccagggcgcaggtgccggcggcggcggcgcgagctcggcgggtgttctgggtacccgacggtgtgctcgaggggttcgagctcctgcgcggcctcgtgcgaacgctgcgacgtttcggtggcgacgtgctcgaggggtcggaggtgatcggcctcgtgcgcgacggtgccagggcggccggtgtggtcgtgcgccaaggcgatcgagaggtcgtcgtcggtgccgacgccgtggtgaacgcggcgggtccactctcgggtgtcgtcgggcgtcggctgggcgccgaggtgccggtcgcgccgtcgttcggcacgatgttgatctttgccgatcgccgactcccgctcgtggtgaaccatctcgagcgcccatccgacggcgacatcttcgtaccccatggcgagactgtcatcctcggtaccaccgacgtcccccacgaagacggcgaggcgctaccgccgagccggcaggaggtggctcggctcgtggagctcggtgcgcgcttcgtgccggaggtgcgcacctggcgaccgatgcgggccttcaccggcgtgcgccccctggtcgccgatccgggtgcgggcgggccgcgaggtctgtcgcgcagtcacaccatcgtcgaccacggcgcgagagacggtatcgccggcctgttcgcgatcatcggtggcaagtggacgacgtatcggctcatgggggagcagaccggcgacgccgtcgcctcctacctcgaggtcacggcaccgtcggcgacgcggtcgctcgtggtggtgccggcgcgagttcggggacgcgcgccgacgtcgtcggagacgttgtgcacctgtgagggcgtcggtcgtgacgagctcgtcggcgagggttcgctggatcgttggcgcgtcgagcattgggcgacgatggggccgtgtcaggggacgttctgcgcccatcggttggcggctcgcgcagctgaactcacgggcggcgccctcgagagcgaggcgctcgatgcgctgcgtgccgagcgcgcgcggggggtcgatgcggtggcctatggcgcacaggcacgccttcgggccctcgcgtccgagcagcgtcgctggtgggggtggggctcgtgagcgtcgtggtcgtcggggcagggccgagcgggctcctcgcggcgtcgctgctgctggacgagggtgcgtcgccgatcgtcgtcgcggccggcgagggttctcttggcttgtggccgggttggctcgcggccccacgggacgatggcgccgtcgagcgggccgtcgcgagcttgaatcgggccgacgcacgactgtcgagcgtcgacgagcgcgaccgactcatcggcccgctcggggtcgcgcatcggttcgcctgggctccgccggaactcgcgagagtgggacccgaggacgtcgtcggcttctgcggcttcgccgagatgaccgagacgcgggctgccgtcgcggtggcgacctggcagagccagaccggatcggcagccgtcggcttcgacctcgcgccgtggggccggcgggtgccgttcgaactcgctcgcttcctcgggcacctggagggggcgcgagcgctcgggcgcgccctcgcgccccgggtcgacggcgccgtgagcgtcgtcgcggtaccgggactgctcggtatcgaggatgcgacccgggcgctggcggtgctcgaggagatgctcgagcgccgggtcggcgaggtaccgctcgtcacgcctgccctggctggttggcggctcgatcgtcgggtgcgcaccgcacttgcggctcggggcgcgacctttcggcgcgccagggtcgtcgaggtcggtcggggaggcgtacggctcgcggacggtgcgcacgtcgacgccgacgcggtcgtgctcgccactgggggcgttgcgggtggcggcatcgcaatcggtccggatggctcgctcacagatagcgcgcgcggcgtcgcgatcggcgaccctgcggcatggatgatgggagaagacgtggggctgctcggttatcgcgaggtcgtcgtcgacgaggaggctcgggtcgtcgcggtgggcgcgctccgtgcgcacgaaggctccgggttcgcccaggttgcccagagcgtcacggaggcggtcgaggtgcttcggtcatggtgagcacggcaacggcgctcagactcgacaacgccgatgcttgcatcaagtgcggtctgtgtcagctcgtctgtcccgtgctcgaggtggacccggcctttagcgggccgaaggtgctcgggccggactggcatcggcgcttcgtagctggcgagcgggtgacggacgacacggccgcgcgctgtacgttctgccagctgtgcgagtcggtgtgtccggtgggtgtccccatcgcgcacctcatcgcggagcacaagtcgcacctcgaccacgacccgcgctcgaggatgcgagatgcggtcgtggtccggcccgatgtgctcgcgcgctttccgtggctgacccgggtgccgaggcagctcgcgccggtcgccggcctgtcgtcgacgacacggtggccgcgtccgcaccgaccccgggccgcgtcgagtgacggcgggacctctcgcgtcggcacggtcggagtcttcgtcgactgcttcagtcgggccttcgacggtgccacgatcgatgcactcgtcgtgctcctcgggcgtgcggggatcactgcacgtctggtgccggcggacacctcggtgtgctgtggcgccgcagcgtgggcgagcggtgctccgcacgtggccgaggggcgcgcgcgcgaggcagcgcgtgccatcgaggccgacgccggcgatctcgatgtggtcctgagcgtgaacgcaacctgcgaggcgacgatgcatggcgagtggcacgacgtcttcggcatccagacgtcggtgccgagcgtgagcgcggtcgattggctcctcgacactggtgtcctcgctgggctcgtggagcggcggcgaaggggcgatcggccgaagcggctcgctctccacacgacctgtcgcgcgacggtggccggagaaggcggcgccgacgtcgccgcgctcgaagcggttggctacgaggtcgtccagaccgagctcagctgctgtggcgcggccgggagctatgcgttcaaggccgagcatgccgagcgtgcgcggcgtatcgggtcgcgggtcggaccgccggccgagatcgtcggggtcgcggtcgactctgcgacctgcgcgttgcacctgggggacctctggggcgtgcgcgcgacacacccactcgtgtggatcgaggaggcgatgcggccgtgacggagaccccacgtgcgattctcgccatccgcgatcctgagctcgcccaggctacgaccgctgggctcgcgcctgggtgggtgatgctgctcggagggccggccgcgagcgtgatcgatgcctccatgaccctctcgctcgagggctgggtcgtgttcgtccacatcgacatggtgcgcggtctcgggcgcgacgccgacggcctcggggtgctctcgcgcttcggcgcaccccagggcgtgatctcgacgcatccgagcgtggtgcaggcggcacgggatctcgggttcgccacctccctgcggatcttcctggtggactcgggctcgttacgctcggggatccaacaggcacagcgcaccaagccggacttcgtcgagatcctcccgggtgtgctgccgcacctcatcgcgccggtggctcgagcgacggggctcccggtgatccctggtgggctgatcacgactccagcggatgcgtgggcggccatcgaaggcggtgcgctcgcgatctcgacgtcgtcgctcgaggtctatcgggcggtagtggaggcgccggctcccctggcgcacgagaaccacgtgcagcgctcgaggggtcaccgatgagtgacgtcgttcggcgccagctcatcgtcatcgaccccctgggactccatgcacgcgctgccgcggcggtggtcgcggcgctggggccgatcgcgggcgtcgtcatccgagcaggtgagcgtgccgtgcccgccacgagcgtgctggcgctcatgggactcggcatcgaggctggcgacgtgatcgtcatcgagggtcccgtcgaggcagagggagcgatcgcagaggcgctggcgacgatctctgcggtggcccagcccgtcgtcgagggcccgagtgacgacgagggacaccaggggcagtcgtcgtcatcatgaaggccgtgtaacgattcccgcctcgtgcatggattcccttgcgccgaccggacgcgacgagtaaagtagcgccacacgggccgtttcgacgcggaaagcgtgtcggaacggggagcctggatcaggaggggtggccagggtgcaacggtctcgagggcgcgcagctacggtgcgctaccgatgaccaccctgacccgtcgcctcgaggccgagcctggcccacgagccgttcgccgagacggtgcgctggcgcgcttcctcgccaatcgactcgccgtcggcgcgctggtggtgctcgtggcgatcgtcgcgttctgcttcgtcggcccgatcgtgcacccggtgtcggacgcagccaacctgctgcacgccaaccaacctccctccggccagtacctgctcggcacgacaccgaacggccgtgacgtcctcggacgtctcatggtgggaggccagtcgacactcgagctcggggtggccgtcggcgtgctcgcgacgggcttcggtctgctctacggcaccgtcgctggtctcgtgggcggtgtcacggacgcgatcttgatgcgcatcgtcgatgccctgctctcgatcccgttcctcttcttcgtcatcttgctcgcctcgatcgtgcgcccgacgctcggactcatcatcctcgtgatcgccggcgtgagctggctctcgacggcgaggctcgtccgagccgagaccctcaggctccgaaccctcgactacgtcgacgctgcccgtggtttcggagctcccccctggtggatcctcgtgcgccacctcgtgcccaacgtgctcggtgtgctcgtcgtgaacgggaccttgaaggtcgccgatgcgatcctcacctttgcggcgctcggctacctcggcctcggcgtgcccccgcccgcgacgaactggggcgcgttgctctcggcgggcgtgaacaacttcttcgacggctactggtggcagctgtggccagcggccgtgctcatcgtcgtcaccgtgctcgcggtgaacgtgctcggcgacgccctgcgcgacgtcgtggagcggaggctctcgtaagtgggtggaaggagcaaatggtggagggatcgatgatgaggcagctgcgtcggacgaggtggcatcggagcgcggcgtggaccggttcgctggtggcgctaggcatactggcggccgcatgcgggagctcgtcgggggcgtcgacgtcgtcgtcggcggcgaccggactgccggcgaactacgcctcgtttgcgctgcactcgggcgacacgttctcgtgggttctcccactgccgaaccaggccaactacgagccatgggaccagaacgcggagtacgggatgtaccgaccgctctacgtcgctggcaacgggtcctccccgaccatcgacgaggcgacctcgatggccaacccgccgacctacaacgccaccgacacgcaggtcacggtgacgttgaagccgtggaagtggtcggacgggaccccggtgaccgcccgggacgtccagttcttcttcaacatctatcgggccaacaaggcgaacatcgcgacgtacgtgccggggaacttccccgacaacgtcgcctccttcaccgtcgactcgccaacgagcttcacgctcacgctcacgcatccggtcaacccgacgtggttcaccgacaacgagctcaccgacgtggtgccgctgccccagcaggtctgggaccgtacctctcccggtggcaaggtcggcaactacgacgagaccacggcgggtgccgtggcggtcttcaagttcctcacgaagcagtcgaacgatctgtcgacctacgcgacgaaccctctgtggcaggtggtcgatggcccctggaagctccagagctacgacccgaccaccggtcgcacggtcttcgcacgcaacgatgccttcaccgggccggacaagcccaagctcgctgggtatgcactcgagagcttcccgagccagaccgccgaggtgaatgcgctgcgctccggtcagctcacctacggctacttgccgatctccgactacaagctggagtcgagcctgtcgaagagcgggtacaccatcgcaccgtgggtcaccgactacgtccagtgggccgaactcggctacaccagcccgaagtacgggccactcgtcaagcagctctacatccgccaggcgctccagcacctggtcgacgagccgctgtacatgagtcaggccctgcacggctacgggcagttcacctatggaccggtcccgaacatccccggctcaccgtacgtgacggcgacggagcagaccgaccccgacccctacagcaccgcagccgcgaagagcctcctcctcgcccacggctggacgctcgggtcccaaggggtgatggtgtgttcgaaccccgggaccgcggcgaaccaatgcggtgcggggatctcgaagggcgaggccctcaacctcctcttcatgtaccagagcggcaccccgacgctcgcggcccaggtggaggcgttcgcgaccgctgcgaagcaggcgggcgtcggcatctccctcgatccccagacccagagcaccatgttctcgatcggcggcgtgtgcccctcggccggcccgtgcaactggggcatcatcttgtaccggaccttcctgtggaactacggccaaggcgatgtgctcccgacggggggtcagatgttcggcaagggcaactactggggaggcggctacagcgatccgacggcccagtccctgatcgacgagacccacacccaaccagggctgagcgccttgttcgcctacgagaactacatctcgcgccaggtcgcagccctgtggttcccgacgtgggactggcagatctcggtggtctcgaacaagctgcacggctggaacccacagcagatcttcgggaatccgacgccgtcgaggtggtacttctaggcgatgcttgggttcgttgcccgacggcttggccaggcgatcgtcaccatggtggcggtgtcgatcgtcgtgttcgggctgctccatgccttgccaggggggctcgtgcgcgcccagttgggcgcgcacgtctcccaagtcgcgatccgtgcgctcaccgtgcaagaaggcctgaccaagccgctgccggtccagtacctcttgtggctgaagggtgtcctcgaagggcagttgggccagtcgttcaaactgggtgaaccggtgtcgacgttgatcgcgctctatgtcccgaggacgatcctgctcgtcggggtgtcgttgttgctcgcggtcgcgatcgcgatcccgctcggtctgtggcagggctaccgccgtaatcacccggacgaccacgccctcagcgccatcatgctcacgctctactccatgccgacgttcctgctcggggtcgtgctcatcatcgtgctcaactcctggctcggcctgttgccgtcgctggcatcgaacttcggcgcgagcatcggcaccgatgtgcgcgacctgggactgccggtgctgacgctcacgctggcgaacgtgagctacttctcccgctacatgcgctcgtcggtgatcgacaacctgctcgaagattacgtgcggacggcacgctcgaagggtgcctcggagcgtcgagtcctcctgcgccacgtcctgcgtaactcgctgacggcgaccgtgaccatgatcgggctcacgctgccctatacggtgtcgggatcgctcatcgtggaagcgctcttcaacttccccggggctggactcttgttctggaacgcggcccagacgcgcgacttcatggtgctgctcggcatcgtgctcgtgatctcgatcgcgaccatccttggcaatctcctcgctgacctcgcctatggcctgctcgatccgagagtgcgctaccgatgaccaccctgacccgtcgccccgaggcccaggtcggcccgcgagccgttcgccgagacggtgcgctggcgcggttcctcgccaatcgactcgccgtcggtgcactggtggtgctggtggcgatcgtcgcgttctgcttcgtcggtccgatcgtgcacccggtgtcggacgcggccaacctgctgcacgccaaccaggcaccctccggccagtatctgctcggcacgacaccgaacggccgtgacgtcctcggacgtctcatggtgggaggccagtcgacgctcgagctcggggtggccgttggcgtgctcgcgacaggcttcggcctgctctatggcaccgtcgccggtctggtgggtggtgtcacggacgcgatcttgatgcgcatcgtcgatgcgctgctctcgatcccgttcctcttcttcgtcatcttgctcgcctcgatcgtgcgcccgacgctcggactcatcatcctcgtgatcgccggcgtgagctggctctcgacggcgaggctcgtccgagccgagaccctcaggctccgaaccctcgactacgtcgacgctgcccgtggtttcggagctcccccctggtggatcctcgtgcgccacctcgtgcccaacgtgctcggtgtgctcgtcgtgaacgggaccttgaaggtcgccgatgcgatcctcacctttgcggcgctcggctacctcggcctcggcgtgcccccgcccgcgacgaactggggcgcgttgctctcggcgggcgtgaacaacttcttcgacggctactggtggcagctgtggccagcggccgtgctcatcgtcgtcaccgtgctcgcggtgaacgtgctcggcgacgccctgcgcgacgtcgtggagcggaggctctcgtgaccgttcgatcgagcggtggggggacctcggtgcgcaggacgtgggagcgccccgagctcctgcgcgttgccgaaggcgcactcgcgcacgcatcgacgatgccgctctggctcgacgatccggctcgaccggcggcgaccccaccactcgaagggcaggtcacggccgatctcgtgatcgtcggtggtgggctgctcggtctgtggagcgcgctcctggcggccgagcggcgaccagagtgggagatcgtcctcgtcgagggcggtcgcatcgccgctgcggcgtcggggcgcaacgggggcttctgcgaagcgagcctgacccatggactcgccaacggacttgccaggtggcccgatgaactctccgagctcgagcgcctcggcgaggagaaccttgcggccattcgggcggccgccgagcggtatgccgcgaactgcgacctcgtcgattcggggacgatcgacgtcgcgctcgaggactggcagctcgacgagctcgccgagctcgccgaggtggcgccacgctacggccacgacgtcgtcctcctcgagcgcgaggcgctctcggccgaggtacgctcgccgagctatcgcggaggcctgtggacgcgcaaccgcgcactcatgctcaatcctgcacgtcttgcgtggggtctcgaggcggcagtggcggggatgggcgtgcgcatctgcgaggggacgcgcgtcgttgggctgagttccgagggcccgttcgtcgtggtcgagaccggttcgggtgcgagcgtgcgcgcgagtcgggtgatcctcgcgaccaacgcggcggctcccctcgtggcgtcggcgaggtggcggttcgtcccggtgtacgactacgtcgtggcgacgcgaccgctcgcggcgagcgagcgtgccgagatcggttgggagcgacgtcaagggatctcggatgcgggcaatcagttccactactaccacctgagcgaggacggtcggatcgtcttcggaggctacgacgcggtctaccactacggttcggtggcccgccctcgctacgagggacgctcaccgacccacgtacgcctcgtcgcgcacctgtacgcgacgtttccggggctcgagggtgtcgagatcagccacgcctggggtggggcgatcgacacgtcgactcggttcgtcgcgtccgtgcatcgggcctttggcgggcgcgtgcactatgcggtggggttcacgggtcttggtgtcggggcgacgcggctgtacgcatcggtactcgtgggtcgtgcgatcggggagccccacccagcggagcggctccgactcttccgtgagggccccgtaccgtttccgccggagccgctccgctggatcgggatcgagttgacacggcgctcgctcgcctgggcggacgaccacggcggtcggcgcaacgtctggctccgtgcgttggaccgcttcggcgtcgggttcgattcctaggaaggggacctcgtgcaagagctcgtgcaagaggatgtgatcgtgcgggtcgaggggctcacgaccgatctcgtgcgtcacggtggctcggttcgggtgatcgatggcgtgagctatgaggtcgccaggggtgagacgctcgggatcgtgggggagtcgggttcgggcaagaccatctcggcactcagcctgctcggactcttgcctccccagatgcgcgtcgtcgctggctcggcacggctcgagggcgaggaactcatcggtgcgagcccgcggcgcctgcgcgagctccgcggtgcggccatcggcatgatcttccaggacccgctgagctcgctgaacccgtcgaagaccatcgggtggcaggtggccgaaccgttgcgcatccaccagcgtctcggagccgccgcagcgcgccagcgcgcgctcgagctgctcgagctcgtgggcatcccgagcccgaaggagcgcttgaacgactacccgcaccaactctccggcgggatgcgccagcggatcatgatcgccatcgcgctcgcgtgtggaccgaagctcatcgtcgccgacgagcccacgaccgccttggacgtgaccattcaggcccagatcctcggcctcctcggcgaactgcaggaccggctgggtacagccatgttgctcgtcacccacgatctcggggtcatcgcgggtcgtaccgaccgggtgctcgtgatgtacgccggtcgggtcgtcgaggctgcgccgacgcgcaccctgttctcggccatgcgccatccctacacccaggccctcctcgcgtcgatccccgtgatcgggatcgatcggagcgtcccgctgccggcgatcccgggcacaccgccgccgctcggcggagcgggggtgggctgtgcgttcgcgcccaggtgtccgcgtgccgacgagcgctgccgccaagagatgccaccactcgcggtgagcgctggccacgcagtggcctgctggcaccccgtcgacggacccgttcgacggaccaggctcgaggtcgctacctcgcttgcggcggtgccacgtgctatggagccgttggtcgagctggtcgggcttcgcaaggagttcgagatccactccaacgtgacgcggcgccatctggggacggtgcacgcggtggcgggggtcgatctcgtcatcggacgtggtgaaaccgttggcctcgtcggtgaatcgggctgcggcaagacgaccctcggacgtatggtcgtcgggctcgagcgcccgacgggtggtgagctgcgcatcggtggcgtcgacgtggttcgcctccgcggcagcgagcggcgatcgtttcatcggcggatccagctgatgttccaagatccgttcgcatcgctcgatccgcggatgcgcatcgcgagcgcgctcgccgaacctttgcgcgttcaggggctcgatcgtggcgaggagcggctggcgggactgctcgagcgcgtcggcttggcgcgcgaggcgctgtggcgctacccccatgagttctccggcggccagcgccagcgcatcggtctcgcgcgggcgctgacgctcgaccccgagctgatcgtggccgatgagccggtgtcggcgctcgacgtctccattcgctcccagatcctcaatctcatgcgcgagacccagcgcgagcgcggtctcagctatctcgtgatcagccatgatctgtcggtggtgagctacctcgccgatcgcatcggcgtgatgtacctgggccgtctcgtcgaggtcgggccgacggccgcggtgatcgcctcgccagcgcatccctacacgcgcggactgctccgttcggtgccgcttccggatccagaacgtgagtcggcaaagcgtcgtctcggagcggtgatcgaaggcgagctcccgtcggcgttgcgcccaccgacgggctgtgcgtttcaccagcgctgcccatttcgggtggcccgttgcgaggtcgaggcgcccgaggctcgcacgctcgacgatggcagggtggtcgcctgtcatcgcgtcgacgacgtcctcgccgagccgtggtcgctcgaggacgtcggacagatggcgagcgcgctgcgagcgtaggcgtttcgacgtgcgccgcggccaacgagggccacaagagtacgccgacgccggccaggcggtctcgtggctgtgcggaggcggcgtcggagcggttcctcgtagcggcgccagacgatgagcgcgatcgcgagtgccgcggtgaggacgaggaggtcttgccaccacggtccgccgtagtgatacagcgacacggtggcgaggctgcgcatgaccagtcgatggaccatgtagaaggcgaagctcgccgagccgagcgcgaccgctgccgaatgggcgatgaggcgtgagatgcaacctgcctggtgtgcaaagacccacacgacggctccccagacgggaagatagagcgcgctgaagcggagcgactgcggagcgaagggtcccgcgacgacgacgcccacggcccctgcgagggcagcgccctcgaggagtgaccatcgccagcgcgacccgccgctctcggggtgttcggcgaaggcaatggccgcaacaacgccggccagaaagtccgagagtcgggtgatcggaaacacgtagatgacccagctctgccaaccggtgtgaagcggaaccagcacgccgacgagggcgagccaggccgtcgccgcgccgaagaggagccagcttgtcgtgagtcgtggccgagcccactcgacgaggcgggcgacgacggggaagatgaggtagaaggttgcttcgtcgctcaagctccatgcgacgccgtcgaacgagaacgccgcggcgagcgatgggatgaagctctggacgaggaggaggttggcgagtgcgagcccgagccaggagccgatgccaccgtacatcgagggtggcgtcaagaacagcgaccaagcgaaggcgaggacgtagaccggatagatgcgtgcgagccgagagcggtagaagccaagcaccgggtttcgccgaagacgcgtgaagcggccctggtacgcgtaggtcaggatgaagcccgagagcacgaagaagaacgagacaccgacgtagccggtctggtaggtgcgcagccaacctacgtgccaacagaagacggcgagtgctgcgacgaaccggagactggtgagtgggcgtagctgtaccaacagacctcctttggccctcgtgcgccacgtagtggctcaagaccgcgagtggtcgcgtgtcatgacgttcgatgacgtgggtcgggcggttccgaacagcgtagagggctcggtcgttcaggtctgggttgggtcgtagtagctactcggagacgtctgagcgctgacgtacgacggttccggaactactgctcgcctcccgcgtgggcgtcgcgcgaggcaatcgagtcagcgaccgagggcgagatggtggagcgcgatggctgcggcggtcgcgaggttcacggagtcgaccccgttcgcgatcggaatggtgacgagtacgtcggcgtaggcgagagcgctcggtgagagcccgtgtccttcggatccgacgaggagcgcaacgcgcggtcgcggcaggtcgtgctcgccgggcgcgcgtgcgtggcgtggttcgccgatcgcttcggcgagctcgtcgaccgtgacgacaggagtgaggtcgcaggttcgctcggtacgcaggcgttgtgtcgacgccggtggcaccaaggcggcgatgcgaacctgcgaccgtgcaaggagtgccagtgcgctcggccatggtgtcgcgcgcacgagggggagcgtcaagaggtggcccgctgacacccgcaccgatcggcggttgcgtgggtcggccgaggtgggatcgagcaccagggcgcacgctccgaacgcggcggcgttgcgcccgagcgccccgaggttctcctggtcgaccacaccctctgcgacgagcgccgtctcacccggtgcccacagatcgaggaagtcctcgagtgcctgcacgggcgggcgctcggcgtgggcgacgacgccgcggtggagtgcgaagcccaccgtctcggcgatcacccttcgggatgcgacgaggatcgggacccgtcgggcgacggcacgatcgaccacctcggtggcgagtgcaacctggtggtcatcgaggaggacggagtggacggtgagcccggtcccgagcagcgtggtgacggccacgcgaccctcgacgatcacgtcgcgagctcctcggcgttggcgaagcccgttgccgcccttgaggtcgcgatacggctcgagccggtcgtcgtcggggtcgtcgatgcgtacggcgccgatcggcagaggagcagaggcggcgtcgtcgtggttggcgatcatggctcgacgtcgaggagggtgtcgtcggcaccaccggagacgagggtcgaggcgaggatcgtcggagccgagttcctcgagctgagcgcacagagccacccgtcgagttcggtggaggtgcgcaccgcgagcggttgccaacctcgtgcgagcttcgtggcgcgcctcgcgagcaggcgtgcggtcgatcgtgtcgagcgctcgaggaggagggcagcgatctggaggtcgtgggcgcggccgaggtgggtggtgagtgcgagtgctcgccgacggagcctcacgctcgtggcgggggcgatgggtgcaaggagttcggatgcgaggcggaggcggcgtgcgcttcgacgtagcgcatggagctcgtccatcccaggccgttgggcagcacgacgcgctcggcgctgccaggaacgcacgagggcttcgagatcgaccacgcgccgagtgtcgggtgtcgatgtcgggcccgggaggcagacacgggcggcgcgtgcgagttcggggaggcgctcggcgcgcttggtgcgctcggcggcgaggtcgggacgagctggcaggatcgtcgcggcgacgtcgagatcgcgcacgctcgcgagctggttcgcgaggcgagtgagtggagaggcgccgtggcgccccacgctgggggcgggcgcggtgccgatgagcgcttcggcgaccgccgcgcgtcggagtgcggctcgcgcatcgtggacgaggtcgggggtggtgcgccgctccagcgcgatgagcagctcttcgagcgccgcgcgtgtctcggcaagatgcgccgccaccgacggccagacctcgggatcgatgacgacacgggtgcgcatggtcgggcgtcgtcgaacgagtcgtgcgttggtcacgtcgggtcagtgggcgtgcaggatcgttgggtcggcgtcgatcgcggtgacgacgccgagcagatcggcggcgcggaccgccacgggtgtggtgccgtcgtcgtgctccgcgatgccggaggcggcgagggcaaagggaatctcgagtgccctggcgaaggctccgtccgtggtgaggcggtcacccaccatgatcgtcgatgtggcaccgaggtggggtcgcacaagctcgaccatgggccagtcgggcttgccgcagtaggtcggttccaccgaggtcgaagcgacgaggctcgcgacgagcgcgccggttcccgggacgacgagtcgttcgagcgggtaggtcgggtctcggttggtcgcgaggaatcgggcccccgcgcggatcgcgacacaggcctgcgcgagaagatcccatgtgaagcctcggtgccagcccatgacgaccgcgtcgaccttctcggcgtcctcgagggacgtgggcctcacgagcgtgttgccctcggcgacgacgctcgtcagtccttcctcgccgatcgccagcacgcgctggtcactgccgagcgcgagacgtgcggcaagggcggaggtgaggatctcgttggcgtcggcgtcgatcccgagtgagcggagcttcgcgacgtaagcttcgacggtgagagtggagttgttggtgacgaagcgcagatcgtcgccacgatcacgaatgcgcctgatcgctcggtcggagccttcgatgagggtgctcgagcgccacacgacgccgtccaggtcgatgagccagcgcatggtcctccagtcgccaatcgactgccgaagcgtcgcgggtcgctcggcgttggttgggacttggaggctagcatgacctcgtcgacacgagggaggtgctgagcgtggactacgagtcactgctgggcgaggaggcgaagcagctcctcacctacgtcgcgacggggatacccgcatcgagcctgatccaccccggccctcgcgtggtcgacgaggtgttcgcttccagcgaccgtaccaatcgcgtgttggtcgagctcgccaggctctatgggactgggcgccttgcggggactggctacgtctcgatcctccctgtcgaccagggggtcgagcactcggcggcggcgtcgtttgcgccgaatcccacctacttcgatccgcagcgtatcgtcgagctcgcgatcgagggggggtgctctgccgttacgacgacgctgggtgcgctcgggatcgtgtcgcggcgctacgcccaccgcattccgttcatcctcaagctgaaccacaacgagttgctcacctatccgagccgttacgaccaggtcatgttcgccaacgtgcgccaggcctgggacatgggtgcggctggggtcggcgccacggtctacttcggctcacccgagtcgacgcgtcagatccaggaggtatcggcggcgttccacgaggcacacgagctcgggatgttcacggtcttgtggtgctacctgcgcaaccccgcgttctcgaccccagacggagacctgcatacggcggccgatctcaccgcgcaggccaatcacctcggcgtgaccatcgaggccgacctcgtcaagcagaagcttccgacgaccaatggcggcttcgtgaagctcggctttgggcgcaccgatcctcgtgtctacgagcgctacgcgaccgatcatcccatcgaactcactcgttggcaggtcgtgaactcgtatgcaggcaggatcggcctgatcaactctggcggcgagtcgcacggcgcgagcgatcttgctgaggccgtccggaccgcgatcatcaacaagcgtgctggaggtgtcggcctcatctcggggcgcaaggcgttccaacggccgttcgaggaaggcgtggcgttgctgcacgcgatccaggacgtctacctcgatcctgcggtcgaactcgcgtgagcgtgtcgcggcgcgcgcctcaggccagcgccgcgagccgttctgcgacgtcgtagagcgacggatcgacctgggcgatcgcgcgaaaggcatctcgtgcctctgcgtagcgtccttgtcgctcgagcagggtcgcgagctggtagcgcagtcggagggcccggagcgacgtggtctgtcgctcgcgttcgagtgcccgacggatgacgtccaccgccgtgctgaggcggtcggtgtccgcgaggtggcttgcccacacgatacgcccctcgaccatggcgtccttcgacgggctcgcttcgcggagcgcgcgccaccaatgctcgacggcctcagcgtcgccttcggctcgagcacagtccatgaggatcgctccgtgcgtcagatcgccggtgaggtcaacgaaggtggcgagatggcgtgcagctcgagcgaaatctcccaagcggtagcgcacgagaccgagcagttcttcgatggggggcgacgcaggcgcgaggcgctcgatgcgtgtgaggatgcgaagcgcctcggcgtagcgatcctcggcatagtgctgtgctgcctcggcgagctgacgctcgacgactggccggagccgaggcggcgccgtcagctcgctgggctcgatcgcgacgggctctcctggcttcgcgcgtcgccggttcggcctcgtcggggcgaggtagcgctgtcggcgcgggctcgtggtgtcgaagcgcacctcgggcaggcgcccgctggtgcgcgagggctgcggctgcttggaggactgccctgccgtgcgagcaggacggtgggcgccatcagagcgacgctcacgcgcctcgccctcggggcgacgtcccccgccaccacgacgcgggccctcccaggaaccctctcgacgggacggccgacggtcgtcgtcgaagcgacgctcacgcgcctcgccctcggggcgacgtcccccgccaccacgacgcgggccctcccaggaaccctctcgacgggacggccgacggtcgtcgtcgaagcgacgctcacgcgcctcgccctcggggcgacgtcccccgccaccacgacgcgggccctcccaggacccctcgcgacgggacggccgacggtcgtcgtcgaagcgacgctcacgcgcctcgccctcggggcgacgtcccccgccaccacgacgcgggccctcccaggaaccctctcgacgggacggccgacggtcgtcgtcgaagcgacgctcacgcgcctcgccctcggggcgacgttgcccgccaccacgacgcgggccctcccagcggttggcagaggtgccgtttccggagcgatccgagctgcgttgccccgcggctcgggcccgagactgagggttgcgctgcccgtcgcgttcgcgtgctcgagtgtcgggacgggggcgctgtgtcggggtttgtcgatcagactgggaaggatcgtggcgttgaggtcgtgcgggcatgcgtaagggcttcttcctggcgatggagtgtgacgggtgcttcagtctacgtgccgattgcggcggcgttcgcggagagacgggagtccgctgccgacagcggccctcggcgacacgagagtagcggtcgctctgcgctcaccggtggcggtcgagggtggtcacggtgctgtgcgaaggcgcggtcacctcggcgaccctggcgcccatgttgagcatctcatccccggccagcctttggagaatctgccgcgtgtggtgcttcgagcgtcgtgggtgctcgctcccgcgtgtgcatcgtcctcgagatcctcgccgagcgagtggtcgcgtcttggaggtcggccgcaggcgagcgtcgcctccggtcggtcggtccgatcagcacctcggggcaggagaggaccggtctcgcagccctcgggatgggttgggtgtccgtcggcatgcggtcgtccctcgtgccggcgaccagggtcaccctcgctagggtcgtctgtcgagggtgcggtcggtgacgggcagtgccatggtggctcgcgagcaggatggtccgtgagcgggagcatccgcggctgcgtgcacgtgcttggcgcgctcgattgcgaggcgtgctttggcaaccccgacacgcacacgatctcgtgcgaacgcgctgcgtgccagcgcgggcgatggctggaacagagtcagttgccctgggtgctgtcgtgccatgaccctctgcttagaccgagggtcggacggcctccatctcgctggcgttgacggcatcgatgagttggcgcaggcgtccgaacgagcgccggtcgaagcggagggcgaggcgcgggagatccggatggtcgtgctctcgcacctcccacggcgtcgcgcggacgcttcggatgcgaccgtcggtggtgatgtcgccgaaggcgacctcgaggtcggcgacgcgcgcgggggagagtctcccgttcagtctgaggatgaggtctcggccgacgacgcggagcgagtggaagactcgatagaagccgaacacctcggccagggcgtcgtcgatgtcgtccgagcggtgaagcagcgtgagatcgtcgcggtcggcaagcccccggtcgacgatgcgatcgttgagcagctgccacacgccgtcccagtagtgggatccagcgggctcgagcaggatcagaggggcgatctgcgtcttgcctgtctgcatgagcgtgaggagctcgaacgtctcgtccaaggtgccgagcccgccggggagggagatgaaggcatcggactcgcgcaccatgagtaccttgcgagtgaagaagtacttcatctccaacagtcggccgtgttcggcgagttcgtgatcgcctggttgttcgaggggaaggcggatgttgatcccgaaggcgtgatgaggtcctgcgccgcgcgccgccgcctccatgatgcctgggccgcccccggtgatgaccatccagccagcctgagcaaggcgggcgccgagcgtctcggcgagctggtagctcggctcgtcagggtgggtgcgagccgagccgaagaccgtcaccttgcgctgggttcgaaacgggccgaacgtctcgaatgcgctccggagttcgcggagcgctgaggtcagcatcttgaggtcgagtcggtcgaggggcgcttcggtggccgcgagcgcctcatcgaggaggagctgcttgaggtcactgtcacgtcccgcgaccgccggtacctggttgcggtggtggtcggatgtcatgagtgcgtgctcgcgatcgtgacgtccatcaggtgctcgtagaacgtcgttcgttggacgaggtggcggcctcgctgcgctgcgatcgcaccaagctcggcgacggtgagctcgctcgcgtgtgccgccccggctgcgtgcgaaatcgactcctccatgagcgtcccgccgaggtcgttcgcgccggcgtcgaggaggagcacggctccggcaggccccatcttcacccagctggcctggacgttgtcgataacaccgtggtaggcgatgcgccccaccgcgtggaggaggacggcctctcggagcgtcggaccccggcgggcacggccagcgaggaagatcggtgcgcccatgtggacgaaggggagaggcacgaactcggtaaaccctcgtgtgcgcgtaccgagcgcccgggtgcgcatgaggtgccgtgcggtgtgcgtggtcgtctcgaccgtcccgaacatgatcgtcacgttcgatcgcaagccgaccgcgtgtgcggtctcgtggacctcgagccactggtcggtggtcagcttctcggggcagatcaccgcacgtacctcgtcatcgaggatctcggcggccgttccgggcaggcttcgcacaccgcgggcggcgagctcgctgaggtaacggtcgaggggccagccgagtcgtcggctcccctcgaagacctcgagtgccgagaacgcgtggatgtgcatggccgggaagcgttcgtggatggcttcggcgatgtcgaggtacgtgccgccgtcgaagcgaggatggataccgccctggaggcagacctcggtcgcaccacgggcggctgcctcggcaaccttggcgaggatctgctccatcgacaggagatagggtgcgccacggagcgccaaggagcgcgggccgcgcgagaaggcgcagaacccgcagccgaaggtgcactggttggtgtagttgatgttccggttctgaacgaaggtgacgacgtcgccgttcgtctcgcgccgcagcgcatcggcgaggtcgatgaccgcctgtgcgtcggttccgcgcgcactgagggcgtgctcgagcagctcgagcgagggaccctctcccgatcgtgacgccgcttcgagctcgtcgaaccaaccggccggagctcgtcggctgacggtcaccacgcgcggggggaggggacctggtcgaccggagaaccactggtgctcgcgtgcgaagccatcgcgatccatggacgcgcgcactgcgggtcggagcgcgtcgtcgacggcgtcgtcacgtcgcgcgtactcggggtagagcgcgaggcgcggcacgaggtcgcggcctgcctcggcgaggcgacgctcgaggagctcgatctcgggccacgggcgttcggggttgacgtgatcgggggtgacccgcgagatgccgccgagatcgtcgatgcccgccgagaggagcccctcgatgtcgtccgagaggttcgggggtgcctgaacatggacggtcggtgggagcacgagacgcgcgagtgcgatggtacgcagatgggcctcgtgatcggcgggcggggcgtgccgcagtcgagtaccaggttttgggaggaagttctggacgatcacctcttggaggaagccggtctcctcggcgatggcggcgagggcttcgagtgcacggaggcgatcggcttcgctgtcaccgatgcccacgaggatgccgctggtcgtcggcacgtgctggagtgccatcgcacgtaccgttgcgaggcgcagatccggatccttgtcgggtgcgttgcggtggaccgggaggtccggtcggatggactcgagcatcgtgcccatcgagacggcgtgcggtcgtagcgacgcgacctcttcgggcgtgagcgtcccgggattgaggtgagggaggagtccctcggcgatcgcgacgtcagccgcggtgcggaggtagtccagggtggttgcagcgcccagcgaacgcagtgcatcgcgtgcgctggaccatcggagctcagggcgctcgccaagggtgaagagcgcctccgcagcgcccaccgccgcccccttgcgagccaacgcgcggacctcgtcgaggctcaggaaggcagatccgagtcgggcgggcacggtggcgaaggtgcagtagtcgcagcgatcgcggcacagacgcgtcaacgggatgaacaccttcggggagtaggtgatcctcggcccgaaggttcgatcgcgccgacgagcagcttcggcgagcagtcggttggtggaccactcgagcagcgccttggtcatggggtcaccctagccatcatggctgacgatcgagggatcgagcgcgctcgccgcggcagagtcgaggagccagatcgtgtcgtcgcgggtgacgtgcacgacggggaggtcggcaccgccgagcgccgctgcgacgatggttgccttggaggctccgagcgccacgatcacctgagtctcgaagcgcgcgagagcatcgcgtgtcagcgagaggcgccagtggcggttgtgtccgctcggatcgtgattgggtgtgacgaggcctgaggcatcgagacctggggagcccgggaacaggctggcggtgtggccgtcggccccgatccccagatggacgagcccccaggtgggacgcgactcgagctgcgcgccgtagcgggcagcgagcctgtcggcgagcttcggcactgtggccgggtcctccgtggcgagggttgcgaggtccgcgggcgtcagtgcatcggcatccaccatcggcaagagggccggaccgcgtccggtcaggaccgggccgaggtgtgtccagttcgcttcgggcgagccgggctcgacgagcctctcgtcgacctgcgcgatcgtgccggtgcgtgggaggctcggcccgagtgcgtccaagagggcgaggatcgtcgatccgccggagagcgcgaccaaggtgtcgcgttcgagcgcgtcgtggatgagtgccgcaaagcgcgttggcacgtcgttgctgacgatgacgcgagccatcgaacctcctcgtccggtcgccttccctgctagggtaggcgacgcggtggctgcggtcgcaggcagcacaaggacatcgaccgcgcgagcagctaggggagcagggtggatgcgcgaggcagatgaggttcgagacgtcctccgggtcgtcgggcgttacctcaagcaagagaccgtcgatccgttccgcgcgatcggtgccatggtcgtgtggggcctcgttgggtctgtgctcgctgccggcggcttcgtgctggcggggatcggactgttgcggctgctccagaccgagacgggaacgaccttcgccggccatctggactggctcccgtacgtgatcgtggtcgtggtgctcgcagttgtggtggcgatcgcggcagcgcgcattgggcgccgggcgaaggcgtaaggcgggaggacacatggcaaccgaaggccgggtaacgctcagcgacgtcgaggagcgcattcgctcgctgactgagcaggcgtctcgctccgccagtgcggtgcggcctgcggtccctggcgtcgccgggatcgcggtcgccgcggtcgtggtcgtcgcgttcgtgctcggttaccggcggggtcgtcgttcgagcgtcctcgagatcactcgcctgtgatggctgcatcccggcgcgtgctgcggtcgcttcgacgacagcgttcccgcctcgtcggtaccgtgctggggctcggcgggccagtggcgggcgtggtgtggggcatcgtcgcgctgcgttggatcgatcgacgcctgggtcggcgtacgagaacggcgcgcatcgatctctcccgtggcccggtgaccttgcgactgcgcgagcgtcggtgagcggggcattccaggtcggcgattcggtcttgctggtcgaccatcgcggtcgcgagaccgtggccgaactcaccgaggccggcgtcgtgcgcacggccgtgggtgaggtcgcgatgggtgatctcgtcggtcacgagccgggtgaggcggtcgtgacctcgaagggcaagcggatcctcgccgtacgtccgacgctcgccgagacggtggtccacatgccccggggcgcacagatcatctacccaaaggacgcgctggccatcctcggcgcgctcgatgtcgcccctggtcagcgggtcctcgagtgcggtgtcgggtctgggggcctgacggtctggctcgctcggctcggtgcgtcggtcgtggcggtggagcgcaggcccgattttgctcgacgtgctgagaagaacgtggcgcatctcggaggctcggagcgggtctcgatcatcgttggcgaactcgccgacgtggctccgccggggccctacgaccgggttgtgttggacatggtccatccgtgggaggtcatcccctggatcggggcagaactcgcccctgggggtcgcatcgtcgcctacgtgaccaacgcgctccagattcacgagacggtggaggcgctcgaggcgagcggctacgtccgcatcgaggtccgggagctcctcgagcgtcgttgggtggcacggggcgagatcgttcggccggagctgcggatggtggcacacaccggcttcatcgtgtcggctcacatcacgcctcgagcgcgtcggttggccgctgaacggccgcgcgagatcagcgtgtcgggtgtcgtcgatgacggctcgctcgacgagagcgcggacggcgacgtcgacgacgagctcatccaaacggaggaccgaccctaggactcacatcctcgtcggcgcgttctctgcgcagtctcaggcatgtcgtgaggggccggcgagtcgtgccgacgcgagcggccagacgggtcgtacgctgggtcgaccctgacggtgggtggagcaacccttggcccgaacgtcgacctcgacgagttcgttcgtctctcggcccgtatccgtcccgtatccgcgctgccggggaccgcgttcgccgcggggggcgaaggttgcgagttgtcggggttcagtccgcctcgatgaagatgcactcgccggggcactcttcgctggcctcggtcacggcgtcttcgagctcgaccggaaccgaggccatctgggcagagcccccagggttgttcaggacctcgccgttgtccttgacgtaggcgaggccgtcgtcgaggagcgtgaagacgggagggcagatctcctcgcagaggccatcgcccgtgcagagatcctggtcgatccacaccttcatcgaaaccctccatcgattgacgtcgcccacttgagactagtgggtactcacccagggaatcacgggagcgcgggaccgttgacggtgtcatggtgtcgtgcccatgcggtagtgtcgcggtggagggaggttagccatgccacgcgatgagaccccggaacgtgagcacgctgagcagcagtcccgccaagcgctcgaggaggaggtgcgcgaactccgccgacgtgtcgaggaggcaccgagtcgagttcgtgccctggaggagaagctcctcgaggtgtcgggagcgttggctcagacccaggcgaagaacgagaagctgaccttcacgctgcagcaggcacgagagcacatccagaacctgagggaagaggtcgagaagctgacgcagcccccgtctgcgtacggcgtctacctggcggccaaccaggatggtacggcggatgtcttcaccacgggccgcaagatgcgcgtggccgtgcaccccgagatcgacctggcagcggttcgcgtcggtcaggaagtcgtcctcaacgagtcgttcgccatcgtgtcggtgcgggggagcgacgtgatcggagaggtggcgacggtcaaggatgtgctcgacgacgggagtcgtgtgatcctgctcggacgggcggacgaggagcgggtggcgcaggtcgctggtcatctgcagcacccgccgctgcgcgtcggtgattcggtcatggtggatccgcgttcggcgatggtgctcgagcgactgccacggcccgaggtcagcgaactcgcgctcgaagaggtccctgacatcacctatcacgacatcggtgggctcgatcggcagatcgaggagatccaggacgccgtcgagttgccgttcctctaccgcgagctgttcggcgactatcggctccccgcccccaagggcatcctcctctatggccccccagggtgcggcaagacgctgatcgccaaggcggtcgccaactcgctcgccaagaaggtcgagcaggtctcgggccggagcgtgcgaagctacttcttgaacgtgaagggtcccgagctcctcaacaagtacgtcggtgagaccgagcgccagatccggttgatcttccaacgcgcacgcgagaaggccgaggaaggcgttccggtcatcgtgttcttcgacgagatggactcgctgtttcgcacacgaggctccggcatcagctccgacatggagtcgacggtggttccccagctgctcgcggagatcgacggcgtcgaagccttgcgcaacgtgatcgtgatcggcgcgtccaaccgagaggatctcatcgatccggcgatcttgcgcccgggtcgtctcgacgtgaagatcaagatcgagcggcccgacgagcaggccgcacgcgagatcttcgcgcgctatctcacgccggaggtcccgatcgatgcgggcgaggtcacgaccctcggcggtggcgatgcggagaaggccatcgcggtgatgatcgagcggaccgtcgagcgcatgtacgccacatcggacgagaaccgcttcctcgaggtcacctaccagaacggcgagaaggagatcctctacttcaaggacttctcgtcgggtgcgatgatcgagaacatcgtgcgacgggcgaagaagctcgccatcaagcgcgagatcgcgggcgggtcgcggggcatctgcctcgatgacctcctcgcctccatcgcgaaggagttcaaggagcacgaggatctccccaacacgaccaatcccgatgactgggcgaagatctccgggcgcaagggcgagcggatcgtgttcatgcggatcctcctccacgaggaggagggacagacgggtgggcgcgccatcgagcgcgtcgcgaccggtcagtacctgtaggtaccgagtagggaggtgcgatggcggtcgcaaaggttctcggcatcgaaaccgagtacggcatcaccgtgccgggggtgccggaggcgaaccccatcaccgcctcctcgagtctgatcaacggctaccttgcccagctcgccgggaggacgagctgggacttcgttgacgagtcgcctggccaagacgcgaggggcttcagcgtggataccggcggcaacatcgagctcgagacgcacctcgtcaacgcggtcctcacgaacggggctcgcctctacgtcgatcatgcgcacccggagtattcctcgccggagtgtcgcacaccgcgggaggcgaccctctacgacaaggctggcgaggaggtgatgcggcgagcaatggctggtgtcgccgcactgaaccctcatggaccagcgatcgtggtctacaagaacaactccgatcgcaagggcaactcctacggttgccacgagaactacctgatggatcgtcaggttccgttcggtcggatcgtcacggagctggtcccgttcttcgtgacgcgccagatcgtggtcggggccggcaaggtcgggtccgaagccccgggggtgtcgatccgcgaggttcccttccagctctcccagcgggccgacttcttcgaggaagaggtcgggctcgagaccacgctgaagcgtccgatcatcaacacgcgcgacgagccacactcggactcgcagcgcttccgacgtttgcacgtgatcctcggggacgcgaacctcagcgaggtggccacgtggctcaagctcgggaccacggccatggtgctcgccatgatcgaggacggtgagctcgaggacctcgggatctccatcgtcgacccggttggctccctacggcgcctgtcgtgggaccccacgctcaaggccaccgtgacgttggccgatgggcgcaccatgcgtggtctcgacgtgcagtgggcctatcgagagcgcgcagagcgctggctcgatcgcttcggcggcgaggccctcggtggcgatgacgaggcccacgcgatcctcgaggagtggacggatgtcctcggcacactcgagcgcgaccccatgagtcttgccgatcgtctcgattgggtcgcgaagtggtccctcgtgcagggctacatggagcgacaccacctcgatatcactgatgccaggatcgccgcgctggatctgcagtaccacgatgtccgcccggagcgatcgctgcagcgccgtcttcgcatgcgaagactgacgaccgacgaggaggtcgcgcgcgcgacgacggagccgccgccgagcactcgggcctactttcgcggtcggtgcctcgcgcggtttccgtcccaggtcgcagccgcgaactgggactcgatgatcttcgacgtcggcagcgatccgcttcgacgcgtgccgatgatggatccactgcgagggacgaaggaactcgtcggaacgctcctcgagtcggtgggctcggtggacgagctactcgaggcgcttggggcctaacatacctagtgaggtgatcatcgtggctgagcgcgaacaggtcagacggagtgggacggagcgcgaggaggaggccgaagaggtctcgacgcagagcgcggcgagctctgacaagctcaaggccgagatcgacgacatcctcgacgagatcgatgaggtgctcgaggacaacgccgaggagttcgtccgcaactacgtccaaaagggtggcgagtagcggtcgggtgaactgacgggctcgagggccgacgacggtcggcctgagcacggggccgacgacggtcggcctgagcatgaggaaggatggagcaaggttggcgttaccgctctttgaccctcggcacgacccggggccggattttgccgcactcgtctcgcgggacgcggctcgcaccgtgccgacgtcgggcgatggttcgctcggcgctcaggtgccgcacgggaccaccatcgcggcactgcgctttgccggcggcgtcgtgatcgctggcgaccgtcgcgcgaccgaggggaacttcatcgccaatcgtaccatcgagaaggtcttcccggccgatcgcttctcgggcgtcgggatcgccggtgccgcgggtccggccgtcgagatggtgcggatcttccaagtgcaactcgagcactacgagaaggtcgagggcaaggcgctctcgctcgagggcaaggccaatcagctcgcccagatgatccgccagaacctcccgctcgcgatgcagggcctcgtggtgatgccgttgttcgcgggctgggacgcagagcgcagcgagggtcggatcttcaccttcgacgtcgcggggggccgctacgaggaggtcgcctactacgcgatcgggtcggggggtcgtgatgctcgcgcgaccttgaagctcggatggcggcccggcctcgacgaggcaggggctgtccaccttgcggtccaggcgctgtacgaagcagcccaggaggacgccgcgaccggtggacccgatgcgctgcggggcatcttcccggtggtcgcggtgatcgaccgcgagggttaccggcgcatcgacgacgctcgcctcgaggagatcgcggtcgaactcgaccaggccgtgagggagcgaggtgcgcggcgatgagcatgccgttctacgtcgcgcccgaacagctcatgaaggatcgggcggactatgcccgcaagggcatcgctcggggacgagcgctgatcggcgccgtctgggaaggtggcatcattatcgtcgccgagaacccgtccagatcgctgcacaagctgtcggagatctacgatcgcatcgccttcggcggcgtcggcaagtacaacgagttcgaccagctccgcgtcgctgggattcgtcacgccgacctcaagggctacgcctatgcacgagaggacgtcgacgctcgcagtctcgccaatctctacgcgcagtaccttggcacggtgttcacgcacgagatgaagccgctcgaggtcgagatcctcgtggcggagctcggcaacggacatcgggagtcgcagctgttccagatcctctacgacggcaccgtgatggacgagcgcgagttcgctgtgctcgggggcgatgccgacgcgatcgcggagcgcttccgtgcgctctacgacgcgagtggtccgagggagcggctgctccagagcgcgcgagacgcgctcagtgggcaacgtcctccgatcggggccgacgatctcgaggtcgtggtgctcgaggatcgaggcgagcgtcgctgcttccgacgcctcgaggtcgacgaggtgcgcgaggcgctgggcgatcagccggaggggagtgcctgagtgccccgcttggcacggcggatctacggcatcgagaacgagtacggcatcacctgcacccagcgtggccagcgtcgcctgagtcccgacgaggttgctcgctacctgttccggcgcgtcgtgagctggggccgctcctcgaacgtgttcctcgagaacggcgcgcggttgtacctggacgtcggcagccacccggagtacgcgaccccagagtgcgactccctgagcgatctcgtcgcccatgacaaggcgggggagcggatcctcgagtccttggcccattctgccgaggccaagatgcgcgaagagggcatccgcggtgacgtcttcttgttgaagaacaacaccgattcggccggcaactcctacggctgtcacgagaactacctcacggtccgcgtcgacgacctgacccggctcgtcgaggtcctgatcccgttcctcgtgtcgcgtcagatcatcgccggcgcgggcaaggtgctgctcacctcgcgcggtccgctctatgcggtctcgcagcgagccgagcacatctgggagggcgtgtcctcggcgacgacgcggtcacgtccgatcatcaacacgcgcgacgagccgcacgcagatgccgagcgctatcgacggctgcacgtgatcgtcggggactcgaacatgtcgcagtgggcgacctacctcaaggtcggagccatggcgatcgtgctgcgtcttctcgaagaggaggtcgtcctccgcgatctcacgctcgagaatcccattcgggccatccgagagatcgcccacgacaccgaactcgagcgcacggttcggctcgtcaacggtcgcgaactcacagggctcgagatccaagaggcctacttcgagcgggcggagcgctaccacgagcggatcggtctgcctgcggacgaggcgcgcgcactcgacatgtggcgcgaggcgctgaaggcgctgcgcgcgaacgatcacgaggcgctctttggcaaggtggactgggtcaccaagctcaccttgatcgaggcctttcgggcgcgtcatcagctcccgctgtcgcatccgcaggtgtcgctgctggacctgcagtatcacgacatcagccgcgagcgaggcctctttgctcggctcgaggccaagggtcgggttccgcggatcgtcgacgacgagaccatcgagcgtgccgtcgacgaacctccggcgacgacgcgggcggcgctgcgggggcgcttcattcgtgcagcgaaggaggcgcaccgcgactacacggtcgactgggtgcacctcaagctgaacgaccaggcgcagcgaacggtgatgctgaaggatccgttcgcgtccgaggacgagcgcgtggatcggttgctgacctcgatctgatggctcgccgtcgccgagcgggctggctcgcactggcgctcctcgtcgtggcggccgtgctggcggtgcgcgcatgggtgctcacgccgttcgtcgtccccaccggttcgatgcgaccgaccatccgtcccgggtcgtggatcctcgtcgatcgactcgccttcgacacacaccccatcgaggtcggtgacgtcgtggtgcttcggcgaccggccgacgatccgggggaggcgaactcggactacctcgtcaagcgggtgatcggcctgcccggtcagacgatcgccagccgcggggggcacgtcgtggtcgacggacgggtcctcgcggagccctatctgcctcgcggcgatcggacggagggcatcgtgccccagacgatcccgcggggcgaatacttcgtgctcggtgacgatcgcggcgattcggtggattcgcgcatctttggacccgtgccagcctccagcatcgtgggcgaggtcgtcgcggtggtatggccgccgagccaagcacacgtcgttcggtcgtagctgtgcccgggcgtcaggcgttcccgcgttcgccggcgatgcccttgcgaaggaagtccacccaaccgggcgtctcgagggcgtcgcgcagcgatgccgcatcgtgttcgtcgagtggggggccgtcgtggtgttcggagagctcctcgggcagccgccagaactgcagccgtacgccggctgcgaccagcacctcgacgatgcgccgttcgaccggtttggcgacgatgaacccgcagctcggacagcggaacgtgtacgaggcttcgccgttcgaggagcagagcatgatcttgacacgcccgggcgcgacctcgacgtccccgcactctgggcacgaggccttgatgatcggcatgggcgactcccttcgcaaccgcgcgtccgtgacagagggtctatcggcacgcgcggcgccggtgttgagtgctgcggccgtcgacctcgacgcgactccaagagaatgtgccgtgtgcaggtagactcacgccggtgacgcagtctctgcgagcgaaccgtgtgctctcgggcgtgcagcccaccggcgtgggtcatctcggcacgctgctgggtgcgttcatgaactttctcgccgaccaggagcgggcggagtgcatcttcctcgtcgcggatctgcacagcctcaccgtcgaccaggaccctgcggcgcttcggcgccagcgttacgagctggtggcgaccttccttgcggtgggcatcgaccctttgaagtcgaccatcgtgatgcagagtgaggtgcccgagcatgccgaactcgcctgggtgatggagtcgaccgcgacctatggcgagctcgcacggatgacgcagttcaaggacaagtccgctcgccagacgaaggtgcgcgcgtcgctgttcacctaccccgcgctgatggcggcggacatcttgctctatcaggccgatgtcgtgccggtgggcgaggaccagctccagcatctcgagctgacgcggaccctcgccgagcgcttcaacggcgcctatggcccgaccttcacggttccgaagggtcagcttccgacccatgccgcacgcgtgatggacctcgccgagccgacgtcgaagatgagcaagtcctcctcctcgcaagcgggcatcgtgttcctgaccgacgacgacgcgacgattcggcgcaagttcctccgcgctcgtacggattcgttcgccgaggtcgtctggaagccagacgacccgtcccgtgccggtgtgaccaacctcgtcgagatcctcgccgcgctcgagggcaccgacgcatccagcgtcgctgctcgcttcgatcgctacggaccgttgaaggaagcggtcgcggaggcggcggtggccgccatcgccccggtgagagagcgcttcatggccctgcgcgacgacgaggcgaccctgcggggcgtgctcgaccaggggcgtgagcgcgcccgggacatcgcccgcacgacgatggccgtggtgcgcgatcgcctgggcctgacctgacgaggcgtggagggaccagcgtggatccggccaaggtgctgttcatcgccgtcgcggcgctcatcgtgctcgggcccgagcgcctaccggcggtcgcgcggcgtgcgggcgagctgtggtcgctcgcacggtcgccgacggagtgggtcgcgaagcatctcggcgaggtcgcgcacgcagccgggatccccgaggacgtgctgcgcatcggtttgccaggaggcctggatcgctggctgatggcttcgggccccgccacgagtgcgtcggcccaaggccccgcggctccggcgtcgccccctcctggccaggcctcctcggcgacgccgacgggcgccgcatcgatcgtggcgggaccctgggagctgaactagtggcgctgcggcggccacgacggcgccgtctcgaccccaacgcgatgaccaccgtggagcacctgcgggagctgcgacgtcgcctgattcgcgccatcgtcgcggtcaccatcggcgccatcgcggcctatgcggtctacccgcacctgttgtcggtcctgaccgaaccgttgtgtacggtcgagcacgaaccgcactgcgtgctgtacgtgaccggaccgatcgatgggttcgcgatccgtctcaaggtggccgcggtggcggggctgttcctcgcctccccgatcgtgctctgggagctgtggcgcttcgtcgctcccggcctcaagcggggcgagcgacgcctgacgctggggtttctcgtgtcgtcggtcgcgctgttcgtggcgggcggcgtggtggcgtggttggtctatccacgcgccctcgggttcttccagtcggccgcgggcgcccaggtgcacgcgatctacacgccgcagagctacctgtcgctgttgctgatcctcatgatcgccttcggcgtcgccttcttgttcccggtcgtgctggtcggcctcgaactcgctggcgtggtgagtccggccgcgttgcggcggcaccggcgtcccgcgtggctcgggatcatcgtggtggtggcgatcctcatccccagtaacgatccctactccttgaccgcgatgacggtgccgctcctcgtgttctacgagctgtcgatcgtggtcggttcggcgctcaccaagcggcgggcacgcgtcgccgacgccggaggctaagctcgtcctcgacggggaggctccgctggtatctaccttccgcagccgattcgccgaaacgctcggcttggtcatggatcggttccaggacgaggccctcgaggcgctcgacgaagggtcttccgtcctcgtcagcgctcccaccggttccggcaagaccatcgtcgcgctctatggcatggcccaggcccttcgacagggacggcgagccttctacacgtccccgctcaaggcgctgtccaaccagaagtaccacgagctcgcccgtttcttcggtcctcagcacgtcgggttgctcactggggacaccacgctgaacccggacgcgcctgccgtcgtgatgacgaccgaggtgctgcggaacatgatctacgcctcgccagccgcgatcgacgacgtcgacgtcgtggtgctcgacgaggtccactacctccagaacccgtaccggggatcggtgtgggaggaggtcatcatccacttgccgcgccgcgtccgcctcgtctcgttgtcggcgacggtgtcgaacgtggcggagttcgctggctggttggccgccgttcgaggtacgacgcgcgtcgtggaggcgacccaccgccccgtcccgctcgagcatcgctacctctacacgccgcggcgttcggagacgccggtcgcgataccggtcctcgtcggtgggagggagaacccccagggggcacagctcgatccaccctggctcgcgcgcagtcgttaccgagacgggcttcgggctcggacggtccatcggatcgagctcgtcgagttcctcgctcacgagggcgatctgcctgccatcgtgttcatcttctcccgtgctgggtgcgagcgcgcccgcgatgaggtggtcgcctccggcattcgactcaccaccgcggccgagcgggtcgcgatcaggcgcatcgtcgacgagcgtctcgacgggttggccgagcgcgacctcgcggccgtcgggttcgcgccgttcctcgcgggactcgaggcgggcatcgcgccccaccacgcgggcatgatcccgccgtttcgcgaggtcgtcgaggcgtgcttcgagcgcgcgctcgtcaaggtggtgttcgcgaccgagacgctctcgctggggatcaacatgccggcccgatcggtcgtcatcgagcgcctggtcaagttcgacggggagtcccaccagctgctcaagcccggcgaatacacgcagttcgctggacgggcagggcgtcgggggatcgacgagcgcggcaccagctacgtcgtgtggggtccgcaggtcgccttcagcgacgtcgcgcacgtcgtccgggcggacttctacccgatcacgagttcgttccgtcccacctacaacatggcggcgaacctcgtgaagcgctacacgcccgagcgcgcagctgagctgctcgatctctcattcgcgcagtaccagcgagacgccgaggtcgtccggcgccaggcgcggttgcgagcaggcaacgaggatgtcgtcgcggcgacgacgcagccggagcgcgctgagtggatcgagccgggtcgggtggtgagcgtcccgagcgagcgcggcggtgccgagcgagcgctgctgctcatcacgcgggtgtcccagcggcgcggtggcgggcttcggatcagtgcgtcctcggagtcgggcagggtgtatcgcctcgacgaggggcacgtcgcctcgatgcgacccaagggcaaggtgcgcctccgtgcggtgcacggctcccgggaccaggggatcgccatggcctgggcacggatccgggcgcggcgtcagcaggcgcgggagctcggcgaaccgtcgaaggcattcctcgacgagcgtgcgcgtggtcgtcgcaccgacgcgccagcgccgtcgccccgttcgcgtgagttgctctcggaacagctcgagcgtgtgcgcacggtgctcgagcgcttcggcttcgccgaggggtggagcctgacgcagcgaggcgagcgactgacgaaggtctacgtcgagacggacctcgcggtcgtcaggttcctccacgacgccgagatcgacggcgtcggcccggcggagttcgccgcgatcgcctcgtggttcgtgttcgaaccacgacctcattcgccccgatccggtccgtggccagcgagcgcggccatggcgcggctctacgagcgggccgaggcgctcatgcaggagcagtgggcggcggagtcgtcgctcagactgcctcgatcgcgcggtccagagcccgggatctctcgcgccctctggcggtgggcgcggggagagccgctgggggcagtgctcgcgaccgacgagatggcaccaggggactttgttcgcgtggtcaaacaggtcgcggacttgcttcgccagatcgcggtcgcctgggacgacgatgtggtctcgtcgctcgctcggcgagccgaggcggcggtcgttcgcggcgtggtggcgctgtcgtcggaggtcgtcgccgaggatcccgagcgcatgccccacggagtgctcgagctcgacgagcggccggcgtaggctggcccgctgtggcgagctaccttcctgagcagttcgacgaggcggagcgggcgcggctcgctcctttcgtcaccgacgtcgacggtcgtgtgttcggtctggtgggcctcgacgaggaggtcgtcgcagccctgttcgcacgctactcgcgcacgtccaggtcgcttcggcggacgctgctggaggagttcgcgccgagggtcgaggacgcggtgcgagcgggcgtcggtcgtgagcgcaccgaggctctccttgcccgcgtgatcggcgagtacggcgacgactcggtcgcccaactcgcggtcgtgcacttcgcgatcgagcagatcccggccttgctcgcgcgccgcatcgagcgcggccgtcttgcggcctatctcgagcaatccactcgctacgtgccgctcgcgactcgccgttcggatgggagttggccagcttacgtccccgacggcctcgcgccgcgggcggcgcgtgcctacgacgaggccatcgaggcgagctttcgtgcctatgcggcggtcctcgaggcggtcgaagaccatctcgcgaagctcgatccaccggccgatgcgccggctcgtcgtgcgcagcgggccgccgcactggatgcagcgcgcgggttgctgccgctcgccgtcttgaccaacgtcggtgtcgtcgccagcgcgcaggcggccgagcgcttggtgtggcggctccgggccgacgccacgcctggggcgagcgaggttgccgacgagatcgcccgggtcctcggagtgctcgtaccgggcctcacccagcgcatggaccgccccgaccgcggtgggcggatggtcgagtatctgcgcgagacgcggggcggcgtcgaggttccgtggcactggaacacggcgatcgtcgaaccctccgttcggatcgtccgagccgacgaggatgcggagcgccgcgtcgctgcatggatgctgttcgagcgtggcgaggtggactcggtcgaccagggccttgccgcggtggaggcgcggggcgaggagggcctcgatgcgctgttcgtggccggcgtcggccatcgggccaatcgccgccacctgcccgggcgccccttcgaggctgcggtgtacgagctcgagatcacctgcgacatcggagcctttcgcgacctcgcccgccatcgcatcttgaccctgctcgagccaccgctcgtgccgggtcgtgggttcgcgctctccgatctcgtcgtcgacgcaggcgtcgcaccgctcgtgctcgagcattgggagcgactcggcccgctggtcgcgagcgtggtcgccgaggccggaccgtcggtgggtcggttgctcttgccgttcgcgacgcagatccgcttcgcggtcgtggtgaacgcgcgggagctgatgcacctcgtcgagctgcgatcgcagccgcagggtcacccggtctatcgccgcatcgcgatcgaggcctggcgcgcgctcgaggcggtcgggcatcgccggatcgcaggggccatggagttcgtggacacagagggctacactgtgggccgcctcgccgccgagcgacggagcgaggtgcgatcgatgcagtcgggaaggatcagcggggctgatccgttgagctagccgagctggtgcgcgaccggctccgtgcgaggaggacgaggacgagtatgccgagacgcaagggcgacgagtcggcatcggaaccggaggttccacacgacgacgagctcgacgaggagctggtgggcttcgacgacgatctcgatggtgacctcgacgacgacgtcgacgaggaactcgaagatctcgacgaagagatcgaggaagagggcctcgaggttggcgatctcgaggatctcgaggccgatgatctcggcgaggccgacgacatcgtcgacgatggtgtcgacgacaccgaggacggcgaggtcgccgttgtcgacgaggaggacgacgatctcgagggcgacgaggacgtcgagtcggccctcgacgagattctgagggagcgcttcgtcggcggtgacgtcgaagaagatgtcgaggccgagtcggacgaagacacgcccgatggtctcgccccggtacggcctcgccaacccggcgagttcgtgtgccagtcgtgcttccttgtcaagagcatgtcgcagctggcagactccgagaagatgctgtgccgcgattgcgtctagacggatcggtggcaccgtaagcttgaggttggccccaaaggaggcgctatggcagagcagcaacgtcgacagctgttcgatgatgtcctcgatcgcttcgtgttcggcccggtcggtgtcgccgctgcggtggcacgggtgctaccgagcgcggcggaggagggtcgcaaggtcctgcagggaccgatccagactgcgcagttcgtctcccagatggccgctggggtcgtacgggcacgctacggcgagcagttgcggggagtcgaggagcgtctcggcgacgtgagcgagcgcgtctcggcactgcgttcgatggtcgagcaggttggcggcgggatcgtgcgcaccgtccagcagaccgtgccccggccgggtgcgggcccacgcgatgcggctcccgatgccgaagccgcatcggccgccacgcgcgaggcgaggccgtcggatgcgcacgcaactggggaggaccacgccggcagtgtcggtgggatcgatgcctacgcgaccctgtcggccgccgaggtgatcgagcggctcggatccttgagcgcggagcagctcgccgaggtcgagctgttcgagctcgatcaccggcgccgccgcacggtgctcgcgcgcatcgcgaagctccgtgaggagcgtggctaggccgcctcaggcattgagaggtgcctcaggcgatgaggccgaggcgctcgaggagcgagcgcacgcccggagccagggggcgaaggtgacgaaggtcgtctggcccgaaccagccgagagcatcggcgtctgaacgcgcattcccacgcgctcgcccccgcggtgtcgcgagcacggtccagagcacgtacgcgccgcgatcggcgagcacctcggcaacctggaggacgcgcactggcgcggcgtggacgccggtctcctccgccagttcgcggatcgccgcggcgaccgggtcctcccccgggtcgacgtgcccaccgggtggggcccaggtcccgttcgcgtccggagagccgcgccgcacgagcagcacgcgcccatcgaggacgaggagcgtcgaggcaccgcgctggacggggagggcgaggcgcgccacgacagcgggcctaggcgaggcttcgagcgagccggagctccaccgttcgaagtccagcctcctcgaagagggccttcgttgcccggtcgccgggtgcgcaacttgcgctgaggacggtggcgccgtgccggcgagcgagttccgcgcaggcttcgaggagctcgccggccaagcccaacctctcgaagccgggcatcgtgacgatcgcgcgcacgatggcctcggggccgttgcgctccacgatggcgatcgctccgactactccgtcgacctcggcatcgacgcgccaggcgtggtcgggccgaagttcctcggcgacgagcacactggccatgggagcctcagtcgtgggtcggcgtcgcctcggcggcggagacgtcggaagggtcatcgccgggcaccgcctcgtcgatgtgcgacggtgctgccgcttcgggttcgccgatggtgtggtcctcgacgtctcgaacggcgtcggctgccgcgagctcgtcgtgtggtcctgcggggtgaggggatggagcagagacggtctcgtcgacggcgacggtcgtcgcagggtcgatgtcgcgggtcgatgtgtccggctccgcgtcagccggctcgggctgggcgccgacgagggtgtcgtcgggagtcgccaacgattggggctcggcctgacgagcgcccgttgcagcgccggcgtccgtggactcggcgtggccccgcccggcatcgtcacgttgcgtggagccctggcggggtttgcgcgaagtcttgggaacccgagcgaggatctctggcttcgggggcgccggcatcgtgaccccgagcaggcgtccgagcgacgggatgcggccggcctgttccttggcgagttcgacgagttcggcaggcgcggcctccggcagaccggtcgcggtgacggctcggcggatcggcgagttcgcgatcgcatcgatcaggaccatccagcgctctggcggggtgtcggggatcagttcgcgatcgacggcctcgacgagggcgcgctcgacgtcgtcggggatgcgtgcactcggatcaggcaggcgactcgccagccgcagcgctcgcacggtacggccggactcgacggcctcgcggagttcggcatgccagcgctcgatgctctcggcgatgcggcggttcagcacctcgcggagcgtggtggccttgtcgaggacgctcgggtccttcgacgacggatcgacggaggccaccacgctgcgcagatcgcgaagggcgacggtgttggcgatggcgagtgcggcgtcggcccgatcgagccaggtcgccgtgcgcacccgaggcaggagatcctcggcgatcttgagcgtggcctcctcaggcgctggcgcgcggccctcatgagcggcggcctcgcgatcgcgcgcgatggctgcgcgaacctcgggcatgccgccgcgcaccagtgcctctgcgatcggccggtgctcggggatgacgctctcgaggaatgcgcgtcggtgggtgtcgcgtggccgaaggcgtggtgccgctggtgcttcgggctgagcgggccgtgcgtcgcggcggcgagaacgctgaggggtcgctccctccgcgcgcgcgctttggtcgtgctggtcgtgctggtcgcgattgctgcctggacgtccacggcgctcggcgcgacggtcctgacgcggccgaccgtcgcggtcgtgggtgcctcgagcacccggccgtcgctctcggcggacggtctggatggtgacgggaggttccgcgcgtcccgaccccacgatgtcgatgcggtcggtgcgaggcggcgcgacgtcgggccgagccaggctgaggatctcgatgccgtcgaggcggcgcgcgatctcggcccgcgcgacatcgccgacgctcgcaccctcccacacgagcgaagccggtaccgtgccgcgcggatgtcgtgcgccgacggcgcgccaggtccactcgccacgcgctgcgtcgtggctcgtgagctcgacctcgatcctcgatgccatgtcccaagaacccttcttgctcacccgatgctcggcatgtcgccggtgcctgcgccatcctagtgtgcgcgctcgtgggcgtcggagggtcactgggggcgctcgggtgccctcggaaggggccccacggcgcccgtggattcgccgccccgaggggccggtcgtgggcgccggctcctcggatcggagcctgtcaatctctagtcaatctctaagaggcaccccgggctcgatgttcactgtgtcgtcgctgcctcctccggcgggttgatccggaccgctgcacggagccggggtggctcgggccgcctctgcacgaggcgttcggggtgggcacgcaaggcagccgcgagcacctcggcccggtgtgctcggagctcctcggcacggccgtcgacgtctgccggggtgtggagtccgattccagaatgacggtgctcgtggttgtaccagcggaagaagcgctcgcaccaggctctcgcgtcctcgtagcagccgaagcgccgggggtcgtcaggtcggtacttcatggtcttgaactgagactcgctcctacgggttgtcgttggaggtgtggggcggctatggctccgcgtcaccccgaggtgcgagagcaggtgtgcgacgggccccgcgatcatgggacctcctctgtctgcgtggatggtgagctgccctggtcggatgccctggctggccacggtctctcccaagagagcgaccgccaggctggcgtgctccgcgcgggcgagcatccagcccacgacgcaagcggctgtcgatgtcgatcacggtggagaggtagtagtggatccacgtggcagggccgtgcagcttcgtaatgtcccacgagtagacctggttccttctcgtggccacgagctcgggcttgaggctcgggggatgggtcgcatggcgtcgccggtctccgagcgcccgtgggcgcgcagtatgcgatccatcgaggacacggaggcgaggtagatcccctcgtcgaggagcttcgcgtacaccgtggccggggcctcatccacgtactccgggctgttcaggacgcggcgcacctcctcgcgctcgcgcggtgagagtgcccgtgggtgagggacacgtgcacgcttcggccggggtggccgggggctcgcagggtgccgtcggtcgtagcgggcacggggctcgccgagggccgagcaggctgcgcgtaccccgaccgttggcgccagttcgctgatggcctcgtcgatcacgtggtctcgccgtgggtcgcgggcgcgccgtcggtggcgagctgctgcaggcgcgcggagagttttccctgcacctcgatcaccttgtgggccttggcgaggtcggcctcgaggcgctcggcgcggcgcctgaggcgtgcgatctcctggtcgcggggatcagcgggttggcgtcctggtggacgtgcgagtgcctcctcggtggcaaggtcgcgttggcgtcgccactcggtgatgagtgaggagtgcaagccctctctccggagcagggctcccttctcggcctttgcaaagggagtcgtagtcggcgaagatccgtgccttgtaggccgcggagaagcgtctcggccctcgggcccgctcggggacctgcggatcggagttgctgggcatgcccccagtctggtagggactcgtcgtggcgtcggtcgtcatggtggtggcaagctccttcctcggccgccctctcgatccaacgatggggtcaggaggagtggtctcacccaagattgacacggagggtaaccccgaaccgctggcggtgccgaggtcagcggattcccccggccagctcctcagcgcacgtcgctgtcgagggggcgctctgccaccagctgcttggcgcgctggggctggcctcgagcgccttcagcctctttacctcgggccccgtgcctgccgccgtcggtctgcttccagccgctgtcaggtcgtctcggtgacgtgcgaaggctcgggcgacctcggcgaccgtggcgcctgtggtgcgcagccgtccccctcggccagcctccggaggaggctgctggtggggtgtggcgctgcctgcccttcatgtggtctcttcctcccactcgtccatgctggtcggggtgctcatggaacgggtggtctcgttgcaggagggccggccagggtactcgatgatcgcgaggtggtcgacgcggtctgtggaggtgcaggcttgccgacgacgctgggtgcaccagccgcaccagcgctcggcggcgtggcgctgtggcttggtggccacgagatcgtcgtggagggggtacggaggcccagctacggcgtggacgacgcagctggtagtgccgtcgtgacggcgtcggctccgcccaggcgctcctggacgcctgttgaaggctacttcacggtcacgttgcagccaacccaagggcaccaccgccgtccggctcagctccctcccctgccagatgacaaccgccgggacaacaacttgtcatcttttcgtccgggtcgtgaggctgaggctatactccgctcaggcgcctccgcaaaggtcgtacggctcgagggctctcggggctcatcgctgcgcgtctcctccgaagggagccgagatatgcacccgtctaagcagatgaccttcttgcgcaaggaactcgcccttggcacgatcctgacgtctgcgctggccttcttacttttctcacccttgggtacaaccagcgtggctgcgtcgaaaacggcagtcgccccgatgcccgcaccatcaggcgacccttctcagcctgccggtatttgttgcagtacccagaacttgggatccaccatcggtgaaggcactgttctcaatcccggcgactatctactctcaagttctggacaataccagctcatcatgcaaggcgacggcaactttgtcctctacaacttgtacaacggtcaagcattgtgggcgactggtactgaagagcactctggcgcctacgcagtgtttcagaacgacggcaaccttgttgtttacttcaatgggactgcgctgtgggatagccatacgtatacctactctggtctgacactgacaatgcagaacgatggcaacgcagtcatctatcaaggtacccagccgctatgggcaacggatacagctgcgaacgagttggactgttggccttccaacaactgcacacccggcttgttcatctatgcctatcttcaattcccgccaacagcgccgttgcagggagtgaacgcaccgacaacgggtgccaacacgtttgcgatgtccaagtgggaacaacaagaagacagcgtcattcagtcaaaccctctcgacacgacgcaaaaggagcctggctcctacaccctgaagggcaactctgccaacgttcaagtgtatacgaattctgatggtgagtccgctgattactggggcattgacgcatttgatcagactatttcttaccttccatattatgggccgattatctcggttcttagaaatccagtgaacagtccctaccagcaatgcgtcaatctcgcgaatgctgtaagcagcaccctttgggggacgattaatttctcagatctgtgttagcttcctactgcaaagatgaggaggtgtgatgtccactgcatggaaccgcacggtgaagattggcggggttgtcagttcgtgtcttgccttagtggctcttgctgctgttgctggccgagtcgaggatggccacgccgctcaacaccgcggacatcagcagtcacccgttgcgagaacagctacggcgccctcagtacaggtggctactgggcaaagagcagggcagtcaaaggatgctgctgccgcaggtgatccaagctactttacccccacgctatcaggtgttgaaacgggtgatcctgccttgccagttggccactactgggaatacgtgccagcggtagtgcccggcgttccggagagaccatcgtacatgttgacgatcacacaaagtgggagtgatggacagatcgcgggcatggtctatatcttctacgaggatgggaagcttgataccgtgtttccgttctctggcctcgtggatgcgacgactggcaagggtagtatcacagtgagtggcgctccaactgtggtgtcatacaacggcgtgatcttctacgatcaatctacggtgcaatctggtcagcagctgccagtggtcgtcagccatggcgacatcacgttccctgggtgttcgaactatctgcactggctgatggccgggagttcagcatcacctgctctgctcgcggcaatagcaagtgatccgaatgtgtgcacgttctacccgactggtggcgaggcctacccaagcgagtcgcagatacccgttaccccttaggggatcggtgcgtgggaagcggagggcggagagcatcttggcgcctcgtgttagttggtgtctcagtaccctcggccggctctcctgaccggccccccgcaccgagtccaccttcaccgtgagacccagcgtcgtcatgccagcgctcgttgattccactgagcgccgatgacgccgagcgggcagcacctctgacccctcgcggaggcctcgaggatccgtcgctgggtggcgacgtcgaggcgggcgaaccgggcggggctgcggtcccccggcgatctgggcgtccgcgtcgtgctggggggtgccggtcgtgctcgaggagctgcctggcctcgcgaacgccaggcgacgcgctccccatcgagcacctcctcgcggacctgggcacccagcgatgcgcacaccccgttctgccacggcgagcccgggtcctggacacctgggcagccgagctcggctgcccaggtggtcatgcacgcggccacgcacgccgggccgtcctcgacccggaggacgcctagggttcctcgctcggcgaggaggccatcgagggtggcgacacgtcgtgcgcgtcaatcgagcgcttcaccacgcacagccagctcctccgtcgtgggggcgtccaccacggcgagcacccagggcgccctcccgtcgtcggtcgcgtcgaaccggctccagtgcccaggtcgcgttcgtctggatgggcaggtgagcgcccatgggcaccccaggtcgtggttggcgccgtctcgtgcgtgactggggacccggagccctgccgtgcgccagagccggtgcacccatttgaggttcacctggtagccagcctccctcaccgctcggtaggccttgcgatagccctggcgggagttggctagggcgaaggtgcgcaggacctcatgctggccgcatccaagctggactcgggcttcgtcggcacccgacgctgggtggagcgaggctgggccgtcagccggcacgctcgtcgctcgtgcaccccgaaccgccggcggtgccggggtcagcaggttccctcggccagcctccggaggaggctgctacctgggtggcacgctgcctgcccttcatgcgctctccctcccgctcgtccatgctggtcggggtgctcacggagggggtggtctcgttgcaggggggccggccaagatcacctcgtatcggtgccggtgccaccaggcgtatggcaccagcgagcggtgatcctcgtaaggcggtcaggtaagtccaggtcagagctgctatggttgagggtcggtagcaacgacccctcggggtcgtcctcgttggagcagggcgtcccagaagaccggatcgtcggcattcaccacgtggcaacgaccccgagcggtcgtcctcgttggagcttcgatgacaccccgctcaccatgtagcggcggctcaagtagcaacgagcccgcggggtcgtcctcgttggagctcggcgacgcagggcccagcccccgacccgtgaccgcggctacgccgtgtgctggaacacggcctgctcgagccgacggaggcgctcggcaacgctcagctcgccccctcctcctcggcgcggagccgatcgagtgcccagattcggatcaacgtggagactggcaggtgctccttggcggcagcgcgttgcagccgggcgtgctcgtcagcggacaaccgcaccgacaccacggtcgggcgagtgaggttgggtcgtgcgaccgtgacgcctgcgggcacggtgtcggcgaggtcgtgctgctccgccgccgctccctcctcggccacgtggagcatgacgcttgccgcccttcaggtcggcgccctcctacgagtccctgctcgtcgggaccgccgcaggccgagtgcaaggatgtagcgtgaacagcgagaggaaggaccccatgccccgccgtaccaccaaggactgcatcctcgcctacctcgccgcccgcccgaacgaggtggccttcgtgcgctccgagttcgctcagtgcgcgaagagtcgctcggccgtggaccgagcgctgcgcgccctcatcgacgaggaggtgctcgtgcgcggcggctggggcatctacgtgcgggccaagcgtgtcgagttccttggtcgtgagtacgtcggcactgtcactggcttcgactattggtaccccgaggtgctcgccaagctcggcgtcacctgggaggccgacagcgcgcgcaaggcgtacaacgagggccacaccacccaggtccccgcctggaccgcagtcaacgtcggccgccagcgcatcaccaggcggatcgcgttcggaaagcgagtgttgcagtatgagcgaaccacgggggctcgacgacgcaaggttcggcctacttcagcgagccgacgacagcgggcaacttccactccctcctgagttcttcgaaaaggacctgctcgtcgccgaggcggtgcgcgtcatcgcccaggtaggtcgtgagcgaggtgtctcgctcatcttctgcggtggcaccgcgctcgcgcaggcccaccaggtgatcgagcgcatgagcgaggacgtcgacttccgggtggtgctgccggacctgcccagcaccaaccagcgccgcaagttcctctcggcgctcaaggccgacctcgtcgcggcggagcctgtcaatctttgagagacaccccgggctcgatgttcactgtgtcgtcgctgcctcctctggcgggttgatccggaccgctgcagggagccggggcggctcgggccgcttgcgcacgaagcgttcggggtgggcacgccaggcagccgcgagcacctcggcccggtgagctcggagcgcttcggcacgtccgtggtgcacatcggccggggtgtggagtccgatgccgcacgtggcggcgctcgtggttaaaccagcggaagaagcgctcgcaccaggctcgggcgtcctcgtagcagccgaagcgccggaggtcgtcaggtcggtacttcatggtcgtgaactgggcctcgctccgacgggttgtcgttggaggtgtgggggcggctgtggctctgcttcaccccgcggtcggcgagcaggtgggcgacggacttcgcgatcatcggacctccccggtccgagtggacggtgagctcccccggtcggacgccctgactggccatagtctcctccagcagggcgacggggtggctggcgtgctcggtgcgggcgagcatccagcccacgacgcaagcggctgtcgatgtcgatgacggtggagaggtagtagtgggtccacctggcagggccgaggagcttggtgatgtccgagctcgtgacttcgttcggtctcgtggccacgagctcgggtttgaccgtcgggggtgggttgcgtggcgtgccggtccccgagcgcccgtgggcacgcaggatgcggtacatcgtcgacacggaggcagggagatttcctcgtcgaggagcttggtgtacaccaaggccggggcctcgtccatgtgctcggggctgttgtagcacccggcgcactggccctcgttcctcgtccgagagggcccgtggctggggagccttggctagcttggggcttcttcggtgccgtcggtaggagcgagcacggggctcaccgagagccgagcaggcggtgcgtaccccgacggttggcgcgagttcaccgatggcctcgccgatcacgtgatctcgtcatgggcgccgggcggcgtatgcgcgcggctcaagggtccttgcggacgcgaggtcgctgccgcacgcgcgtgcacgggagcggttcgcgtgctccgggccactcgggtcagttcgcagccgagaacggtagccttggccgtggggacgcttgctccgagggaggttacagggggatgacgcgtcggtaccgctgcacgaactgcgggaacgtcacacggtttgacgtcaccatgtcggttcgtgcacgttcctatttccactattccatcgcgggtgagctgtcggtcgaggacaccgaggagctgtcgcgcgtcgtcgaggaggtgtcgtgtcggtggtgcggcacgagccgattcgtggaggtcctcgaggcgaccccagcgacggtggagcggacgtgagcccccgcgctggtgaccgccctcgtcggccggcgccgcagtgggcgctcgctcgtgtcgtggagctcctcgacgagacgccggacacgaagagccttcgtctcgagctcgacgaaccccagcagtacttgccggggcagtactacaacatccgtatcccggtcgagggacgaccacgaccgatccagcgcgcctattccctcgggtcctcaccgatcccggaaggccgcgtgatcgaggtcggcgtcaaggcggtgccgggaggactggtgtcaccgcgactcgtgttcgagacgcacgtgggtgacgaactcgaggttcgtggcccctacgggacgttcacctggaccgaggaggacgggggcccggtcctgctcgttggtgcgggatcgggcatcgtgcccctcatggccatgatccgctaccaggccgctcgtgggacggcgatcccgatgcacctgctctactcgtctcggcgtcgcgacgaggtgatctacctcaccgcgctcgagtccctccggagcgagcacgagtggcttcgcgtcagccacaccttcacccgtgatctcgatgatccgctcgccaggttccatcgtcgtatcgacaaggagatggtgcagctggtggcgcgcgaggccgaagcgcagctcgcctacatctgtggacctccagaactcgtcgacgacgtcgaacggacgctgatcgagtccggtatggatgagcaacgcatcaagaccgagaagtacgactgacgacggtgcgctcgctcgccgcgtcgaggcgtgcctccgagacgccggtgtcgtcgcggcagggtgggtcccgagagagcagcgtgcctggcgcgagagcacctgggcccagctggctgtcgcgcgcggctggatgcgtgagccacggttcacctttcggcgtccgcagcctgcggccgacccttgggccccgctgtcgtgggcccgcggtgcgatcgtggtcgcggtcgcggcagcgccgtccgtgcccgcggcgaaccatctcggtgtcgctggctacgcagcaggcgatgcgtacgcgcaggtgcgcgacgcactcgagcgtgtccggcgcctcctcgtcgacgtcggtggccgtggtgtcgtcgtggccgactccaacctcgctttcgatcgcgccctcgcgcgccgagcgcggctcggatgggtcggacgccacaccctcgtgatggtgcccggctacggcggggccgtcgtcctcgggtccttgatcgtcgatcgggtcgtcgaggtgcgtctcggacggaccccgactggggatccgtgtcgcaactgccgtcgttgcgtggatgcgtgtccgacgggcgcgctcggcgacggggtcctcgagccgctgcggtgtcgctcgtggcgccagcaggagcgacacctcgagccgtcgtggcgcgagacgtggggcccctggctgtatgggtgtgacgagtgcgtgacggcgtgtccgctctcggcacggcagaagaaggtcgggggcgagcgcgtcgcgtccatcttgtcggcgagcgatgcagcgctcgccgagcgcgtccggagttggtacataccggatcgaacgctggcgtgggtgcggcgcaacgcgatcgtcgcggctcggtccctcgcgacgagccccgacgacgagcaggcgatctggcgccagctggtcgccggagcagcgccggtgcgagccgaggcggtacgctgggtgcttcgtcgaggtgggtggggaggtgtcgatgcgtcacgtgctcgtcaccaacgactttcccccgaagatcggcggtattcagcactacctcggggagatctaccgtcggctcgacccgacgagcttcgtcgtcgtcacgcgtgacgaggcgggcgccgaggccttcgatcgcgccttcggggcgcgcgtcgtgcgagtgcgcggaccgcttctgcccactcgggccctggccgcccgagttcgcgggctcgcacgcgagatcgacgcggacctcgtggtgatcgacccgatctggccgctcggtgaggtcgcggcgagcctagggctggggtgggttggtgtcgcacacggtgcggagctcacgttgccgcttcgactgtggccgacggccggtcgaatccgaagtgtgctcgcgggggcgctcggcgtggtggcagcgggaggtttcgtcgcgcgcgcgctcgatggggtggtgccggccgatgcgatcgcgacggtgccgccgggggtggatctcgaacgcttctgcgtcggcgatcgcgagcgtgcgcgcaaggacctcatggtggacccggagcgatcgctcgtgctgttcgtctcccgtctcgtcccgcgtaagggcgcccacatcgtcatcgacgcggttgcccagctgcatcggccggtggagctgcacgtggtcggtgacgggcgaagccgcagtgctctcgagcagcgagcgcgccgtcggggaatcctcgcggtgttcgaggggcgtgtggcgctggatcggctggtggcgagctaccaggccgccgacgtcgtcgcctttcctgcgcacgatcgttggttcggtctcgaggaggagggtttcggcatcgtcgcgctcgaggcgcaggcctgcggcgttcccgtcgtggtcggcgtgagcggcgggaccgcggaggccgtcgatcctgcgagtggacggctcgtcgcgagtcgccgtccgagggcctgggccgaggcgatcgaggagcgtctcgctcacacgagccctccggtcgccgacgcgcgtggcttcgtggagcgtcatcacggctacgaccggttggccgacgagtggcatgcgggactcgagcgcctcgcgagccgtggacgtacggccggaagcggctaacctgcacacatcatggaggccacagctgagtcgcgcgaggttcctgcgccggtcgaggcgctgttcgacgtcgtcgtcgacgtcgaacgctatccagagtgggcctcggacatccgaagcgtgagcgtgctcgagcgcgacgagcatggtcggccgcgtcgcgtccacttccgtgccggcgcgttcggccggagcgcgtcctacacgctggtctacgatgcgtccaaagcgccgaacgagctgtcgtggacgcaggaggaaggcgacgtcaccgcgcggctcgatggccggtatcagttcgagccgttgggggacgacgtcacgcgtgtcacctatgagctggctgccgacctcgtcgttccgctccccgggttcttgaagcgtcgggcagagatgaagatcgtgcacgccgcgctcgaggatctggcgcaacgggttcgccagctcggctccgccgacggatcggcggcgcgcacacccgatcgctcgcattgatcggtcgtgacgcactcgcttcaccactgaatccatcgtccctgaccttcggcgtccctcacgacagggacggccatcggcgcacgtcagatgcactacgctggggttcacagcgacgctgtgcgtcgggtgtgggggagcggagccgtctgggggtgcggaatccatggcgagatgtcgaggatctcgaccgatgagccgatcggggtcgacacacggttcgcagccccgacgtcggcgactcgcgcaggtgtcgagcgcggtgcgcgcatgatcggctgtggggggcccgcgctgggcgagatgatcgatctgggcttcggcaaccccgacctgcctccgcctcaagaggcgctggcggcgatcgcggccgagctcgcgcggtcgcatcctgcacgctacggcgacagcgctgggaccgtcgcgtatcgtgccggcgtcgcagccctctacgagcggcgttggggcgtcagcctcgatcccgacgcggaggtcacccaggtgctcggcgccaaggagggtctgcaccacgtgctggcggtgctccctccgggtcctgtcggggtgccgatgccgagctacccgacgcaccacgaggcagtgctcgtcgcggggaggcccctcgtcggactcgagctcgatcccgacgatcgagacgggcgacacttcatcgagcgggccgcggacttggcccgcgccggccgcgttcgcgcgatcgtgctgtcgttcccgcacaaccccacgggggtcacgacgacgcgcgcgatgctcgaggagttggtggccgccgcggtggaggcaggggtgaccctcgtgcacgacttcgcctactgggccacggtgctggaggagcgcccgagcgtgagcctgctcgagatccccgaggcgcggtcggtcgcggtcgagctggtgagcctgtccaagtcgcactcgatggcgggatttcgtgcgggtgcgctcgctggttctggcgctatcgtgcagcgggtacgcgcgcgcaagcgcgccttcgaccacggtctgtcccaaccggtagaggcaggagccctgtgggcgctgcacgatggcgaccgagcggccgacgagctcgcacgtcggtatcgggtgcggcgcgacgtgctggtggcgggccttcgccggctcgggtgggggcgggtcgcgaatccggccggatcgatgttcgtgtgggcacagcctcggggcggactggacgacgccggcgtgacgcgccacctcgtcgacgagcacggcgtccttctcggtgcgggacgcgacttcggcgccacggaggcggggtggcttcgcttctcgctcatcgccgagcccgaggtgctcgacgaggccgttcgtcgtctcggccagtgcgcgctgctcgggtcggcgtcagcgcccgagggctcgctcgcgtcgtgaggccgtggtatcgaggcgcgctcgctcgaggtaggcgagcacctcgtcgaagtcgtggtggggctcggccagcgtgatgcgcacggcgccggcgaacgacgaggcgagggtgaaggcggcgcctggcacggtgcgcacgccgtgggcggcgagctcgagggcgatgagcgcctcgggatcgggcgggagccatgcgttgacgccgtctcccgtcaggttgcgacccagcgcatcggcgaggcgctcccgtcgggctgcgtaggtggcacgggcgtgctcgaggcgctccgtctcctcgggggcctcgagcatcgcggcgagcagcgcctggaggagtttcggcgaccacgacgggccgaggctgcgcgcgtgctcgagcgcgtcgcgtcggtcggcatcggtgatgatcgcggcgaggcgcaggtcgggcccgtgggacttcgagaagctgagcacgtacgcactcgcgggatggagccctgcgaggctcgccaacagcgtcgaggcgacgagcccggagtgatcgtcctcgatcacgaggacgtcggggcgtggggcgagggctgctgccagcgcatcgcgacgctcgccgctcaccgtcgcgccggtcgggttgtgcgcgcggggctggatgatcaccgcgccaagctcggggcgtgcggcgagtcgcgcaaggtcgctcgggtcggggccctcggcgtcgatcgggaggggccagacgctcaagccgtgggcctcgacgaggtcgaagagcgcgggaaagctcggatcctccacggcgacggcggtcgcgctgggagcgacggtgccgaggagtcggtcgatcgcctcgagggcgccatcgacgatcgtggtgccggtgtccgctcggagctggagggcgggtggcagcaaggggacgaggacgtcgacgaggggtccgaacaccggtgggtccgcgtacgtcgcgggagcgagcggggcgatgcgtgggagataggacacggggtcggggagcaggcgcggatcgggagcgccggtgccgaggtcatagcgtgcgggctggggcggcgtctgctgccatcgccgaggccgacggcgcggtggtgaggcgacgaaggtaccacggcggccctgggccgcgacgagccccaagctggcgagctgtgcccaagcagccgccaccgtcgtcggcgagatcccaaggtccgcggcgagctggcgaacagggggcaagcgcgtgccttcgggaagctcaccggcgcgaatcatggtcgcgaccgtcgaggcaacggtgcgcacgccgatcgtgccgacgctgcgacggcgcagcgctgccaccagggcgtctgccgctgcgtcgtgcccgagatgctccatggccccagcgtagcaaggagcgcgctcgtgattttcgtttgtgtggcacaaccctgtgtcgcgtgccagtacaacgaagtgctaccatgccggaaacggtccggatgctcggaggaagtggaggcggcgatggacctcatcgaacggcatcggcgggtgctcccgtcatggctcagtctgtactacgacgagccgatcgaactcgatcggggcgaaggatgctgggtgtgggacgcgcacggtgagcgctacctcgactgcttcggcggcatcttgacgacgagcgtcggtcacaacgttcccgagatcgtgagcgcgatcagcgaccaggccgctcgggtgatccactcgtcgaccctgtatctgaaccggcccatgatcgagctcgccgagcgtctcgccaaggcgtcgggcattcctgatgccaaggtgttcttcacgacctcgggcaccgaggcgaacgacgcagccctgctcttggcgacggccgccctcgggtcgaaccaggtgttcgcgctgcgcaactcgtaccacggtcgctccttcacggagatcgcggtgaccgggaaccgaacctggtcgccgacgtcgtactcgccgctcagcgtcagctggttgcaggggggttcgaggctgcgcgggccgctcgcgggtctctcggacgccgagtacgtcgcgcgtggggtcgccgacttggaggatgcgctgctgacgacgacggccggacgggtggctgccctcatcgccgagccgatccagggagtcggcgggttctgtctcccgccggatgggtacttcggtgagctgtggagggtgacccagcgcgaggggattctgtggatctccgacgaggtccagaccgggttcgggcgtaccggcgagcatttctggggctacgaggcgcacgggatcacgcctgatctcatcacgttcgccaagggtgtcggcaacggcatgtcgctcgctggcgtgatcgggcgagcggaggtgatggacgcgctcgggaccaactccatctcgacctttggcggttcgccgatcacggcggcggcgggcgtggcgacgttcgactacatcatcgaccacgatctcatggccaacgcgcgtgcgcgcggcgccgagcttcgcgaggggctcgacgcgatcgctcgatcgacgcccgcgatcggagaggtgcgcggcaagggcctcatgcagggggtcgagctcgtctggcccggtacggtcgagccggcgcccgagcttgccacacgcgcgctcgaagcggcacgtcgcgaaggcgtcctgatcggcaagggtggtctgcacggcaacgtcctgcgcatcgcaccgcccatgaccatctcggccgagcagatcgagcacgcactcgaggcgttccggcggtccttcgccgaccaggcattccatgtgaaggagcagtgatggagacgatcgcgcacctgatcgacggcgagcgggtcgaagcggccccgctcggatcccagccggtcctcaacccggcgaccggtgaggccatccggagcgtcggactcggcgatgcgggcctcgtggatcgggccgtcgccagcgcggcggcggcacagcaggactgggccgagcagtcgctcgccgcgcgccagcgcgtcttcttccgctatcgcgagttgctcgtcgctcacaccgacgagctgtgcaccttgatcagtgaggagcacggcaaggtgctcggggatgcccgtggcgagttcgcccgaggggtcgaggtcgtcgagttcgcgaccgcgctcccgcagctgctcaagggtcagttctccgacagcgtctcgcgcagcgtggacgttcgcagtctgcgccaaccgctcggggtcgccgctggcatcacgcccttcaacttcccggccatggtgcccatgtggatgttcccgatcgctctcgccgtaggcaacggattcgtcctcaagccgtcggagcgcgatccctcggcgtcggtgcgactcgccgagctgttcgtcgaggcgggtggtcctccgggcttgctgaacgtggtgcacgggggtccagcgacggtggatgcgatccttgcccaccctggcatccgagcggtgtcgttcgtcggctcgaccccgatcgcacgccacgtctacgagagcgccgctcgttcgggtaagcgggtgcaggcactcggcggcgcgaagaaccacatggtggtcctccccgatgccgatcgcgaacaggtcgtcgacgctgcgatcgcggccgcgttcggcagctcgggtgagcggtgcatggcgatcgcggtgctcgtggtggtgggcgagcagccgggcctcgtcgacgagatcgcggctcggatgggctcggtacgcgtcgggcccgcgacggacccgactgcggagatgggcccgctcatcaccgaagcgcatcgcgaccgcgtggcccgcctcatcgaggaggcggtgtcgaagggggcgaaggcgatcgtcgacggacgagcacacccggctgcggcaggtccgggcttcttcctcggccccacgctgctcgaccaggtggacgtcgcgatggacgcctacaaagaagagatcttcggcccggtgctcctcgtccagcacgcggacgacctcgacgaggccgtggcgctcgtgaaccgcaacccgtacgcgaacggcgcggcgatcttcacgcgcgatggcggcgctgctcggcgcttcgtgcgctccatcgacgccggcatggtcggggtcaacgtgccgatcccggttccggtggcctaccactcgttcggcggcttcaagctgtcgctcttcggcgacacccacgtccatggcgaggagggcgtgcgcttctacacgcgcggcaaggtcgtgacggagcgctggcccgacgaggcgtccgaggcgcgctcgctgcacttcgtgaccaaccggtgaggtcgcgcttcggtgccggctcaccgaagcgctaggctcggcgcctcgtgaagcgggaggagtcatcggcggccgacgctccggcggccagcgagcgcgacatggcacgcggccgaggcgcgcgagaagcgtggcaggtgcccgcgctctcggtcgatgcgttcgactacgacctgccggccgaggccatcgcgcacgatcccatcgagccccgtcgtgctgcgcgtctgctggtggcccgtcgcggggctcccgtggcccatgcgagggttgccgatctcgctcggctcctcgagccgggcgacctcgtcgtcgtcaacgagtctgccgtggtgcccgctcggctgcacctgcagcggagcagcggaggcgccgtcgaagtactcctgctccggcagcttcccgatgggaccgccgaggcgctcgtgcggcccaatcgtagggttcgcgccggtgagcgccttctcgccgacggcgtggaggtcgtcgaggtgggaggcgccctcgaggccgtcgagggcatgacgatccgagcggtgcgcgtgctcgatccggagcgcgtcgcctcgatcggggtggcaccgctcccgccctatctcgggcgccaggacatccccctcgagcgctaccagaccgtgttcgcgcggcgcccagggtcggtcgcggcaccgaccgcgggactgcacctcgacgaggtcgtgctcgccgacctcgcggcgcgcgggatcgacgtcgtgcgcatcgtgctccatgtcgggctcggcacgttctggccggtgacggcggcgacgctcgccggccatccgatgcacgcggagtcctacgaggtcgacccggccacgtgggcgcgcatcgagggcgcgaagcgtgtcgtcgccatcggcacgaccgtggtgcgcacgctcgagaccgtggcgctgacaggtgagttggcgggcgagtctcggctgctcatcgcgccagggtttcgcctgcaggtcgtcgacacggtgctcaccaacttccaccaaccgcgctcgacgctgattgcgctggtcgcggcgatggtgggggatcgctggcgcgagctctactcggtggccctcgccgaggggtaccgcttcctctccttcggtgatgcgatgctcgtcgacgtcgaggggcgtcggtgaggccgtcgttccggatcgacgcgacggacggcacggctcgtgcggggacgctcaccctacgccatggtctggtaccgacgcccgtgttcatgccggtcgcgacgcgtgggatggttcgactcgtccccccggcgaccctgcacgagctcggggtctcgctgctccttgcgaacacctaccatctcgccctccgccccggtgccgatgtggtggcggcgctcgggggtctcagcgctttcaccggcttcggagggcccatgctcaccgactccggcggattccaagtgatgtcgctcggaggcacggtcgatgacgacggagtcacgttccgatccacctatgacgggcgccgggtccgtctgaccccggagggcgtcgtcgagctcgaggagcgcttcggcgtggacatcgcgatggtgctcgatgtgtgcaccatgttgccggcggagcgagcagcgctgcaggtggcgatggttcgcaccaccgagtgggcgcgccgggcagcagcggcgcgtcgagacgaggcccaagcgctcttcggcatcgtccagggtgggtcggaggaggatctgcggcgtgagcacgcgagccagatcgccgagatcggtttcgacggctacggcatcggaggcctcgccgtcggggagtcggcgcccgccacgctcgcggccgtggcagccgccctcgagcggctgccggcggatcggccgcgctatctcatgggcgtgggggatccctacctcatcgcccacgccgtcgagctcggagtcgatgccttcgactgtgtggcacccacgcggcttgctcgccacggcatcgcgctgaccagccagggtcggctcgcgctgcggccgagtcgctggttgggctcggacgagcccgtcgatcctcgttgcgggtgctcgacgtgtcggacggtccctcgagggctcgtcgcgcacctgttgcgtgtcgatgcgcacagcgccggcgcgctcctcagcgtgcacaacctgtcgtttcagctcggactccttcgcgacctgcgtgctgcgatccgtgccggcacgctcgcgggcctggtacgcgccctcgacgaggtctgggcgccgagctggcgaagcgctcggaccgaggccgcgccggatcgctaggctccttgatgagtgcacgtcggaggggtatgagcaagacgcgttggctgtggtcggtggtgctgtcggcgctggtcgcggtggcggcattcatcggtgtcgtcgagctcgctcacgatgggccgatcctcggactcgacctccaaggcggggcgagcgtcgtctaccggcctgctcgaccggtgtcgacggccatcttgaacgagacgatcggcatcttgcgcaaccgggtcgatggactcgggatcgccgatccgtccatcggtcagcagggcaacgacatcgtcgtggagctgccaggagttcgcgatccgcgccaggccttggcgctgatcggacagacggcggtgctgcagttccgaccggtcgagtgtacgtgggctgcgtacgccccgacgaagggacagcacgtctcggccactcggccaccgacgtcgtgcccgacgagcgcagccggactcgccgccgaggccgcggtgccgacgacgccgacgcaggtcgccctccacagccagacggcggtgctcgatcttcgtcagggaacccaggtcgtcggacgctacctcgtggggccagccttgctcgacggcaacgccatcaagagcgtgtacgcggcgcccgacaccacctcctcgaccgggtcatggctcgtcgacttcaccctgacgccgaaggcctcgccgctgttcaatcagatcgcgaagacgttctaccaacgccagctcgcgatcgtgctcgatggcacggtgatctcagccccgcagatcacctcgacgtcgttcaacggacaaggacagatcaccggcaacttcaccgaggcgcaggccaacaaccttgcgctcgtgctgcgctatggcgccctcccggtgcagctggtccagcagacggtgcagaccgtctcgccgacccttggtgcgagcgcgctccgtgcgggcctcgtcgccggcgtcgtcggcctcatcgccgtgttgctctacaccatcgtctactaccgagtcctcggcgtcgtggtcctcgcaggtctcgtggtgacggccgcggcggtctgggcggtcgtcgcctacctggggagggcggcgcagctcacgctcgatctgtcgggcgtgaccggtctcatcgtgtccatcggcctcatcaccgactcctacatcgtcttcttcgaacggctcaaagacgagatccgtgaggggtcatcgatcgggtatgcggtcaaggcggggttccagaaggcgtttcgcaccatcatcgcggccgacctcgtctcgttcatcggcgccgccctgctgtggtacttctcgatcggtcaggtgcgagggttcgcgttcttcctggggctcgcgacggtggccgacgtcgcctccgcctggttcttcacccgaccgctggtcctcatcgtcggcgacgccctcggcaagacgcatccccgatggctcggtgtgggcccggtgcagctgcgcgaacaggcacccgagacggccatcttgcggccacgggccagagtgagtggaagtgaatcatgagtcaggttcgcatcgtcgaagatgcctcacagctcagctggtggcggcgtgtcggggcgggcgcgacgcgcattcgcttcgtcgaacgggcgcggtggttctgggcggtctcgctggtcgtgatcgcggtcggcgcggcggcgctcgggattcgcggcctgaacttcggtatcgattttcgtggaggcctcgcctggcaggtgagtgcgccgacgctcagcgtcacccaggctcgtagcgcccttgccgggctcccgctctctggcaccacggtcgtcagcttggggaccggtcagcaccgaaccatcgaggtggaggcggatctgccgacctcgggtgcgcgagcccatgcgctcgagaacgaggtcgccgctcgactggctgccgcagctcaccagccttcgtcggcggtggcgatcaactacgtcggtcccacgtggggatcgcagatcaccgacgcctccctgaaggcgctcgtggccttcttcgtcggcatcacgctctacatctcgttgcgcttcgagtggaagatggccctggcggcgctgatcgcggtgatccatgatctcgtcgtcacggtcgggatctatgcgctctcggggttccagatcacgccatcgacggtgatcgcggtgctcaccgtgctcggttattcgctctatgacaccatcgtcatcttcgatcgcatcaaggagaacgtcgcgacgcacgtcgatcaggcgggggagatgacctactcggaggtggtggaccgctccgtcaatcagatgctcgcgcggtcgatcaacacgagcgtcgtcgcggtgataccgatcctgtccgtcttggtggtgggggcctacctcctcggtgcgacgaccctgcgcaacttcggcctcgccctcgtggtcggcctgaccagcggcgcgtactcctcgatcgccatcgcatcgccgatcctcgcgttcctcaaggagcgagagcccaggtaccgacagctcaagcgacggattgccgcgcgtcgtatcgcacctgcgaccgaggcggcgggtaccatcgatacgtaggagggggcgatgctcgacgagcggtggttagcggagcgctacgccgacaacccgctcgtgctcgacgccctcgcgctcgcgacgaaggcgcaccacggccagctgcgccggtctggggagccctacatcgtgcatcccctcgcggtggcccgtcgcgtcgccgaactgcgcgccgacccgatcaccgtcgccgcggccttgctccacgacacggtggaggatacctcgatctccctggaggaactcgagcagcgtttcggcgcggaggttgccgcactcgtagacggagcgacgaagctcgaccggctctcgttcgactccaaggaggtcgcgcaagccgccacgatgcgcaagatgctcatcgcgatggcgcgtgacgtgcgcgtgttggtgatcaagctcgccgatcgcctgcacaacatgcagacgatcggcgctctcgggcgcgagaagcagcgccggatcgcgcacgagaccatggacatctatgcgccactcgcccatcgcctcggcatcgaggaggtgaagtggcagctcgaggatcatgcgttcgcggtcctgcatcctcggcgctacgccgagatggagcacctcgtcagtcagcgggctccggagcgcgaggcgcggctccaggcggtcagcgaacagctcgctgccaagctcgcccaagtcgggatcgtcgccgaggtcacggcgcgccccaagcacgtctggagcatctacgagaagatggtgctgcggggcaaggagttcgacgcgatctacgacatcctcggggtccgcatcatcacacacgaggagcgtgactgctgggcagcgcttggcgtcatccactcgctgtgggcgccgatccccgggcggttcaaggactacatcaacgctccgaagttcaacctctaccagtcgctccacaccaccgtcgtcctcgagggcgggagcccgctcgaggtccaggtgcgcacccgtgagatgcatctgcgcgccgagtatggcgtcgccgctcactggggctacaaggagggttctgatgcggccgagctcgcctggctcggtcggctcatcgacctcgacgaagagacgcacgatccggtcgagttcctcgagcacctcaagctcgatctcgggaccgacgagatctacgtgttcacgcccaagggcaaggtcatcaccctcccgacgggcgcgacgccgctcgacttcgcctatgccatccataccgaggtggggcaccggtgcgtcggtgccaaggtgaacggtcggctggtcgcgctcgagacggagctgcgctcgggcgacaccgtcgaggtggtgacgagtcgctccgccacggcgggtccgtcgcgtgactggctcgcgatcgtgcgcaccccgagggcgcgctcgaagatccgccagtggttctcgcgagagcgtcgggaggagtcgatcgacgcaggtcgcgaggagctcgctcgtgagctgcgtcgcgaggggttgtcggtgaccaagcacctctcgggaccgggtcttgcgcgcctggccgagcaggccggctatcgagaggccgagaccctgctcgcggccatcggtgagggccacgtctcggcccggagcgtgctcgccaaggtgcagcgagccgagctcgagcacgacgggttcgagccggcggtcgcgacgccgcagcggcggcgccgtggaggcgggggaccgtcgatctgggtcgagggtctcgacgacgtgctcgtgcggctcgcacgctgctgcaacccgctgccgggcgatgcgatcgtcggcttcatcacccagggccgtggggtcgccatccaccgagaggactgcccgaacgtcgaggcgttgctcgcccaagggcccgagcgcatggtcgaggtcgactgggcgggtgagcacggctccggcttccagatggcgatcgagatcgaagccctcgaccggccgcgtctgctcgccgacgtgtcccgtgtgctcgccgagcaccacgtgaacattctcgcctcctcgtcggggcgcgggagtgatcttgtcgcggcgatgcgtttcgagttcgagctcgccgatccgagccacctgtcgtcgatcctggcgggcattcgccagctcgacggtgtcttcaacgctgcccgagtcgttcccgggcgacgtcgcccacggaccgcgacccagcacgacggccgctgagtcggtcgccgaggcgaccgtgtgtcgcggattcgtcatggatttggtcctacgacgcagcattacggcgtccgtgacgggatattgttgggccaccgacgcatggggagcgtcggaggaacgggcgtgagcccgtccattgctacgacaagggggattgctggatgcaacagcaggcagtagagggcggatcccttcgcagggagatgtccttcgttgatctggtgatggcctgtctcggtgccatcatcggatcgggttggctcttcggcgtgctctatgccgccaacgcagccgggcctgcagcgatcgtcagctcgctcatcgggggcattgcggtgatcttcatcgccctcgtgtacgccgagctctcagggatgctcccggaggcgggcgggatcgctcgctacccggagttcacccacggtccgctggtagggttcgtcggctcgtggggcgcgttcctcgcctacgcttcggtgcccgccatcgaagccgaggcggtggtgcagtacgccgagcactacattccgaagctgaccgggaacaccgcactcgacttcgtcatcgaggcggtgctgttgatcatcttcttcgccatcaacgtctacggcgtcaaggcgttcgcgaaggtgaacacggtcatcacgttcttgaagttcgtcgcaccgacgctcacggtcatcgcgttcttgttcgccgtcggccactggagcaactacacggcgacctcgaccggaggtttcatgccggagggtagcgcgggtatcctcggcgccgtggcgacctcgggcatcgtgttctcgtacctcgggttccgccaggcagtggagctcgctggtgagtcgcgcaacccacagcgtgacgtgcctcgcgcgatcatcacggccgtgttgctcgcggtcgcgctctacacgctgctgcaggtggtcttcatcgccgcgattcctcactccgcgctcgccaagggctgggcgggcctgtcgctgacgtcgccgttcgcgcaggtcgcgtccattatcgggctgggctggctggcggcgatcctgtacgccgacgcggtgctgtcgccctcgggcacggggctcatctacctcggctcgacggggcgcgtcgtcctcggatcggcgcgcaaccgctacctcggtcagctgttccgtcggatctcggacgcgggtgtgccgctctacgcgatgatcgcgacccttgtcgcctcgatcatcttcttgctgccgttcccgacctggcagagcctggtgggcgtgatctcgtcggcgacggtcttcacctacatgatgggtccggtgtcgctgggtgtcttgcgcaagcactacgcagaggcgcatcgtccctatcgcttgcctgcggcctcggtgctctcgccgatcgccttcgtggtgggcacgctcatcatctactggaccggttgggcgacggactggaagctcgccgtcggcctgctcggcggcgttgtcgtgtacctgatcgcctcgagtgctggtcagggggtcaagaagatcgacggggcggcgatccgtcacggtgcgtgggtgatcgtctatatcgtcgcgatgctcgccatggcctacttcggtgcgcaccgcttcggcgcgccgttcgatcacggcaaggggctcatccattatccgctcgatctcgtcgtcgacatcgtccttgccctcgtcttctactactgggcagtggcgtcgggtcgtccgagcacggatacggaggaggccatccagcgtgctgccgagctgcgtcgtcagaccgcggctggcggttccgcagccatgagcggttgagcctcagctcgccattgcgagagggggtcgggctctgcccgacccccttcgtgcgttggcgggccagcaccagccggggcggcggcatggcccctcggtagtatgggcgccgtggaggtctcccggtgagcgtgctcaccgtcatcgtgctggtcctcgccgtcgtcgtggcggtgctcttggtgcttggcctctggcaggtgagcatgctgcgtcgccagatggaggcgtttgcgagcgagtggcgcgaggagatggtccgcatggtgcgcacctcgacccaactcatcgaggaggcctcggccgctcagcggcgggcgcgcgatctcgtcgaggaggccgaggccgatgtcgacgggctcgactgggcgctgcgtgcggtcgtcgagcctgcgcggagcgttcggcgcctgggtcttggggttcggcgcgctcgcgccgtctttcgggagcgtcgtggtggtgaggtgcgccgcgcatgaggcgggtggtgtggctcggtatcggggcgaccctcggggccatcggggcccgccggttggggcgtcttggcgcctcatcggtggatgcgcgggtgcggcgtgagacgcgccgactgcgccgggatctcgcggccgccatcgaggcgggtcgccacgaggtgcgcgtcgccacggcgaacgagcggagccggcgccgcggctcgaggaggagcgggtagtggattcgaatgacctgagacgtgcgtttcgggagtacttcgtcgagcgaggacacgttcccgttccctcggcgtcgctcgtgccgcacgatccgacgctgctcttcacggtcgcgggcatggtgccgttcaagccctacttcttgggcgaggaggtcccgccgtatcgtcgggcgaccagcatccaaaagtgcatgcgcgccggtggcaagcacaacgatctcgatcaggtggggaccacggcccgacacctcaccttcttcgagatgctgggcaacttctccttcggcgactacttcaaggagggtgcgattccctacgcgtggggtctcgtcaccgaggtgctcggactcgatccagaccggctctggatcacggtgcacacgagcgacgacgaggcggagcgcatctggatcgaggcctgtggggtccgcccggagcgcatccaacgactcgacgaggacaactggtggcagatgggggagacagggccgtgcggtccgtgctctgagatctactacgacaagggcgagtcctacggcgcgggcggtgggccggcggtcgggtccgacgagcgcttcctcgagatctggaacctcgtgttcatgcagtacgaccgccacccggacggttcgttgacgccgctgccggcaccctgcatcgacaccggtgccgggctcgagcggatcgtgccggtgctccaggggcacgactcggtcttcgagaccgatctcatgtggccgctcatggaggaggcacagtcgctgacgggccgacgctacggcggtcgcttcggtgcggacgccggtggcgacgtcgggctgcggatcatggccgatcacgctcgggcgacgacgttcttgctcgctgacggggtcgtgccgacgaacgaggggcgtgggtacgtgctgcgtcgtatcatccggcgtctcgtggcgcgcgcgcagctgttgggcgcgaagggtccggtcgtcgagccgatggtgcgcatgaccgccgccgtgatgggcgaggcctaccccgaggtggcgcgcgagctcgagacgatcgtgcagcacgcagcgcgcgaggaggagcggttcgcggcgacgctggcgctggggcgcccgctgctcgacgcggccctcgagggcggctcggttcccggcgcgctcgcgttcaagctccacgacacctacggtttgccgatcgagctcacgatggagctggcggccgagcggggggtgagcgtcgatcgtgccggtttcgaggaggccatggccgcacagcgcgagcgggcccgccaggccgggctcggtaccgaggccgtggagcacccggtgagcgccgaggtgctgcgcgagcacggccggagcgagttcacgggctacgaggccaccgaggacgaggggcgcctgctcgcactcgcctccgaaggcgacgtgctcgtcgccgtcctcgatcgaacgcccttctatcccgaaggtggtggccagctcggtgataccggcacgatcgagggggatggctttcgcctcaccatcatcgacaccgaccagcccgtcgcgggggtgatccgccaccacgtcggagcggtcgagggcgagccggtgatcggggcgttggtgcgggccgtcgtcgacgcggagcggcgcgagggtcttcgggtccaccacacggcgacgcacctgctgcactgggcgcttcgcgaggtgctcggtccgcacgtcaagcaacaaggctccctggtcgcaccggatcacctgcgcttcgacttcacgcactggggaccgctcacgcccgacgagatcgaggagatcgagcggcgggtcgcggccgagatcatccgcgactcggtcgtcacggtggagctcatggatcgcgacgaggcgatccgtcgcggtgcggtcgccttcttcggcgatcgctacggcgacgtcgttcgcgtggtgcacgccggtgagtcgtcggtggagctgtgcggtgggacgcacctcgaccgactcggccgcatcggccacctgcgcatcacgtccgagagctcgatcggcgccaacacgcgccgggtcgaagccgtcgtgcagctcgccgccctcgaggtggcacaccgcgatcggcgactcctcgacgagctcgagcggatcgtcccgggcggacgcgatgggatcggcgagcgcgtcgatcgcatcgtcgagcgtgccaagcgcgccgaatccgagctcgcgcgtgagcgcacgcgcaccttggctgagcgcgcccgcgcgctcgccgagacccggggggccgacggactcgtggtggcgcgcgtggacggtcttgaccagcggggggttcgggagctcgcgatgctggttcgtgaccacgagggcgtgctgggcgtcgtgatcgggggcgtcgccaacggcgtggtcgcactcgccgccgcggtgcgcgagggcgctccctggcgtgccgacgagctgctgcgccccgtcgcgcaggcggtcggtgggggcgtcggtcgagccgaggtggtggcggtctccggtgggcgccgtgccgaagcccttgacgcggcgctcgaggcggtgcggacggcttcgtgagcgaggggttcggcggccgcgctctcggcgtggaccttgggacgaagcgcatcggcgttgcggttgcagagggctcgctcgcgctgccgctcgaggtcatcgacgcgcgggggccgtggcgtgcgaggctcgccgagctggtcgcgtcggtcggtgcgagcgtcgtggtcgtcggtcttccgatcggcctcgatggatcggagggtcgggcggccgcccgggtgcgccagtggtcggaaggcctcgcggagcacctcgaggttccggtcgtgttcgtcgacgagcgcttgtcgtcgcaggccgccgagcgtcgtctcggggccgccggtgtcgacgccaggtcgcggcgcggtgcggtggacgcctttgccgcgaccgagatcctcgagcggtggctggtgacgcagcggtgagagggtggccgaagcggctcgtcgctctcgcgctcgtggtggtgctcgcgctcggggcgatcggggtcgcgtatctcgccgaggcggcgccgagctcgtcgggtcacgaggttgcggtactcatcgagcccgggacgtcgctcgagggggtgtcttccctcctcgcgcgcgagggcgtcgtgcgcaacggcacgttgttcgacctctacctgcgccttcgcggatcgccgacggtggatgcgggggtgtacttcttgcgcaccggggagggctacgccggcgcactgtcggccctgacggcggggccagcaacggtacggctcgtggtggtgccggggatgacgatcgctcagatcgcagccaggctcgccgcactgccggaggccggtcacaacgggggtgcgttcgtcgcggcagcgtctgccgtgcacagctaccacaatcccttcctgcgcggcgcgaggtcgctcgagggcttcctctaccccgacacctacttcgtcgatccggcccagacgccgcacgagctgatccaggagatggtggatcgcttcacccaggaggccctcggcgtgggtctcgagccgggggggacctaccacggtctgagcgcctaccaagtggtcatcgcggcgtccatcgtgaccaaggaggccacggccgcgtccgatgcccccaaggtggcccgcgtgatcctcaatcgactggccgcggacatgccgctcgacatggactcgaccgtgcgctttgcgaccggcaacgagaacgcgccgctgacggcggccgaactcgcctcgccctcgccgtggaacacctacacccatcgagggttgccgccgaccccgatcggtcagccgtccgtggccgccatcgacgcggtgctccatcccgccaccggaccgtggctgtacttcgtcgcgctccgcgggcatcggaccgagtcgttcttcacgacctatgccgcgcagcaagcggcgatcgcgcgctacggagaggccgggtgaggcgcgcggatcccgaactcctcggggtgatcggccatccgatcgcccacagcctctcaccagcgatccacgccgcagcggcccgcgccgagggtcgtcgcttcgcctaccacgccttcgacgtcgagcccgctgcgctcgcggcagcgatcggggggcttgtcgtgctgggagcgcgcggggtcaacgtcacggtgccgcacaaggttgccgctgctgcgctcgtggatcgactcgagccggaggctcgggcgacgcggtcggtgaacacgatcacgatcgaggacgacggcacgctcaccggtgcgacgagcgacgtcgagggcgtcctcacgtccgtgcgcgacgatctcggtctcgaggtcggcgggttgcgcgtcgtggtcgtcggggcaggaggtgcggcgcgcgcgacggtctatgcgctcctccaggcgggtgcggcctcggtcggcatcctcgcgcgcgatgtggcgcgcgcggccgagctcgctcggagccttggcggttccgtcgtcaccgcccatgacgacggggcggcggcagatctcgtggtccaggccaccagcgtgggcatggcgggcggccccgatcccgcgggatctgcggtgccggactggctcctcgatcgtgccggcgcggtgctggatctcgtctatcgcccgagcgtgacgccgcttctcgaggccgcacgccggcgcggacttccggcggccaacgggttgacgatgctcgcggcgcaggcgcgtgggtcctatcggcgttggttcggcgacgcaccgagcctgtcggtcttcgtcggcgcggcccgcgaggccgccgccgagggctgaggcgatcggcgcgagccgcgaacgggctcgccgaggctgcccgggcacgaccggttctggccgtgcgcgcctcgcgtgatgtcacagtcgccccagctgcgcggagcgcctcgactgccctgtcagcgggtcagcgtcgccgagccctgcggtgctcagtcgttcgtcgatgcgtcctggttggcgtcgtccgagacgagtgccttggcctcgtcgagggtggtgtcgggtgcggggacgacgacctcggccgtcacggcgggatcgtcggtcggcgtgccgttcgtccggacgagctcgatgacctgtgcgagcagtcgcgtgaacccgtcggcgtcgtcgtgatcgagggcctggtcgagcgcgtcgtcgagtccgtcgagcgccggtcggagcgaggcaggcacgaggtagacgtggtccgacaagatgcgcaccgccaccgtggcggccgacgtcccgggcgccgggggtgtcgcgggcgccggaggtgtcgtggcctgtgccggctcgctggccgcgatcgccgcgggcgctggcggtgctccgatggcgttcgtctggtccgcaggggcggcaagctccgccttgatctgggcgagctgcagatcgacgtcgttgccctggttgccggccgcgagggctgcctcgatgtcgtccccaccaccgccgagcgctggtgagtcgaggaccccggagtccgccagttcgccgacggcggcggagcgcgcttgcatctcggagatcttgtccttcgcgcgatccatcatcatggtcacgtcggtcatctgatccgacaggccggtgaggccctcgagcgcagcggtggacgccttggcggcggtgtactgcgccttcatggtgtcgcgttgggcgcgaaacgcctcgatcttggcgttgagttgccgtccggtctcctcgagcgcggcctcctgcttggccagctgctcgatctggggcgtgagctggtcgatctggggcttgatggtgctcgcgcgctcgagggcgagccttgccacctgctcctggccctgctgcacggcctggcgcgcctgtccttgcagcttgtcgtactgggcctggagctgggcgcgctgagcctcgagtcgcttctgggacgtgaggacgtcggcgatcgacttacgaacctgctggaggttctcgagcatcttctggtaggacaggtcgagcgcctgggttgggtcctcgaccttgttgagcagtgcgttcgacttctgctggaacacctggctcacacgcttgagcaggcccattggcatctccttcgatgagacccacccgcgcgccacggttcgaggcgcgctaggctccacagagcatggtagcagcagcgacgcagcgttcgtgggccgtgcgcttagcgttctcggtgcctgcttgcgttgcaacgcccaaggcctgaggaggtgctctccatggcgacatcgctcgcccccagatcccgcgggacgacgtgggcgcgccttcgcagctacgacgcgctcctgtggttgctcgccgcggccgtgggcgtcttcggtgtcgtgatggtgtactcggcgacccggaaccaactggaacttgctggcctctcgccgcactactacctcgatcgtcaggcgatcttctgggtgctcgggctgatcgtgatgagcgtcgtcgccgcgctcgatctcgagtggctcggtcgtctcggctactggatctacggtgcggtgctgctcggcctcgtggccgtgttgtcgccggtcgggtcgtcggcgctcgggtcccagcggtggttccagctcggcccgatccaggtgcagccgtcggagttcgcacccatcggcgtgatgttcggtatcgcggcctatctctcgggacgcgatggaccgcggacgtggcgcgaggtggccgtggtcctcgcgctcgggggtgtgccggcactgctcgtggtgaagcagccggacctcggcaccggcatcgtggtcggtatcgtcaccatggtgctcctcgtcatgggtggcgccaccggtcgtcagctcctcgtgatcctggttgccggggtgctcgggatcatcgccgtcgtgcacctcggtctgctgaagcactaccagctcgagcggctcctctcgttcgtgaacccgcagtcggcgacccagacctacggctacaacctggtccagtcgaagatcgccatcggttcggggcacatcttcggcaccggcctcttcaaggggagccaaacgaacctcgcctacgttcccgagcagcagaccgacttcatcttcacggcggtgggcgaacagctcggcttcatcggtgccggttcgctcgtgctggtgtacggcatcatgctggccaggtcgtatcgggtgctgcgttcggcggcggatcgagtctccatgctgctcgtcgccggcgcgatcgcgtggatcggattctcggtgttccagaacatcggcatgacgatcggcatcatgcccatcaccgggatcccgttgccgttcgtctcctacggcggctcggcgatgctcggcttctcctcggcggtgggcatcgtgctctctgccgggtcgaggcgactgcgacgtgccagctgaggagccgccgcagaccgaaggcgcgcccctcgtcgtctgcgacgttgcgagggtgcacgtcgccctcccggagccgttcgcgcggatcgagctcgtgtcccgtcaggccgagcacccgggtcggttgtcgttgccggtgagcgtcgagcaaggtcgtgccgtcgcgctcgcccttgcgcgccgacgcgcaccgcggccgttcacccacgaactcgcctccgagatcgcccacgccgtcggggccagcgtgttgcgcgcgacgctccacggctccccagaggggggcgagtccaccttcgcagcgacgctcgagctcatgggggccgatggttgtcggcacccgatcgacgcgcgaccgtcggacgccatcgttttgtgtctgctcgaggccgtcccagcccccatcctcgtcgaggcaccgctcctggccggcccacccaccgacggctgacgtcgacggttaggacgccggccagtcgagcccgagatccaggctcggtgccgagtgcgtgatccacccgacagcgaggtagtccacaccggtgagggcgacctcgcggagccggcccggacgcaggccgccggaggactcgagcttggcccgccctccgttcagacgaacggcgtcgcgcgtggcctccagggtgaagttgtccaggagcaccatcggcacgtcgagcgcgagtgcctcctcgaggccgtcgaggtcgtccacctctacctcgatgggaaggtcgccgaagcgctgacgtgcggcggcgacgaggtgctcgaggggtgcctgggcgaggtggttgtccttgagcaagatggcgtcgtcgagactgaaccggtggttctcgccaccccccgcacggacggcggccttctcgagcccacgcatgccggggagggtctttctggtgtcgcggagccggcagcgggtgtcggcgatctcggcgacggcccgggcggtcgtcgtggcgaccccggagagatgggtgagcaggttgagcatggtgcgctcggctgcgagcaggacacggttcgatccggcgagctcggcgatgagctgcccgggctcgagcgcgtcggcgtcgtgtgcggaccactcgatggtgggcgcggccgcaccgaggcgcgcggcggtggctcggagcaccacctcggcggtgttggacccggcgaggacgccctcgtcgcgggcccggagctcgagtcggacggtccgttcgggcaccaaggagccggtgatgtcgccacgctcgccgaggtcctcgtcgagggcgagcgcgacgaggcgttccaggctggaggcgcggagcgccgtcatgggcgcagctcccgggtgacgcggtggtcggcgtcgaccgcgagctggtagtggggatcctcgtcgatcgcgtcgcgacgggcatgcgcgcccacgctgccgcgacgggccgccgccccagccagcatcgcaccgacgagccacgtcgccccagcctcgctgggatcgccgctcgactcgccagtgaggccggcggtcttgatcgtccggtacgccgcggcgagcgtgtccccgtcgcgcagcggaccgagggcgagggcggcaagggcgcgcagacgcgcgagtgggagtgcgggacggcgcacggggcgtggtagagccgtcggcaggggtgtcgggcgcggcaggtcgccctccgtgatggcttcgccgacacgccgtcccatgacgacggcctcgaggagcgagttcgaggcgagccggttggcgccgtggagtcccgtgacggcgcactcgccgacggcgaagaggcccgggaggctggtcgcgcccagctcatcggtcgcgatgccgcccatggtgtagtgcgccgcgggacgcaccgggacgagctcgcggagcgggtcgaggccgagcgtgcgagccgcggcgacgaagctcgggaagcgatcgacgagcgatggcccgatgggccgcgcgtcgaggaaggccggggtggcgtgcacgctgaggtgcaaggcgagctggtcgcgggtggtgagttcgcgcgccgggaggtcgtcgacgagggacgtaccgtcggcatcgacgaggagggcgccggccccacggagggcttcggtggcgagcgcgaagggcgcacgtgggcccccgatggcggtcgggtggaactgcacgaactcgaggtcgaccaccctggcacccgcccaggcggccgcggcgatgcccgtgccgagattggtcggggggcaggtgaaggcgtcgaagagcgcgccggcccctccggtcgcgagcacgacgcgacgagcggcgatggcgtcgaggcgtccgtcggcggtgcggacccaggcgccgacgacgcggccatcgagcgtgatgagctcgacgagcgtgccgtcgaggcgcgtgatggagccgagccgagggcggagcgccgccatgacggccgcaccggtggcgtcgccggccgcgtggcggatccgtgcgcgccggtgaccggcttcaaggccatagtcgggtgcgaaggccacgccctggtcgccaagccagcgaatcgcgctcggtccgtcggcgaggatgctcttcgcggcgcgctcgtcgaccaggtgggcgccggcgtcgatggtgtcggcgagatggtcgccgatgtcggggccgtcgacgggggctgcgatgccgcccttcgcccagtcgcttgaggtcgctgcgcctcgaggtgcgacgatggcgacgcggagcgtgggcgccacgctgagggccaccgaggctgcagcgaggccgtcgcctatgatcacgacgtcgaagctgctcaccatggtcgcaccgtgggatcgagcatcgcgagtacgggtcggcgtgcggcctcggcgacggccggatcgagtgtgacctcgccctcgttgcgctcgagggcgccgaggagcagctctggcgtcacccgctgcatgtaggggcacgtggcgtcggcgcgcagcggttcgaagctgatcgagttctcgcgccggagctggtggagcacgcccgtctcggtggcgacgatgacgcggcggtgctgctcggcgcgggccgcctcgatcatctgcgtggtcgacaggaggcgcacccgttggcgccacgggtcgtcgacgagcagggcgctggtggtgcagccgcactcggggtggacgtagacgaccgcctcggggtcgtcggcgagcgcggtctcgagggcgccgggctcgagcgcggcgtgtacgtgacactcgccgtgccagacgtgcatgcgttctcggccgagcgtacgcttgacccacgagccgaggaagacgtcagggaggaagaggacctcgcggagggtggggatggaggcgaccacctcgagcgcgttcgcgctcgtgacgcagacgtcggcgagcgccttcacctcggccgaggtgttgacgtaggcgacgacgatggcgtcgggatgggcgctgcgccactgccgcaggtcgtcggcggtgatggcctcggcgagggagcagcccgcatcgtgtgccggcaggagcacggtcttcgtcggcgacaggagcttggcggtctcggccatgaagcgcacgcccgcgaagacgatccgccgtgccggatgctcggccgcgatgcgggagagctggagtgagtccccggtgacgtccgcgaggtcctggacccacggtggctggtagttgtgtgcgatcaggagtgcgtcggtggcgagggccttcgcggcacggaggcgctcgaggacctcggccgagggagtgggcccgccgacaccgagggttggcttcgtcgcggtcgatgcggaactacttagtctcatcaagagacaaagttagtgggtgacgccatcgccacagctcggctggtcggccggtaccggtacggatccgaagtccgacgggctcgatcagcgtggactcgacgaggcgcctgcgcgcgttgggcgcgtggacctgttccccggtgagggcctcgatgcgcccgatgagcgcggggagagtgaaggtggcggcgaggagcggggcgaggacgctcgttcgatcgaggaggtcgcggaggaggagcaggccacggccgacgagggcgagttcgtcggcggtgagcgtgctgggccgcgggctgcgggcgctgcgatggtcgagggccggcatgaggtcatagacccggaggcggtcgacgcccgaggcgttcgaggcgagcgaggcgaggaggccgacctcggcgtagcggatggtgctgggatcggcggctgaagccgtgagggcatgcgtcggcccgggatcgagaccgacacgagcgtggaaccagtcgtgcagcgcatccgtgagatcggcgcacggaggtgcgagggtcgtcgtggggaggtggccgtcgagggtcaggaccacgggatcctcgccctcgacggtgagcgcgatcagggtggcttcgaggcgccagcagggcgtctcgttcatggttgtggcaattcctgcaatttgcttgacaatagcgccgggctgtggcatgctccatatgcgcaggtgcgcatatggcaatgctccgagcgtccggtggaggaaccggggcgaggagcggagccggcggggacggtcgacatcggggctgggaacctcccgatgaggtgccgtcgtcggtgtcgtacctcgcgcaggcaccggggggtgcatggatcgcaagatccgaggtgcgtgttgtgacaaggggggactcgtggacgaaccagcagtggtcttggactgcaccggcctgcagtgtccgatgccggtgatcaagacgtcgaaggcgatcaaggacgtcgaggtaggggcggtgctcgagctgctcgcgaccgatcctggcgtcgagccggacatgcaggcctggacgacccgtacgggcaacgagctgctcaaggtcgaccgtcaaggtgacgtgttccacgtcttgattcgtcgcgccaagtagcgctgcgcggtcggtcgcggtccgagcgaccacgtggcgggcacgagccgtgtggcgcgaaaggctgcgtacggtctcgctccgcgcgtgatcggtgctcacgcgacggcgagctgcgatggtggcgtctcttgctgggcgtgcgcgaccaccatgacgggttcgcgtccatggaggtggctggccctcacaatttccgtcagttccgtcagtcgagtcgctgcccgcgaggcgggccaggtggtgaggaggcaggcatgtggaccaacgagggtgaaggaaagatcgtctacgtccagacgcacgggatcaacgatccagggcgctcggcgacgccgttcttcctcgctgcctcggccgcggcgatggaggtggaggtcggcatctacttcacgatgtacggtccgcagctgctgcgcagggacatcgtggacaagatcggaccgaagggcgatcgcgggcagccgctctcgtacttcattcggcaggcgaccgatctcggcgtgcgtctgtgggtctgtcagccttcgctggacctgaacgacctcaccctcgaggagctcatcgacggtgtcgagatgatcggcggggcggccttcaacaacctggccatgaccgctgacgcggtggtgtcgttctgatgcccacgttgagtgccgacccctacctgaagcgttccgacgccaccggctatggcgaggtcgatcgtgcgaccaaggaacgcctcatcggcgaggtgttcgaggatccgcggtttccgcactacctctacgggtgctacgagtgcgggatctgcgtggcggcgtgtccgtcggccaggttctacgacttctcgccacggcgcatcgcgcaagctgcggccaggcgtgacgtggagctgctctatcagcagctcgaggaggacgtctgggagtgctcgcagtgtttctcctgcctgcgctgcccgcgaggcaacaaccctggaggcatcgtgacgatcatgcgcgaggtggcggtccgtgagggcctggcgtcggccaaggaggcgctcgcgggctactcccggatcatctacaagatcatgtcgacgggcacgcaggtctcgcccgacatgctccagcccgacgccttccccgactggggaccggaggtcaaggacgtctcggtcaacctcgacctgtggcgtcggatgctgccgcccgagacgatgcacaccaccaccactgggtggcaggtcgccgatcggacgctcgtcgagctgtacgtcatctggttggaaacgggggcgctcgacatgatcgcccaggtcgacaaggggatccacatgatcctcgccgaactcatggaggagcgactcgaagaggagggcatcgagctatgaccacgagcgctgtcaacgtcatcctgtcgcgcaaggagcggttcgagcgagagcccgatcgccgctccgaggacttccaccatcacctgttcgagctcgaagccgagggcgaactggtcgtccagcgcgtcgccggggaggtcgtcgaggtcccgaccaagtacgggatcgccaagcggatcccgaaggctcacctctggcatcacaagtcgtgcggccagtgcgggcacatcccgggctactcgacgtcgatcttttggatcatgcgcaagctgggctacgactacctcgatcccgaggatcagacgagctgcacggcctggaactactacgcctcggcgacctcgaaccaggccgcccaggccgccgtcgccgtgcgcaacttcgctgcggcgtacgagaccgggttcttcccactgatccactgcggcaccagctacggccactacaaggaggttcgctccgagctcctgcacgacgcggcgctgcgtgcccaggtgcgcaaggtcatggagcgactcggcaagcagctcgtgctgcccgaggagatcgtgcactactcggagtggctgtacgcggtgcgagacgagatcgcccagcgggcggttcgggacgtgtgcaacgtcgccgttacggtgcatccggcgtgccactactacaagctggtcgagggcgacgccatctacgacccggatgtctaccacggtcagcgcacggcggcggtgtcaggcctcgtgcaagccctgggggccgaccttcggagctactcgacgttcttcgactgctgtgggttcggctttcgccacatcctggtgcagcgcgacttcacgcggtcgttctcgacgctgcgcaagatcgaggtgatgcgagcggaggccgaccccgacgtcgtgctcacccacgacaccggctgcgtcacggccctcgacaagagtcagttcgcagcccaggcgcacgagcgcaacgtgggcgtgccggtgatgagcgaggcgcagttcgccgcgctcgccatgggcgcccatccgttcaaggtgtgccagctgcactggcactcgaccaactatcgaccactgctggagaagatggggatcgactggcgggccgcgtgggccgagttcgaggaggacgccaagcgcctctcggacggtcgtcagcagttcctgacctgggccgacgtggatgcgtgaggggggtacatggatcgaattgtcgtgatcggtggtggcccggcgggcctgtcggcggggatcgccgcggcggagctgggtgcacccgtgacgctggtcgagcgcaacgccttcctcggtggacggccggtcgaggagaactacgcctctatcacgccctatctcgaggacgcggcgatggtgatggggcggatggaggagcggctccgggccgccggtgacgtcgaggtgctcttgtcgtccgaggtggtgcacgcggccggtgacggaccctacgggctcaccatccgtacacccgatggcgaacgagtccaagaggcctcggccgtcgtggtggcgacgggcttcacccacttcgatccgggccgcgagacgcagctctatggctactacgagttcccagacgtgatcgcgctccaggacctcgaggccatgctgaaggagcaccacgtcgtgcgcccctcgaacggggaggccccgcggcgcgtgtgcttcatccagtgcgtcggcagccgcgatcgccagatcggcaacgagtactgctcgaaggtgtgctgcggtgtggcctcgaaggaggcgatcgaggttcgccagctcctgccggattcggaagtgttcatcttctacatcgacatgcgcatgtacggctactgggagcgccagctctactggccggcccaggaagagcaccacgtccagtacgtcaagggcatcgtgaccgaggtcctgccgaaggacgggcgcctgctcgtgcggggcgaggacaccaccatgggtcggccgatggagacgctcatggatctcgtggtcctgtcggtgggcatggagccctccccgggaacccgcaagatcgccgggatcttggggctcgcacagaacaagttcggcttcatcgaggcccagcagcccccgctcgacacggtcgggacgtcgcgtcccggtgtgttcgctgccggtgcggctctcggaccgagcgatctcgaggactgtgcctcctcgggtggcctcgctgcggcacgcgccgtcgcgctgtggcgtcagcaccagaccgtcggcgcgcgatgagtgtcgtgagctcgcagctgtgcgacctcgagagcgtgcgtgcgttcttggaggctttcgacgagcaagccgggagcgcgacccgcgctcggctcctcgagcgggcgcacgagcgtcgagcacgggtacgtcgagcgctcgagctcggtgacgccgatctcgtgctcgagacccaagtggcgagtcggcggcgacggcggacgctcgctgggctgcttgcacgagacgagctcgaagcgctctgtcgcgatgtcgcagccggtatgggcgaggcacgcgcgctcgaggacgatcctcggcgcgaggttgtcgagttcgttcgcgagctcgtgcacctgtgggaccctgcgaaggtcgcgctctggacgtcgtgggtctgggcccccgacgacgagaccggcgcgctcgcgctcatggtggaggacccagcggcgctcctcggtgccgacgatgccgaggtggccgcgcgggtgggcgaggcgagtcgctacctcgccgccgtgctcgaggcggcggggctcggtgtcgacgctgccgatccgttgagcttcgacgtggcggccgctgccgtctgggccacctacgcggtgacggtggtgcgcctgcgcatgaccaaggagttcacacagctccttccgccggccgctggctttgcggaacgagcactgggactagcgagggagggctgatgccggtcggagggcgcaaggtggcgcctcaggtggtcgaactcgaggaggccagggtcacctcgaccatctcaggcagggagtgggacgtctcgggcggcccgagtcgcatgctgatgccgcgggtgctcaccgactacacccagcgcggcttcgaggcgatccgtgcgctcgccggtggcgagagcctcgagtggtgctacggctgtggcaagtgcgtaccggtgtgcccggtcgatctcgtgggcgagtacgggccgcgcaagctccaccgcatggtccagaccgggacgaacctcttcgaggccgatcagctctggatgtgcacgacgtgcggcaactgcctgcgcgtgtgcccgaagcaggtcaacatgatccagatcatgccggcggtacgcgaagtggcggtcgccgacgggaccatcccgaccgagctccaaggggtcatggagaagaccttccgctacgggaacgccttgggcgagaatccccggcggcgccatgcctggacgaagggcgcgggcgtcccggtgcgggtgctctcgcaggatccgagcccggtggacgtgttgttctacgtcgaggactactggagctaccacccgcgcggacagcaggcggcacaggcgttcgcgcgtgtgctgaacgcggctggggtcgactttgcgatcctcggcgccgaggagaagaccatcggcgactcgcagcggctcgccggcgagaaggggctgttcgaggccctgatggaggacgtcgtggcgacgctcgagcgctacgagttccgacgcatcgtcacgccggacccgcacggcttcaacgcgctcgtgaaggtgtacccctcgtatgggcatcactacgaggtgctccactacacgcagctcctcgcgccgctcatgtcgtcactcgagctgacgaacccgatcgacgcgaaggtgacgttccacgatccgtgctacctcgggcgtcacaacggcgtctacgacgcccctcgcgaggtgctgcgagcgatcccggggctcgagctgatcgagatgggtcggtgccgtgagaactcgtactgctgcggtggcggtggcggcggcatgtggctcgacggcttcaacggcaaccacctctcggagcgcctgtcggagcgacgggtgcgcgaagccgcggcgaccggtgcggacatcttggctgtgtgctgcccgtacgaggtgtcgcgcttcgaggacgccgccaagtcgaccgggaacgaacatctccgcgtgctcgacatcgccgaactcgtggacatggcaatggcgccggcgctcgctggccaggttgggtgaaggaggggggatggacatcgtcgtcgtggtccgtcagctggcggacctcgtggaggaactcgaggtcaacgacgagggcacggatatcgaccgtgacttcgtgaagttcgtcgcgaacgagtgggacgaggccgcgctcgaggaggcgctgtgtctcaaggaagcggtcggggggaccgtcaccgtggtggccctcgacgagccggacgtcgaccagacgctctatgccgccgcggccaagggggccgaccgggtcgtcaagctgaccgggcacgatcccgacggctgggtgcgcacgcgcgagcgagccgctcgggtcgctacctggctccgtgatcagcatccggacgtggtcctgacgggcgtccaggcggccgacgacctcgacgggcagatggcgggcgtggtggctgcgtatctcggatggccgcacgccgccgtcgtggtggtggtcgaacccgccggcaacgagctcaccgtgacccaggagctcggcggtggcacggtggcgacctcgacgctcgccatgccggcggtgctcgggatccaggcggcgcgccaggcaccgcgctacgcgcccatctcgaggatccgccaggcgcagcagtcgacgaccatcgaggaggtcgagatcgacgagccggcgatcggcgccgtcgcatccgtgcgtcgtctgttcccgccaccgtcgcgcggtggcgctgagatgctggaggggtcggcggccgaggtcgccgacaagatcgtggagatcttgcgggcccgcgggctcgtgcgcgcgtaaggggggttcagatgtcggtggcagtgttggtggtgagcgagcgggtcgtcggcgaggttcccgacgtcacgttcgagctgctcggcaagggccgtgagatcgcctcggcactcggtggcgagctcgccatcgcggtgctcgggcaccaggtcggcgagctcccgttcggggcagccgacgtcgcctacgtggtcgacgatcctgcgcttgcgaactacgcggcgagcgcggtcgaggcagcgctcgctgccgtcgtcgaggccgcgtcgccaaaggtcgtgctgatgagtacgggcacggtcgggctcgatctcgccgcgtcgctggcggctcggctcggcgcgccgatggcgtcctatgcggtcgacgtcgcgacggaaggcgacacggtggtcgcgacgagtcagctctacggcggcaagcttctcgcagaggtcgccctcgagggctcgccggccgtcgtgagcgtgatccccggcagcttcgcggccgatgcgggtcgcgtcgggggtgcgccgcgcatcgagaccatcgccgtgtccctcgatggtgctggtgcacgaggcgagggtgtgcgcgagcccgaggcgagtggcgtcgacatcaccgcagcggatctgttggtgtccgtcggtcggggcatcggctccaaggagaacctcgagctggtccaagagctcgccgatgcactcaaggtgccgctcgcggcctcccggcccatcatcgaccagggctggctccccaagccgcatcaggtcggcaagtcgggcaagaaggtcaagccgcaggtctacctcgcgctcggcatctcaggggcgcccgaacacctcgaaggtatgcgctctgccgggaccatcatcgcgtgcaacaccgatccgaaggcgcctatcttcgaggtcgcacactacggcacgacggtggatctgttcgatctcgtgccggagctgaccgagcggctctaagggtgagcatggtcgcgctggttgagacgaggccgatcttcggcggagagacggagacggccaagctcgtgttctacgcgctggcgctcatcgtcatcgtggtcttcttctgggggctcgctcggcgagtgcgggcatggtcgcggggtcgccggcccgccggttggcactggctccgtcggcgagaccctgccgacatcgccgacgtcaccgagcgtccgaaggtcgcgtcgtcggtcgcggtgatcgcagccaacaagacggtcacgaagacgaagcactcggtggggatggcgcacctgttggtgttctggggcttcatcggcctcttcgtcgccacgtcgatcctgtcggtcgactacgacatcctcggcaacctgtcgcggctgatcgtcggccacaccgtgagcttcttccaaggtccgttctacctgggctacaacgcggtcttcgatcttgcgggcctcgcggcgatcgtcgggacgctcctgctcgcgctgcgacgctggttcagcccggagatccaactcgacctgcaccgcgccgagcagcccgagggaggctactcgcgcgcgaagatcgccctcggcgaccaggtgttcatcgtcgggctcttgctgatcctcctcaccggtgtggccatccaggcgctccgcatcgatggcgagggctttccgagtttcgagcgctggacctggctcgggtggctggtggcgaagctcttcgtgagcctgggtgtcggtcgggttgcggctcgtcacatccacgcctggctctggtgggtgcacgtcgggatggcactggcgttcatcgcctacatcccgttctcgaaggccctgcacatgctgtcggcccctgccaatctcatcgtgcgcgatcccaagcaggttcgccagctgccgccaccgcccgagggcaaggtgggctacagcgagctcggcgacttcacgcccgccgaattgctctcgctggacgcgtgcaccaaatgcggccgctgccatggcgtgtgcccggcgcggaccgccggcgcgcccctctcaccccgtgacctggtgctggatctgcgttcctggctcgatcgggcccaaggcatcgagctcctgctcgactcggaggatcggcccaccccgaccggcccacgggccccatcggggccgctcgcaggcaacgtcgtggccgagcgcgtgctctggtcgtgcacgacgtgcatggcgtgcgtcgaggtgtgtccggtgggcatcgagcacgttccgctcatcgtccaactgcgccgccccctcgtcgacgctggccagatggacccgacgcttcagagcgcgctccagaacatcgcccagcaaggcaactccttcggcaagtcctcgcgtatgcgggcgcgctggaccaaggggctcgagacgccgatccccgatgcgcgcaaggagccggtggagtacctgtggttcgtgggtgactacgcctccttcgacgagcgagtcgcggagctctcacggaccttcgctcggatcttgcagggagcgggcgtctccttcggcatcctctacgagggtgagcgcaacgccggcaacgacgtgcggcgcgtgggtgaagagggcctgttcgagatgctcgtcgaatcgaacttgcaggcgctctcgcaggcgacgttcgagacgatcgtcacgacggacccgcacagcttgaacaccttgcgcaatgagtaccccgccttcggtctcgacaagccggtgctgcactactcggagctgctcgcgaagctgatctatcagggaacggtggagccgaggcagctggggttgcgggtgacctaccacgacccgtgctatctcggtcgttacaaccgtgtcttcgatgcgccgcgtgccgtcatcggcggtctcggctgcgacctcgtcgagatgccgcgcaaccgacagggatcgttctgctgcggagcgggcggcgggcgtatctggatggacgattccttcttggccgagcgcccgagcgtgaaccgcatcaaggaggcccttgcgctcggcgtcgacgtcttcgtcgttgcgtgcccgaaggactacgcgatgttctccgatgccgtgaagagcgtcggtgccgaagggacgttgcgcgtcatggacatcaccgagctctttgccgaggccgtgctcggggcgcctgcgctcgaaggggcgagtgagtgagcgatggcggcgagttcatcctcacgtgcttcgtgtgcggcgagcaggggagctaccggagcctgcacgcgcaccttgtcgacgcacacccggaactcgtcgtcatcgaatcgggtccgcgaccgagctatgcgcttcgctgtccggtgtgcggcgaggcctaccgtcaggcgatcaagcgcgggcgggccgatcgcgacttcgtcgccgcgttcgaacgcgacgtgcgggtggtcggcatggacatcatgctccagcacgtcatcggcgagcatcccgatgcagtcggcgtcgacctcgacgcgttggcgacggatgccgatgagccggaggagtgaggggagcgagcccccgcgcgctcgtggagcgatcgtcgtcgcgggaccgcagcgagagcgcagaaccgagtctccaagagaggaaaggatggattggcatggctgaggtgcgatcgtgcaacctccccgaggacctgtactacctcgtcgaccggcacgtctgggttcgcccggagggtgacgtgttggtggtggggctcaccgatgtggcccagaacctggcgaagacgatcatctcggtgtcgctgaagcctgcgggcaagccggtgaaggctggacgctcgctcgcgaccgtggagagtgggaagtgggtcggcccggtgcccgcaccggtggacggcgaggtggtcgaggtcaatggtgcccttgcgacccatcctggcctcttgaacgacgatccctacggcgagggctgggtcgcgaagctgcgagcagacgccttcgatccggctgctgccggtctcgtcaccggcgatgagggcattgcgcgctacagcgccttcctcgaagagcaggggatcagctgcggctgaggtggcgcgatgagtgagacctgggcgggctgcgaggtcccgccggagctgcgctacgacttggatgccgacgtgtgggttcgcttcgagggcgagctcgtgcgactcggcatgaccgatgtggcgcagtcgcgcatgggcaagctcgttcagctgtcgtggaagcgcgtcgggcggacgatcacgcggggacgacccctctcggtgctcgagagtgccaagtgggtcggaccgatggtctcaccgctgacgggcaccatcgtcgcgacgaacgaagccgcattcggtcgggacgtcgcgatcgcaaaccgagatccctatggcgacggttggctctatgtcgtcgagccaacggtgcctgctgagttcgacgccttggtcgacggacgaaccgcgttcgagcactaccgacgtgtgatcgacgagtccggattgcgctgtttccgctgtgaggacccggtgatattcgtggatgaagatccttgaatgatccctgatcatggcgtagactcaccaggtgaacaccgcgggggatttggtgttcacctggagggtgatcgcgttggacgagcggttcagagtcggtgcggtcgtcgcacgctgatcgagtaggggcatggaggctcagtcaacgacacaagggtgacagaggggcatcgaggcgtcgcgggcgtggcgcgcgtggcgcgcgacccggaggagccgttgcggttgaatccgacgaccacgacggtagccctcccgaagagccgatcactacggcgcatgccgcagcggaacggttcggcatcacagagacaggtacgggttgtacgaagggggaaccatggcaaaggatgacggcacccagtcgatggcgatgatctgctggagttccgatctcgatcgggtctggccggtcttgatcctcgcgaccacggcagccgcttccgggctcgaagtggacgtgttcttcacgttctggggtctgcgagtcctgcagcggtcggacgttcgcatcacgggtgagaactggaagcagaagctcgagtcattgatggatccgggctcgaccgatcgccttcgactcgggaagttgaacatgggtggcatgggcacgaagatgatcaagatgctggcggacgagcacaaggtgtcgtcgcccaccgagctcttggagatggcgctcgatctcggcgtgcgcttgcatccgtgccagatgacgatggagctctacggcctgtcgaaggacgacttcatcgagggcctgcagcctcccattggagcggcaagcttcatcaatatggctgccgaagccgacatcaccctgttcatctagtgctgagcgtcgccgtcgtcggtgacgaaggggtggtcgcgcgcgtagtgcgcgccgcctccccattcggctgggaggtaacgagcgaccttggggctgccgatgtcgtggtcgtgccggccggcgaccccgaggcacttcgagcggtcggtgctcgccgtgcccgaggcgaggcgatcgtcgcgatcgcctatgtcgccgagccagatcagctggcctggcgcgcagccgagcgcggcggtgcggatcgcgtcgtcaacgtcggtgcgttgacgaagacgcttcgcgaggtgctcggggatccctcgcgaggcgtcaggcgcctcgtcgtggggcacgtcgaggacgtggcggggcggttgggcctcgtgggcgaggtcgagatcgacggcgcttcgttcatggtcctgcgcgtcgagggacgatgggtctgcctcgaggcgacctgtccgcatcagggagcgcgtcttgccggggtcccgtgcgaggagggtgtgctgacgtgtccggcgcacggctcgcagttctcgtgcgagagcggggagcgcgtgcgtggtccggctgaccgggcactccgttcgctcgctgtggtggtggaaggatcggagctggtcgtacgtgggggaggggttggctgactcacgaggggtcggtacccaggcgcggtattcggctggatggtccccagtggtcccgggccggtcagcggaaccacttctgtcgtatgttgccccgtgcggcttgtgaatcgattgacatccaaaggggcagcgagactcgcaaggcgtccatggcaatgggactcccattgggcagcggctcccggtgacaaggttccgcttgccccggaggtcatggtgcagggaggtgatgccgagcaccacgatctggggagctagtccctatagctgtgtcgcgggtgggtcacttctgaccggtgatcccgggtcaaaagaaggccggtgcctacacacccccgcctgcgcggggagcacctcgccagcaacgtcacggaccacaccgaggtcggatcacccccgcctgcgcggggagcaccgaaatccagttgagccaggcgcaagttcaggcggatcacccccgcctgcgcggggagcaccccaacgcactcctcgtccgcacgcccgaggagggatcacccccgcctgcgcggggagcactcagtcaacgcggccagccgcgcgcaagtacggggatcacccccgcctgcgcggggagcactcgacggtgatcccctcaatctcggtctggccgggatcacccccgcctgcgcggggagcaccagaacctggccatccagcagtcgagcgtcgccggatcacccccgcctgcgcggggagcactccgtcatcgcgtcctttcttgagtcctgctgaggatcacccccgcctgcgcggggagcaccccgccgcgaccgacagccgcaggcgatcttcgggatcacccccgcctgcgcggggagcacgacgtgggtgcccctcaccgacgcgagcgggtcggatcacccccgcctgcgcggggagcactatctatccaccgaacctggcgagcgcccaggtggatcacccccgcctgcgcggggagcacagcttgccctcaatctccagcaatccacgtaccggatcacccccgcctgcgcggggagcacagatcccacacaaggacgccctcggggagctggggatcacccccgcctgcgcggggagcacacgcggggtggtacggatccatcctcaacgcgcggatcacccccgcctgcgcggggagcacacgaccaccaccacgtcgtcgggcttcggcttcggatcacccccgcctgcgcggggagcaccacgcgcggattgctcatgtaacgccacgcggcggatcacccccgcctgcgcggggagcaccgaccatcagaagcttcggttggcgaccgagaaggatcacccccgcctgcgcggggagcaccgctttgcagcggcgtgaggccgaaggtactgcggatcacccccgcctgcgcggggagcacaaaagcccgacggggagtattgcatgcgacgccggatcacccccgcctgcgcggggagcacacccgtgaagagatgcgctcgtgggtagagcgcggatcacccccgcctgcgcggggagcaccggtaatgcccacttctgtctcctttctgctcacggatcacccccgcctgcgcggggagcacctcacctgcgcggcgcgctgagccaggaatgtcggatcacccccgcctgcgcggggagcacttgggcagctcaggacagtagacctccgctgcgggatcacccccgcctgcgcggggagcacatcgcccttggccttggccttggctgcctcagcggatcacccccgcctgcgcggggagcactcggcgtccttcgccacccagttcgggaggtgcggatcacccccgcctgcgcggggagcacacggtggcctgggggctgtcgccgggctggatcggatcacccccgcctgcgcggggagcactacttgaccaccatgtgcagcacacagataccaggatcacccccgcctgcgcggggagcacgggtcgccagcgcggagggcgtcgaggatcgggggatcacccccgcctgcgcggggagcacacgtgggacctccagatcgccggacagacgaccggtgggcttccccccatttgcttgacagtctgaatttaggccacggccacctcccggcaggcccaggagagctcgtactcgacgggcggtaggtacccgaggcttgagtgcaggcggaccgtgttgtaacggtgaatccagctagcgatggcagagcgagcccctgagaggttcgcgaagcggtagcgagccaccagctcgcgcttcaagctcccgaagaaggactcggccacggcgttgtcgtagcaggtcgcgaccctccccaccgactggcgaatgccaagggtcgcgagcaggctccgtaccttccgggagaggtactggctgccgcgatcgctgtgaaagatcgccccagccaggctgccccgagtcccgagtgcttcgcggatcgcctcgaccaccaggtcatcgggcatgtgacgcccaagtgaccagcccacgatgcgcctcgagccaagatctgccaccgtggcgagatagcagaacccctcatcggtgcggacgtaggtgatgtcgctcacatacctgcgcttcggctcaccaggagcgaagtcctgacggacgaggtccgggagcgctgcgtcctctccccgcctcgtcgtgactacgaagcgccggcgtgggcccgctgccatctcgagctcgcgcatcaggcgttccacccgcttgtggttcacgcagaacccgcgccgtcgcagctcgtgggtgatgcgggggctgccgtaggtgccgtcgctctcgtgccagatggcgcgaagctcgctcgcgagcaccaggtgctcgggatcctcgcctcggtcccgacggtgtcgccaggcgtagtaggcctggcgagagaccccgatgactcgtgggcttccccccatttgcttgacagtctgaatttaggccacggccacctcccggcaggcccaggagagctcgtactcgacgggcggtaggtacccgaggcttgagtgcaggcggaccgtgttgtaacggtgaatccagctagcgatggcagagcgagcccctgagaggttcgcgaagcggtagcgagccaccagctcgcgcttcaagctcccgaagaaggactcggccacggcgttgtcgtagcaggtcgcgaccctccccaccgactggcgaatgccaagggtcgcgagcaggctccgtaccttccgggagaggtactggctgccgcgatcgctgtgaaagatcgccccagccaggctgccccgagtcccgagtgcttcgcggatcgcctcgaccaccaggtcatcgggcatgtgacgcccaagtgaccagcccacgatgcgcctcgagccaagatctgccaccgtggcgagatagcagaacccctcatcggtgcggacgtaggtgatgtcgctcacatacctgcgcttcggctcaccaggagcgaagtcctgacggacgaggtccgggagcgctgcgtcctctccccgcctcgtcgtgactacgaagcgccggcgtgggcccgctgccatctcgagctcgcgcatcaggcgttccacccgcttgtggttcacgcagaacccgcgccgtcgcagctcgtgggtgatgcgggggctgccgtaggtgccgtcgctctcgtgccagatggcgcgaagctcgctcgcgagcaccaggtgctcgggatcctcgcctcggtcccgacggtgtcgccaggcgtagtaggcctggcgagagaccccgatgactcgtgctgctgccgctacagagaagcccttggcctcctggcgggagatccagtggtagcggctcactgtcccccctccttcacccagaaggccatcgctcgcttgagcagctcgcgttccacggtgagctgcttgacctggcggcgcagccgtgtcagctcctcgcgctcggcgctcgtcaggccctctcgctcacctcggtcgatgcgttcctgacggacccagttaccaagggtctgctcgttgatgccaagctcacgggcgacgtcagcgatggtgcggcgctggtcgagaaccaacgctgccgcgtccttgcggaactggctcgggtagcggccgcgtcgtcgtccagcggggccgtcgcccggtggtgggttcggtgtctggctcatcccttcctcctatagcaggtgtcaacctggaggggggaaggccatcgtgctgctgccgctacagagaagcccttggcctcctggcgggagatccagtggtagcggctcactgtcccccctccttcacccagaaggccatcgctcgcttgagcagctcgcgttccacggtgagctgcttgacctggcggcgcagccgtgtcagctcctcgcgctcggcgctcgtcaggccctctcgctcacctcggtcgatgcgttcctgacggacccagttaccaagggtctgctcgttgatgccaagctcacgggcgacgtcagcgatggtgcggcgctggtcgagaaccaacgctgccgcgtccttgcggaactggctcgggtagcggccgcgtcgtcgtccagcggggccgtcgcccggtggtgggttcggtgtctggctcatcccttcctcctatagcaggtgtcaacctggaggggggaaggccacggatcacccccgcctgcgcggggagcactacttgaccaccatgtgcagcacacagataccaggatcacccccgcctgcgcggggagcacgggtcgccagcgcggagggcgtcgaggatcgggggatcacccccgcctgcgcggggagcacacgtgggacctccagatcgccggacagacgaccggatcacccccgcctgcgcggggagcacttgagggtggcgggtgaggtaccccaatgcgagggatcacccccgcctgcgcggggagcacgagggtgacgctctcgaccggatcgcggacctcggatcacccccgcctgcgcggggagcacggctactcagtggtcagtcttgaggagaccccgggatcacccccgcctgcgcggggagcacccgtcggcgacctctctggttgccttgtatatcggatcacccccgcctgcgcggggagcactcgaacagcacgagcgacgagccgacctgcaacggatcacccccgcctgcgcggggagcacctaacgtcacatggtatgtggtgatgctcaggaggatcacccccgcctgcgcggggagcactgcgataagccatggggagctgtcgaccaagcgtggatcacccccgcctgcgcggggagcacggcctcaccggcctcaccacgacccgccaagtcggatcacccccgcctgcgcggggagcactgctgaactcgtgatcgtgttccccgccaagtaggatcacccccgcctgcgcggggagcaccgaagtcccagctcaggggcactgggggaaaaaggatcacccccgcctgcgcggggagcactgcccgccgatcccgtagccatcgaccggatcgggatcacccccgcctgcgcggggagcacacctcgttgaccccgaggttctccacaatcgtcggatcacccccgcctgcgcggggagcacctcgctcctccctcttcgtcctctcgtccccacggatcacccccgcctgcgcggggagcacggtaggggccgtgctcatcgctgagggcgctggggatcacccccgcctgcgcggggagcacccgttcgttgcccggggcaacgcagcccactggggatcacccccgcctgcgcggggagcaccgccgttaccgatcacgatccaaccgggaagcaggatcacccccgcctgcgcggggagcactcgcgttgatgacccggacgagctctggctggcggatcacccccgcctgcgcggggagcacttgatgcagaccagtgctgatccgcgcatcgacggatcacccccgcctgcgcggggagcactgccgtggcgacctgcgcgtcgtcggcgttcagggatcacccccgcctgcgcggggagcacaccatagcgtcgagggggtactgcggatgagcaggatcacccccgcctgcgcggggagcacctgctatcgatgactgctctcatgctcttcagaggatcacccccgcctgcgcggggagcaccaagttcagcttcagaatgcgtactgagtcggaggatcacccccgcctgcgcggggagcacgtcagttgacagatcgactacctgaggcgactcggatcacccccgcctgcgcggggagcacccgtcgtgattctgtccttcttcggcgtggtgaggatcacccccgcctgcgcggggagcacgagttgtcgaggtgcatgtgctccgagcaagggggatcacccccgcctgcgcggggagcacagctcgcgttgcgggtcgtcaccaggcacgaggggatcacccccgcctgcgcggggagcacccccagtcgcccgagaagctgagcttgtccgagggatcacccccgcctgcgcggggagcactcaaccgcgtgccccccacccgcgaggccaagcggatcacccccgcctgcgcggggagcacggaatcttgactacttcaccatccactgcctccggatcacccccgcctgcgcggggagcactcagcctgagactctctgatgatggataccgccggatcacccccgcctgcgcggggagcactacattgccttcactggcccgtacctgacccagggatcacccccgcctgcgcggggagcactgctcccgttgctgtcgcagtgcgttggccatgggatcacccccgcctgcgcggggagcacccgatagtcccgaagatcggagagtatcccgaaggatcacccccgcctgcgcggggagcacgtctcactcgggaagagctcgaggagtctccgcggatcacccccgcctgcgcggggagcacccaacccacatgaccaacgtcggcccggttcgaggatcacccccgcctgcgcggggagcacttccgtgtgcggcccgtacttaccagtcatcccggatcacccccgcctgcgcggggagcacatgtcgtctgtgtaggtagtcacttctgccaccggatcacccccgcctgcgcggggagcacacttcaccacatggatgtttaccggctgggcttgcgaataagtgtaagtccctcaaagtccacgggctcccatgtgccgcctacgactttgaaggcaaggccctgttcgttgcgagcggggtagaccatgaccgctcggccgccttctcccaggtgctcgttgactcgttgccacatgaggtcacgaacgcgggcggtcacggttcccacgaagaccccaggagcgatttcgagcagccacctggtgatgtggccacggagcccaacggggacagcggtaagcacgagaaccgtcatacgtcggagctgtagtcggtgcccgctgggacctcgccgatgcgatcgtcgaagagaacgagaccgggttcgcccccaaggtcggcatctggcgtaccaagcaagagacgaatgtcgtcgacggctcgttcgaggagatgtgcctcgtgaatccgttcccgcatcgttcgtcggacctgactcgacagacttcccgttcgctgggcggctgcctcgaaggccaccggtatcgccagttctaccttgtagaggtcggcgacgtcgtagacgaacgacagcgagtggccagtgtggacgaagcccaggccgggactacagccgagtgcaacgatcgccgtatggaccacgccgtagagcacgctgttcgcgatggagagcgcgcgattgacatcatcgcccgcggacgagttgttggggtcgtagtgccgaccatgccagtcgatcccaaaggcgctggcaaggtgacgatacgtgcgacggatgcgcgcgccctccatgcctcggagccgctgcatagtggccttgctcacgtcctcgccgggaaagcgcatctgatacatctggcgcgcgacccggagtcgatcttgccgattcgagacgagacgagcttgcgcctcgaggaagcgcgtagactggaacagcgacggtgcccaggcgtacagacgagtatcaccttcgcccacccagcacaccacgaccccggattctcccaggagcagcatggcttgatgggtgatgcgcgttccgggaccgaggaggagcgtgccgaccgctgctgcaggcaggtaggtcgtgccggactctgttaccgacacgactgcattcgcatcccgatggacgacgcagtgctcgaggtagacgaacgaggatcgtcgtgagaccggctggagttcgcctatcccgacgcgctctccactgagtgggacacggccttcagtcatcggggtctcgctggtgcagcaagcgtgagcaggccgcaaccataggcgcgtgcgtggcctatgccggtgaccaagctgcgccgaaggagctcccggtcgagaacctcgagatggcccatgaactcggtcaacgcgatggtcactcgttggccttgcctgcggaacaccatccggcgaccgcctgtcaccgccacgtctggttcgcctgtcgaaccggtacggatcgtgaaaccgtgctgctcggaccgcgcaaggagccagccgagctgctgtgtgatggtgacgtggccgtggcgcttcgtgtctgcggatccggacgaactccgaccgctccgcaccgcattggctgcgagccggaaggcgtagacctggcctgtctcgagtcgatcgaggaggggcccgtagggcttcgtgtcgtagtccgtgcctcggacgacttgccctacgctcgccgcgaagtgggcgaactgcggctggactgcgctcaccacgtagagaatcgggacccgagggtcgtcgccgtcgacgcgccagagcgttcggccaatcgaattcgcctcctgcggcacactggccgacgtcgcttgggcgatgatcgcgtgcatgcgctgcgggttccgcagaacgctgagagcagcctgcttctgtgggtcgatgtagagccgagtgaggaacatctcaatcgccctcctcgagcagggccatcgggtcatgggtcgagcgagccgattcgtggccgtggccgatggtcacctcgacgtagtgatgactgacccggcggcgcgtgtaggagcgcgtgagtgggtcgaagcttcgtgcctggtccgcaagctcgacatcgccggcgggattctcgacgacgagttcacaccgtatcgacgtcgcggactgcgcggggtcgttggcctgccacgggatgcttgccagcacgtcgatgagcccgccgtcgtagacgccgagccgcagcggcttgtccggggggcaggagcgtcgcccgaggtacaggggaaacaccggagtcctgagtgcgtcgtcgagctcttggagctgcgcggcgtcgccttcgagcccagcgacgaagcaggcgtcggcgaggtagaaccgttcggtgacttgcgtgctcgtagcggcagagcgatagccgcccgatgcagtcggcagtctcccctcgccgggcgcgaaccgcttcttgtcgtcgaacagactcgacagtgtgtggaagtctcgcaagacttcacctggtcgatcgatgcgcacggcgaagcgcagcgcgccgagatcgtcgagagctgcggaccgaggacgccccagggcggctgcgagcagcccgatgacccctgacttagttgggaaacgctccgttcgtcggtagtggtcgagacgctggctgctgccccaggcctgcaatggtcctccaaggcgcagtgcgagcacgctcatgatgccatgtgctccgcggttgcggcctcgacggcgtcgaggagctggggaaaggcgatggagtcgccgaggtgagtcgcgaccgcctgctccagcttcgggacatagctcgcccagccgttcaggcgaggcacgccatagagtccgtcgatgtcgtcggcgtaggtcgccaagcgctcggcagatgcgtggacgtacccacgatcgctctcgactggtgcctcgaaggccccgaccagactgaccggctggtcgcctcgcatggacacaaacaccaagtcgggcaccgtcaatgctgcaaacgtgttctggtgtcccgttggcaggctcttggcaaacgcttcgataaaggcgcgcacgcccgtcggtaccgcgtcgggatcccccaggttgtctgccagtcgtccaaggctcacggtggcgaagcgatagacggtcgcggaattgaactcgatgaaccccatcatggccgcgccggtctcgtcgtcgcctgccaggtcgtcgacggtggtgtaaaagtcgaactcggaggtgacgcgatgggtcgagatggcatgcgcgacctggcacgcggcgtcgacgttgagattcggggtgtcagcgatcatcctgccgaacagagcgacatcgagggagagatccctgcccatcgcggtcgtcagaacgtcgaggtcgaggtcatcgccggcacggagggagcgttccagctctcccaccgccgcatcgattgcactctcggagacgaacaacgcgtattcgagatctgcaggttgggtctcctgggcgcgcttcttgagcttctcctccttgaggccgagcagcgctcccgcggcgaggttgacgagtcgtgcgacgtcgtcctcgcgcacatcgagatcgcgcacgcgggcctggactcgctcgtggaggaggccggcaagcttacgcgtgcgaattccgcccccgcggctgcgcagccagtcggtgccgatggttgcgaggttctcattgaagtagcgcctcgtcgcgcgcttccacgactgtgacgacacccgagctcgacgagcaccgccatagagcgcggtctttggtgcgttggtgtcgtcgcggttcagacatgagggcggcaacgtttgcaggacgtgcacgtcgatgactgcgcgggtgggatggttcatggttcctccttctgttcggcgggtgattgctggtcagggtcgagcgcgtagtagtctcgtgcccatctcaggctgactctctgtagtttctcgggcaggagccaggtactgagatcttggtagagccggggatagtcgagggacacgtccgcaccgcgcatgagcgtgaccagtccccgaaggtgaacgccgagggcgtcgatggtctcgctcgcgagcgcgctccggaagcgccgttctatcccttgctcggatgcgccgctatcgccgcgagaggttcgcaatctccgagttgcgagcccgaaggtcgagccttccttgtcgagggcgccaggcgtcttcgattggtggtgcaacgcgaagagaccgagcgcgaggtgcgcagccggctcacgccagcgcgagcgtcccgtcaccatgaggacgtacggccaagagtcaggggactcgtcaaagctccggccgacgttgcggcgaagcgtcgcgagcgctcccgggtctcgggcgatcatgtcacgtacctgacggaacagtgtgtcgttcgtcgaggtcgacgaagttgtggtcatgcagctcccttctctgggctatccgatggactgaactcgttgcgagcccgtgcgagcattcgtcggaagcggtcctcgccagcgacacccgcgaaggcctgcgccggggcgagctgcgctagctcccggctcgcgagatcccgagcgacggcctcgacgagggcagcccactcagcccgagggcgctcgaggtcgtcgatgttcgcgagtcccgtcaggaagtggcgatagggcgcgtcgagccgaccgtagagctcctcggcgagcgccgaccgtgccgccttggcgagcgctgccttcccttcgggcacccggtgtcgctttgattcctcgtggaaggagaggtcgtaggagaggtagcgagcttcggcgacgtagccgagtgcttgggcagcgtgcgctgcgaaggtgactgcgtcgattgcgacggtggctgctgcgggatcctcctggttcagtacggcaagaggagtgtcgagtcggtcgtaggccaggtcgtcgagggtggtcgacatgttcccgaactttgcggaagtgacgaggagggacacgagggcgatcccccgcgattgcagaccctcgacgaaggacaggacgcctgcgcgctgttcctcagcgccgagcgcgagcacgctgctcaggccccgccacacctgctggcccgggcgcgcccgcagtggcacatagctgacctctgcaccacgcctgctctccatccgccatccgacgtgaggatcgacgtctcgcgcggcgcgacgatcaacctcatcgccagcgcagatgagtacccgcgggacgacgatagcatcgccgcggcgctccgggaagaggcgaatccgccgaccttgccaggtgaacaggtcgcacacaccgtcgggcgcgcgcatcacccgtgtcggccccagcgggtcacgttcccatgcgggcacgtcgtcctcgcctccacggatgagattgcgatactgccacgggacgaggttgaggaggagtgtctcgcgcagtgtctgcccgacgggcgcgacgaacccgatccaagcgaggtagccgatcgcgggggtgtccttgccgcccttgaccttcggattccccttggccccagtcttgtcggatgccgagccgaaggcatggcgctccacgagccagcgtgctgcctcggcggggctcagtgccagctccgtgcggtcggtgatgggcgtgaagacgggcacgttgttgcctgatggcgcgtaggccaccagactgttggcggtcttgacgccgcccttgcctgctggctcgaggtcggcgacctgaaagaacgggaactccttcgagaacaggtcgaagcgatggcgccaacgggcgaagtaatcgtcgatggcgtcctccgaaaaccggtcagcctcccagaggcgaccccactcggcgtcatccttcgggcctcgcaagatgcggtaggcgagggcgagcacgagtcgaagcaaggccggctccagggtcgggaagtcgacgtcgaagccaacgatcgtatgggcgagcacgaatatgtctcgaagactcacctcgcttcgccgaccgtctctgaaccgtacgggcagccacggctcggaggagaggtcaaagtgcatctcaggctccaccgctcaccacctccaatccctctacgtcagtatatcgaatgcgataatacccgagcgagcattcaccgtcaagtcccaacacgagcacccgctgacgccgtagccaggggtgacgacgccaaccctccggcacggcgagactggttgcagcttccgtgaggtaactaggcagccggaccaccgagccgaggaccgcctcgacgtcatcgggcgtcggaggatgctcgagactgacctcggtcgtcccgaagcgcgcgatgttcggcgaggggccgacacacgcgatcgcaacctcgatgctcgggacgctgtcgcgcaccgccgcttggacacgaggatcatcgtcgtcttcagggtcgccaagacggatacgttcaagttccaggagataccccgccctcgtcgggtccgagatgacgaactgctccgcccgtcgttctcgttcgtgttgctccgattgccattcgacggcgacccgagcgccatgatcatgccaggctggagcgatgacgtcgtcgtccccatagacggccgccaccagggaggggacgtcatcggggagcgtcagcgagtcccgagcgagcagcagggcggccgttcgaagcaacaggtgctctccgtacactcgcaccgagcccgaaggaaacgcgggtggtccggttggcgagcgcgtgaaccctgtcacgatgacacgaggctctgtgaagccgacggggcgtcgcgtgccgcggtggcgatggaccctgccgattcgctggaggacgaggtcgaccggcgcgaggtcggtcgcgagtacgtcgaaatcgatgtcgagcgattgttcgagcacctgtgtgccaacgacaacctgccctgagaggcgtgtgccaccgcggccgaagtgctccgcgagccaggactccttcctcagtcgatcagctgtggtgaatcgagcgtgcagcaggtgtactgtgcccatgggtcgccgctcagcgacggcgcggtaggtgcgttgcgcccttgccacggtgttgcggatgacgaggatgttcgccccggcctctgccatttgggcgaccatctccagtagcggcatcgaggattcgtcctcagggtcctcgtcaaggtgctcgaggcgcaccgtaaccgatgatgcgtccgtagcaactggagtcgtggtgacgtggccgtcggtcgagacagttgtgatcgagggatagcccacgagcccgagtggtgtcgagtgtcccgcatacgcctcgatgagacgtgcgcgcacggcaggagggagcgttgcggagaggagaatcaccggaatccgctccgcgccgagccactcgaggacacggcggaggaagaccgacatgtaggcgtcgtaggcatggacctcgtcgaggatgaccacttttccggcgagaccgacgtgtcgcaaggccacgtggcggaccttggcggttccgagcaggatctgatcgatcgtgcccacgacgaagggggcgagcaggcggcgtttgggaccggtgaaccatgcttcggccgtgacgcgtgcgatgtcgccttcgtcgacatcgaccgcggacggagcgccgttctcaaggaggtcacggaacgctggcacctgctgtgcgcggccgtgggcaagttcgagcacaaaggtgccgggcccaagctgctccaaccagcgcctggtgcggtggaacatctggttgctcgtggcttgtgttggcaggccgatgaaggctccgccgtgaccttggcgagtggccaagacctcggccgcagcgagggcggcttcggtcttacccatgcccatcggcgcctcgataagaactaggcccccgtcgccttgctcgacggcctcgagcgtctggcgctgtagggcgttcggcgagaagccgaaacgatgctcgaaggcgggcgcgccgaccacggctccgaggttggcgactccgtgccatccgagttgcacgagcgcctcggcggcgcgctgctgagctgcgtggaggtaggcgtcgtcataggggaggcagaggtaggggaagagctgctcgttgctcgcgatccagtccgcgaggatgacgaaccctgcgagtgcgagtcgccgcgcactgccgagttcggttgtgcctgcgaggccgagtacctgctgcgcaccggcgacctcgacgacgaggtcgaacaggcgctcgcgcgcggcactccaggggtctccggcaccgccgagaggtcgtcccgccagaccatagagttcggggcgcttgatcggttctcgctcatagcccagaggagggaaccaaccgtggtgaccaccgaggatcgctgcaactccgcggatagcgggttcgctccagccgcgagctgcgagcagcggctgcaccgtggccgccgaggcgagtgcgtgaggtgccttcgagcgctgggggagcggcttgtccacggcgaggccggcgtcgcggagttgcgggtgcagccagtcgacctggatttggaaagcgggtgttcaggacgaacgctggcggcgtgcttaacacatgcaagtcgaacggggtaccaaggtagcaatactagaagtacctagtggcgaacgggtgagtatcacgtgagtaacctgcctcaaagtaagggataacaccgggaaaccggtgctaataccgaatactctcattcggccgcatgactgaatgaggaaagatttatcactctgggacgggctcgcggcctatcagcttgttggtgaggtaacggctcaccaaggctacgacgggtagctggtctgagaggacgatcagccacgctgggactgagacacggcccagactcctacgggaggcagcagtggggaatattgcgcaatgggggaaaccctgacgccgcgacgccgcgtgcgggatgaaggccttcgggttgtaaaccgctttcagcagggacgaaattgacggtacctgcagaagaagccccggccaactacgtgccggcagccgcggtaagacgtagggggcaagtgttgtccggatttattgggcgtaaagagctcgtaggcggctcggcaagtcggatgtgaaatctccaggctcaacctcgggttgcagtgggatacgggcatggctagagtgcggtaggggtgactggaattcctggtgtagcggtgaaatgcgcagatatcaggaggaacaccaacggcgaaggcagcgatctgggccggtactgacgctgaggagcgaaagcatggcgagcgaacaggattagataccctggtagtccacgccctaaacgttgggcactaggtgtggggcctatttcgacgggttccgggccgtagctaccgccttaagtgcagcgcttggggagtacggtcgcaaggcttaaactcaaaggaattgacgggggcccgcacaagcggcggagcatgcggcttaattcgatgcaacgcgaagaacctcacctgggtttgacatgtagggaaaagctgcccggatgcggtgtcctttcgaggccgtacacaggtggtgcatggttgtcgtcagctcgtgtcgtgagatgttgggttaagtcccgcaacgagcgcaacccttgtcctatgttgccagcgggtagtgccggggactcgtaggagactgccggggacaactcggaggaaggtggggacgacgtcaagtcatcatgccccttacatccagggctgcacgcatgctacaatggccggtacccggcgtcgccaacccgcgagggggagccaatcccaaaaaaccggtctcagttcggatcgcagtctgcaactcgactgcgtgaagtcggagtcgctagtaatcccgaatcagcacgtcggggtgaatacgttcccgggccttgtacacaccgcccgtcacaccacgaaagtcggcaacacccgaagccggtggcccaaccagcaagggagggagccgtcgaaggtggggtcggcgattggggtggccctaaatccatccgatttttcaggcgccggatgggaggtgggtcagcctggctgcgcgtggacgagccgagccgcggctacggtcaccgatgtcggcgtagttcagatcctgaggcgtggcgtcgggggcagcggcacacatcctccggcctcgggtgtgtcctcggctctgacgtgctgaggcgggagctgtcgtgatggacgatgacggacctcgacgcagcccggtcagtgccatctcgtgcggcctcgtgggcacggtgaccccgctgcatgagctgcgctgtgttgtaccagtgcaccgaggccgaggtgagctccgcgagcgtcgcgatgggtccgcgacgaaagggcgagcgaaggtggagtcgttggcctacgggctggtcgtggtctctgtggggcgtggcgtcgtcgccgtcctcggcgaacttcgaggcccctggacctgttggcaatggcaccacgtcgctgtggacggcggcgctcgacgatcctgcgtctgcatgagaggtggcgatcgcagccaagagcatcctcggcctgctggaggcccttggctgtgcacgcggcgctctcgacgaactcggtgccgctgcgaagcgagcctgtctccctggtgatggcgtgccgacgaagacgcagctgtgaacgccgtgcagccgaaccagttggtgagcccgacgtcggtggcgtcgaccacgtcgagctcgcggggcagacggctagcggtctcgtgcgcccgaagcgccactgaacgaggcagggggcgagttgcaggctcggattgcggaccgtcgcgtgtcgtctcgtgtcccgtcgcatcccgcgccagctatgggggcacggggagctgcggacgcggccggtcgcggagaggctcgttgcgcccttggtacgggtactgatcgtcgttcagggggcctgagccgatggacaggtggagcctcggacgatcgaggtgcgcgtgcggtgcgcccgagcgatcggtgcgaccccgaatgcgtgcgttgcgtggccacgtcaaggagtcgcagatcacactgatcgtctcatcttccgcacgcgtcggacgccgtcgtcatgtgtcgagatcatgcgcttgacgtcgaggttcccgggttcggagcgcgcacatcgcgggcgtgatcggtggtgaagcccggctgctcgcgagcttcgatgcagtcctggtcgtgcccctgtggcgcgtcgttcgggtggcgtcgcgccgttcggccgtgggcttcgggaatgagtagcgagcccggcatggttgttcgatggtccgtgtgagcttcgatggctcagctacgatcgtcgagaccggtgatcgcagcgagcaggctctcgactgtgaactcggacgtcggggcgtcacgtaccactcgaccgagccgcaacacgatgatccggtcgcagacctccagcacgtgggggagcgtgtgggagatgaagaggacgctgagcccacggtcgcgcgccgcgcggatgaccttgagcacctcgaggctctggcgtgctccgaggtggttcgtgggttcgtcgaggatgatgacatggcgagcccaggtgatcgtgcgcgcgatggcgaccgcctggcgctgtccgccggagagctcggcgaccgtgcggcccatgccctcgatggtgatgccgacacgctggagttcggcgagggcctcgcgctccatgcttcgctgatcgacgaagccgagcctgccgagcaacccacgccgacgtcgctcacggccgaggaagaggttcgatccgatggagagatccggtgcgagtccggagtcctggtaaagggtttcgataccggcggttcgcgcctcgcggggtgagcgccagtgtcgttgctcgccgtcgacccagatctcgcccttgtcgggttcgaggacgcccgagatcgtcttgatgagggaggacttgccggcaccgttgtcgccgacgatgccgatgacctcgctcgggtacacctggaggctgacgtcctcgagggcgaccacggatccgtaggtgagcgagaggtggcgcagttcgagcaccggttggcgcgtcgtcgtggtgctggtcatgtggtcatcctcccggtcgcgttcgaacgacgtcggagcgtctggagcagcgccgcgagggcgataattgcgccaacgacgacttgaatccatgtcggggccacgttgatgaagatgaggccgtcgctcaccacggtgaggagagccgcgccgaggatcacaccccaccacctgccgacgccgccgtagagggaggcgccgccgatcacgaccgcggcgatggcgagcagattggccgagttgctgacctcggtcgtcggggcggccgagccggatcggatgtagaaaaacatcccggtgagtccagcgaggacccccgagaggatgtagatcgaggcgacgtgacggcgggtcttgatgccggcggcaagggcagcaaactcgttcgagccgatcgcgtaggtgtagcgcccatagacggtgaagtgcaagacgacgccgagcacgatcgcgatcacgatcacgatgatgtcgagccaggtgaacaggctgatgcccgaggtgctccagacgatggcccgcggatcgtagcccaccggcgctccgttggagatcacgagtgcgaggccggcccctgcgctgtaggtgatgagggtcgccacgaacggcaccaggcggaacaccgtgatgagcaacgcgctgatggctccggcgactgccccgaggcccgcgcacaggatcgtgccgagcaccaagatgacggcgaggttgtcgccgtgggtgacgagtggctggatccatcccgccacgatcaccccggtgaccgcggcggtcgatccgacggcgaggtcgatgccaccagcgatgatgacgaacgcctcggcgatggcgatcatgacgagaccgctgaagtcggtgagcaggttcgtgaactcgccgatccggaagaagagcgtgttgcgggcaccgaagaacaagatcagtgcaatgagtaccacgacgagcacgaactgctggttggtgacgatacgccgcaaggttggcgtcgtcggtcggctcgtcacggccgctggggccgcgtcgtcatcacgcgtcaggctcacgtcaactcctcccgccagggctcatggcaaccacgagatgcgtgtgtctccccggccccgggggttgggtaccggggagacacgtgcgcgtcgagctagctctggacgtactggtacttctggaggatgctctgtggtgtcgagggcgtgagcaagatgttcgggatgagctgcaggtggggcaccggcttgtggtgcagtgcgtccacggcgtactcgatgatcagcttgccctcgagggtcggctgctgggagatgatcgccgagagcgacccctgtccgcccgcctccatcgactggatgttggtcgcgtaggcgtcgtagcccacgatcttcacgttcgcgccttcggcgccggccgccttgacagctgcgctcgcaccttctgcatccgtgccatccaccgcgaagatgccgtcgaggtggtgggcgctgatgtcctgggcgaacccagactgcgcgacgctcggctccgactcgctcacgacgtcattgagcacctggatgttcgggtagtgcgccttgatctcggccttgaagcccgcgacgcgttgggcgtcggtggtggtggtcagcgacgagacgccgaccgcaaccgtgcacgggttggacgcggtgcagttctttgcgtagtccatggcggaggccagtgcttgggccgccgtctcgccaccttggtagttgtcaccggtgacccaggaggtgatcatgctctggtccgacgatccggagtcgacgttgaggaccttgataccttccttgacggcctcttgcatgtaggtgttcaaggccttcggatcggtgggcgcgaccacgatggcgttcggatgcagcgcgaggacctgctgcaggatcgggatctgcgtcgctggcgagtagtcgaccgggtcgccctgccagacgagcttcacgccgagcgccttggcttcggcggccgcgccgacgtacatcgactggaagaacggatcggcttctgcgccgacgacgaaaccgatggtggtgccgctgctcgaggccgtcgtggacgacgacgtcgtggacgaggacgacgacgtggatccacacgcggcagccaggagcgatgcgccagcgagcaccgcgccgacgacggctggccgacgccaggtccgaagagaccgagtcatgaattcccccttctcccacgcgggacgtgctctccgttccgcggttgggtgtgagactagcgggctctgatatcgttgtcaacgaccatcgggcgcggggatctcacccgatcctcgagcgacgaggcgccacggtgcgtacgcggtctggatggggagcgatgggtcgtccatccgtgcgaacagcagggaggcggcgagcgctccgatctgctcgacctcctggctgatgacactgacgggcgggtcgaggaggtcggcgaggtcgaagtcgtcgaagccgatcagcgcgacggatcgctcgagccctgcggcgcgcagtgcgtagatgacaccgatggtgatgaggttctgacccgcgagtatggcagttggcgggtgcgggccagcgaggagttcacgggtgcgctcggcggcctcgccgacggagtgcacgtccatgaccgcgaggcgcggatcgatcactagaccgccagcgaccaggccgtcgaggtagccaagcctccggtcgacggcggtggcgatcgtggagagatcgccgagaaaggcgatgcgccgatgaccgtgggcgatgaggtgctcgacggcggctcgcgcgccagcgcgattgtcgatgaggacggcgtcggcatcgagatggcgcgggggtcgatcgacgaagatgaccgggacggacgcgcgctgaagctcggcaaggtagtggtggtcgtcggcggccggttcgacgacgatgccgtcgacgccgtggcgccacatcgctgcgacgagctggcgttctcggtcggggcgctcctcgtggctcgcggcgagcaccgagacgccgcgatcgcgcgcggccagctcgatcatgcggaggatccgcgctgggtgggggttcgagagatcgtcgaagatcgcggcgatcgtggaggagcgtcgatcgagacgacgcagcgagcgcgcggagaggttgggctcgtagcgtaactcacggatcgcggcgcgcacgcgctcggtgacctcggccgtgacgcctggctcgtcgttgacgacgcgcgacaccgtcttcagcgagacccccgcgcgatgggcgacgtccttcatcgtggctcgagccttcggggtcgggcgcgtgaactcggtcgtcacggtgctccttcgtggtccggtgcccaacgggtacgagtgctcattggtcgactcgcgctcagcataggcagctcggcctggtgcgtcgaggcacgtcccgagctcgggcctcctcaggactcctaggtccaagtcgacgtcggcaccgatcgcctcggtgggtcggcgcctcggcgggtgcaggtctcgcgagcgacctcgatgccgtcgcgcacggccgcgagcacaaactcggtgtcgtcgaccgtgcgccggccgtggtaggcgaacgtcgcggcgacggtgccggtgagcgcgtcgcccgcgccgacggtgtcgacgacgcggaccggagcgacgggaagctcgaccacgcgaccgtgtaccgagacgaggacggggcctgccccctggctcatgatgacagcggctggtcccgaggtcgcgagatgggcgagggcctcggccacggtcacgtccggctcgagccagcggaggtcgtcgtcggaggccttgacgatgtcggcatgggcgatggcctcgtggaggcgctcgcgatagcgctcggggctcgcgaccgcactcggacgtacgttgaggtcgacgatgcgcaacgatgcggcgcaggcacgaaggacctcgacgacgctcgttgcgagcgtgtcgagcgcgagggcgagaccaccggtgacgaggacgtcgccggcgtgcgcggcgtcgttcacgcgatcgtggcccaccgggtcgtccagggccgtgccctcgaggtagaagcggtagtcggcgacgccgtcgtcgagggtcgcgagcgcgagcgtcgtcggcagccgcgagcgccacgagaagccgaggtcgaccccgtcgtcgcggagaaagcgcaggaggcgctcaccgaggggatcgtcgccgacgccggtcgcgagcgtgaccggcacgccgtggcgagcgatggtgcgagcgacgttcgcgggtccaccaccgggcgtgaacgatggcgagcccgaccctggaaggaggcagtcgaagagtgcctcgccgatgacgacagcctgagacgtgctcggggagcctagctgcgagctggctcgatcacgacgtggaaggcaagctcggggcagaggtgctcggcgtggcgggcggcatcgaggtcctcggtgacgatcggatcggtgacgagagggaagtgccagggatcgagctcgagatggcgcgcgaggagggccacgcaggtgccatggcctcggcatcgggtcgggtcgatcacgatccgagcgcggctagccacggctcggctcccggctctcgagcgcgaaggggcgctcgtggcagcgccggcgctggtggccggccgcatcggccggggtgatggccgtcgcgaggtgtgctgcggcgtcgggtagcgcgcaagcgcctcggcgggcgatcagcctcgccacggtcgcaagttcggcgggacgagccccggcaccgagtgcacgggcaagttcggggagcccacggtcacagggtccgcactggccggctcgctcctcgctgaggtagccgacgagctcgctggtcgcacagacgacgcaggtcgccgatggggcgagcagcacggagcccgcgccgagcgccagctcgtccgatgagtcggcacggtcgacgaggacacgtgccatcgcccgctcgtcggcgaccgagatgagctcgccgaagagaccgccgacgagggcgagacccgtggtgacgccgaccgcgtcgaggaggctccgaacggtcgcccctggggcgagttcgaccaccgtgggcgtcgagcccgggagcgcgatcgagacgatgcgcgtcgagcggtcgtggcctcgggttccggcgctctggtgccaggaggtgccaaagcgcgcggcgagggcccactgcgcgagcgtctcgacgttggcgacgagggtcggcctgctcttgtagccgcgctctgcgacgcgtgcgagctggaaccgcgggagtgcgggacgcccctcgagcgcggcgagcagcgccgtctcttgaccggtgagatacgagcggtcgaggagtgcgacgcggaccgcgtcgctgcgttcacgaatggctcgctcgaggacgtcggctgcggtcgcgtcctcgacggccacgatggcttctcgggcctcgaggagtcgtgtcgcgagcccgaggccatcgagcacgaggtgcggcgcatgggtgagcagcgccttgtccttgcgcgcgccgggctcgctctcggcgccgttggcgaccacgacacgtggcccacgctgggacgcgaccgcagcaagcttgcgcgccagggggaagcccgcgccgcccctgccgacgatgtgctcggcggtggcgagtggtggtcgtgggggcagggagccgtagatggcgcggtgcgcgtcgagcgagagaggcggcgcatcgagctcagcgatcgcgaggtcgtcgctcacgagtcggctccagccggcgctgaggcgtgcgacggacctgggcggcggcgtcatgcgtcgctgccttcggagccatcggcctcgggagcgccgatcgagggtgcagcgttcagggcttccgatggcgcggtggagaaggagacctggcccgtcgcaccgttcgcgtcgatggcgagcgccgcggtgccttccaccgtggcatgggggcaggcgagcgagaaggagatcgtcgagcccccgagcgcggtgacgctcccgtggcacaggtttggcgcgctgggggtccccaaggtcaccgtgccacccgagacggcaaagacgccctcgctcggctgtccggtgagcacgaccgtgagccgttcgttcgtgccgccgatggcgcccgcgatcgtgaggtccgtggcgctcgtggcctgggtctgcgtcacggtggcggtgatgggcccgccgaggggctcggacgagcgtgtcacggcggcggtggtcgccgtcgtcggggcggtgccgtcgatgcgcgcagaccagccagggcgaagcggtccgctccgtgcccacagcgccacgaccccgggcacgccgaggacccccaccatgccgagggtacgggcagtatgtgcgagatcggggtcgcgacggatgcgcaagaccgcgaggacgatgacgcctgcggtgatggcaccgtagacggcgaggaccgcggcgagccgcgtgtcggaaccggtcccgagcccgtggacgatggcgagcgcgagcacgagccacacgagcatgtgcgtccgcttccagagcgcaaagccaaggtgctggcgtgcgagcgaggaggcgatcacgatcagcaggccatcgaaggcgagcgtgccgaacccgacgaaggcgcgtcgatagtgggagaggaacgggatgacggctgccgtccagccgatcggcacgaagctgtcggcaagtgccgtcagaatgtggatcgcgagcacgaccaccaaggtgagcgagagccgtcgatggaggtccgggccgaggaagcgggcgacgccggaagggaggattttgcccgccaccgcgatgccgagcagggcgaccgcaccgagcatgacgagcgcggcgagaccgctcacgcgggtcaggtaccacagcagcggggatgtcgtcgcgatcagcacgcggccgcttcctcgagacgtggtggccagccgccaagggggaggcgttcgccggcattcgtcacgacgagcgccgacagctcgtagcggcgccacatgcggtgccaggcgcgtccagcggcgatgatcgcgaggctggctgcattggccgccgcggcgctctcggcgacgacggtggcgcggcgggcagcgccagggagcgtggaggcaccgacgatgtgatcgagaccccgtggcgatcggcgcgtcgcgcggtcactcgtcgcgaccgcgccagcggggatgtggatccgctggccgggcgcgtcgggccgcaaagatccatcgtcggtgacgaggatcgaccagggggcttctccgacgcagcggaggtcgccaccgaggttgacgaggatggcaccggcggcgtcggctgcgagttcgagggcgatcgcatcggcgatggccgccttggcgaggccgccgaggtcgatcagcgttccgggtgggcgtcgaaccatgtcatcgtcccgttcgacgtcgtcccaggtcgcgctggagcgacggccgaggcgcgccaccgggtggtctggttcgagcgcgctcggatcggcggcgcgcaccggatcgatgacgccgccacttgcgcggaccgcctcgtcggtgacctggaggaggtgtgcgagacgtgccgacacccgcacctccggtgtcggatcggcgttcagctgcgagagctcgctgtggggatcgtggaagctcgcgacggcgccccactcgtccaggagcgcacgaaacctgtcgacgagggcgcgatcagcggggtccgtgccgaccagttcgcagcgtgtggtgtaggcaggcagcacgctcgaccacacgttaggagcctccggtcggggtcggggttgcggcagagggagcttggctcaccgtgggagcggacgatcccgacgacgtcgacggtgaggagctgcccgacgagcccgacgacacgaagggtgccgtcgagttcgacgtcgaagaggtgtgggaatgggtcgtggccttggtggtgtggccggggaacgatcggatcgcttcgaagccgagtgcaccggccgcgaggacgagcgctgcgacgaccgtgcggtggatgcgcttcgcttgggccatgaggtccgtcacgggtcctccttgggtcgggggagcggggacgacgccctcaagtcaaacggcgcgatctggcgtggaccttgagtcaggctcgaaagcccctgagaagggtggtcctgcgaagggcgttcaggactggtgggtctccaaggagaaggcgtcctcgaccgcctcgcgcagatggacgccggcgaggccaggagcgtcgtcgagcgttcgatcaccggcctcctcggcaaccctcgcgagagccgcgggatcggccggttggccgatcagggcatcggcgatctcgcgcggtgcctccatgggccagacggtgaagtccccctcgacggtggcgtcgatcacgtggccctcggcgacgacgaggaggatccgcacgagcccgctcggtgccttggtgcggccgacgaggacgtcggcaccttcgcgaatgtgcaccccgaggacgcgccgccccccgccatcgttgacccaggcgggatcgacgagtcgttcgcgcaccgcggcgacgtggcggcgctcgtcctcgctcaaggtgccgagttcgagtgggcgtccgagtgcctcggcgaggatcgggaggtagcgctcgacgatggcgtcctccgacggtgccgatccgagctcgcgctccatggaggtgacgtaggtgcgcatcgtggcggcgagcttgtcgcggagcttcacggagtcgacgcgcagcacggcggcgagggcgtcggtgtcgatcgtgcggatgaacgaacccacgagcacctcggcgcccgcgatgcgagccgcaccggtgccgccgatcttgcggtcggcgacgtggatgtcgttgaccgggcgatggcgcgcgtcgatcccgaaggcacgcagcgtcgtcacgagtggcgcaatgtaggccgcgtagcgtgcctccagcgagagcggtacgtggtctgggtgcatgatccactggacgaacagctgaccagcgtcgaggtacacggcgcccccgccgaccatgcgccgcgtgatcggtaggccgcgcgccgcggccgcttcgacgtcgagttctcgttcgaccgcctggtggtagccgacgcacacgtaggggtctcgcggtgacaccaggcagatggtgtcggggtcgtcgggaccgagcctctcggcgagggcgtggtagatcgcctgggagtcgatggcctcgaggccggtggcgacgatgatgcgaacgggtcgtgtcatggtcgtagctccgtcatcacgatgacgtcgtggccggcgtcgatctgtcgattggcttggtgggagatgcgcacgagtacggcgacgaggagatagttcgcgagcagcgacgaccctccgtaggcgacgaaggggagcgtgacgccggtcaggggcaggagtcgcacgatccctgccatgatgaagaaggtctggagtccgaggatgaccgacagggcgaaggccagcagcgacgagaactccgttcgcgcacgcagggcggtgcgcacgccggcgccgacgaggagcacgaaggcgatcacgagggcactcgtgccgagcagacccatctcctcgccgaaggcggcgaagatgaagtcgctggtgacgaccgggatgagctgcgggtggccgagcccgagcccggtgccggcgagtccaccgatgccgaaggcgtactgtgcctggacgagctggtagccgatggtctgggcgtagcgccatggatcgagccagaccacgacgcgctcgtgcacctgggtgaagagggctccggccaggaccgccccgatggcgaaggccgcgaggccgaggaccaggtagctccggttcgccgtgcccacccagaggacgatgacgaaggtggagaagatcaacagcgcgaagccgacgtcgcgctcggccgccatgacgacgagtgcgagcgcgaacgcgagtgcgatggggccgaggcggcggatgccgccaccacgaagccggctgagcatgtcgcggcgctcgacgatccaggacgcgaggaacagagcgagcaggagcttggcgatctcgacgggttggaagctgaaggggccgacgtggatccagagccgcgcaccgttgatgtcgagcccgagcccgggtagcagcggcaggaacagcagggcgatcccgccgatcgcgaggaggtagcggtagcgatcgagcgcgtccgcgttacgcacgacggcgagggtcacgacgtaggcgatgacgctgagagccgtccagagggcctggagggtgccctcgtgggggtcgagtcggttgatcatgacgaacccgagcccattgagcagtcccacgaggggcaccatcgtgggatcggcggccggtgcgagcagccggttcgcgatggcgaggacgaacggcgcgaccatcacgctgacgagtgcgaggttggggtccaggtgtgccttcgggttctcgccccaggtcgcgagcgcccacgcgaagacggtgatgacgtcggcggcgagcaccagttcgagttctcggcgtcgccggtcacgagcccatggtgatcgctcgcgacgggcggcgagcatggtgcgcatcggtccttgtccccctggctggtgcgagcggattctagcgggcatgacgctggcgcaggtggtggcggaccgggcgtcgacgcactacggcgagaggctaggttggcggccaaggaggtgctggtggctgaggcgcaacgcatgctggccgagggctccctgcgcagttcgtctgagcgcttcgtgaatcgggagttgtcctgggtggacttcgcctcccggatcctcgaactcgccgccgatgcgcgcgaaccggcgctcgagcgcgccaagttcctcgccgtgctcgcacaaggcatggacgagttcttccaggtgcgcgtggccggcctcaaggatcagctcctcgcacagcatccgattcgctccccggacggactcgatgccagggcgcagctgcgcgcgattcgcacgcggctcgagccggtctgggagcgccagagcgaggtctggcacgacgggatccgaccggcactcgctgcgctcgggatcgagatcgtcgccgtcgaggacctctctccgacgctccatcgtcgcctccacgagcgcttcttggaagagctgttcccgatcctcacgcccttgtccgtcgatcccgcgcatccctttccctacatctccaacctgtcgctcaacctcgcggttcgcgtccgtgacagccaaggcggtgagctccggttcgctcgtgtgaaggtgcccacgaatgtgccgcgcctcttcccgctcggggacctgcgctactgcttggtcgaggacgtcatcgcgagcttcatcgcccgcctgttcccgggcatgatcatcgaggaagtcggcacgttccgcgtcacgcgcaacaccgacctcgtcctcgaggagggcgaggcggacgacctgctcgagctggtcgagaccgaactgcgacgccggcgcttcggtcgtgcggtgcggctcgaggtgtcgtcgcgcatgagtcgtgagctcgtcgacgtgctcgtcgacgagctcgagctccatccggatgacgtctgggcgacggacatgccgatcgacggttcgttcgcatgggagatcgtcgcactgcccatcgacgaggggcgaggcatcgccgccgcgggtgtgacgccgtcgatcttcaccgtgggcgacgacggcgctggcgcgctgttcggccgcctggcggccggcgaggtgctggtgcaccatccctacgagagcttcgcctcgacggtggaggcgttcgtgcgtgcagcggcggccgatccggacgtcctcgcgatcaagcagacgctctatcgcacctcgggtgactcggcgatcgtcgaggccctcgtcgaggccgccgaggctggcaagcaggtcgtggtcatcatcgaggtcaaggcccgcttcgacgagctcgccaacatcgcctgggcgcgtcatctcgaagaagccggcgtccacgtggtctacggcgtcgttggtctgaagacccacctcaaggccgcgatggtggtccgccgtgagggcgcccgcctcgtgcgttactgtcacgtcggcacgggcaactacaacgcccggacggcacggacctacgaggacctcggcctcttcagcgccgacacggtcctcggcgacgacctggccgaggtgttcaactacctcaccggattctcgcacccgaatcggttgcggcgcgtcgtgctcgctccccagcagctgcgcgggtggttgctcgagcgcatcgcccgagagcgcgatcgcggaccgagcggacgcattcgcttcaaggtgaactcgctcgtcgatcccgagatcatcgatgcgctctacgacgcgtcggcggccggcactcccgtcgagggtgtggtccggggcctgtgctcggctcgcgtgggggtcgaggggctctcggagcaccttcggatccgatcgatcgtggggagcttcctcgagcattcacggatctacgtcttcggccaaggacccgacgccgatgtggcgatcgcctcggccgatctcatgcagcgcaatctcgatcggcgcgtcgagctgttgatcccgctcgaggcgccggcgactcgagcgcgcgtggagcacatcctcgatctcgccttcgcggacgacacctacgcatgggagctcaccgccgatggccgctggcatcgtcaacgcggtggcgagggcatctcgctccagcggcggctcaacgacgaggcgggggctcgggggtgagcgaaggcgcgatcgggaccgagcgggaactgaagttccgcccgcgcgacgtcgacgaggcacgagtcctcgtcgccaggttccgtgaccggctcggtctgcctgcggcccccgcggtgacgaccacgctcgagtcgcgctacctcgacacggccgatcaccagctcgcgcgctgcggccttggcgtgcgagcccgctgggcgctcgaggctttggatcccgaggccgcacgctggacggccaagctcgcactcgaagaggacgacggcacctacgtgtcggtcgagttcgaggtcgacggcgagcgcgagcgcctcccggccgagatcgctggtcggcttcggagcgtcgtcggatcggcgcggttggtggagctcgcgcggattcgcaaccaccgtaccagctggcgcgatgcgaccggtggtgtcgagatcgagctcgacgtggtggacgtgctcgctccgcgaactgggcacttcgtcgaggtcgaggtcgaggtcgccgacgacgagcagctgcgcgcgctgcggcgctgggtcggggcggtcccggtgtcgacgacccacaagctcggcgcggccctcgggcaggtcgtgagcgtcgatccggagtgcgtcgcgcgggtgcgtgccctcctcgaggcgccgagcgaccccggctggtgcgaggagcctgctccatgggcacgctgagtgcggcggcgatcgatctcggctccaactcgttccatctcgtcgtggcgcgggtgcgtccggagcgcctcctcgagcccgtctacgaggacaaggtcatgctgcgcctcggggaggtggtcgcacgcctcggtcgcttcgacgacgaggccgaagcacgtgcccacgaggcgttcgagcgcttcgtctcgctcgcacgcgcgttcggcgcgacggtcatcgtcgccgcggcgaccgcgagcttccgtgatgcccagaacgggcgtgacgtcgccgacgcgctcgaggcgcgaaccggggtgcacgttcgtatcctcaccggtcacgaagaggccagcacgatcttctcggcggtgcgctcggccggcagcatcggccaggtccccgtcgtcgtggccgacctcggcggaggcagcttggagctcgcgctcgggacccaacgatccctcctgcgcgcgcgcagcctcccactgggtgtgggcaagctgtcggtgcgctaccgctgtagcgacccgccacggcacgacgaactggctcggatccgggcccacgtcgaggcggtcgccggtgccgagctccgcgagatggcctcgttcgagccgcgccggctggtcctggcgagcgggacgttcgccgcgatcgcgaaggtcgcgcgtcgactcggtcgcgtcgatcagctcgccgacgggcaggtgttgcgggtcgtggacgtcgcctccctcaccggtgcgctcgatgcgatcgtgcgtgccgatcgagaggcccgcatcgaccgtctcgggatcgatcggcggcgcagcgataccgtcgtgccgggcgtcctgatcgttcgcgccctcctcgatgagctcggggtcgacgaggtgtggaccagtcggtgggcgcttcgggagggcctgttgatccaggccgtggaggagggcgacgccatgggcttcgccttcgacgctgccgagctccgcgctggctcgctccgacacctcatgcggaagtaccagatcgaggaggatcacgcccgcgctgtggagcggcacgcactcgcgctcttcgacggactgggcggtgccctcgagctcgtgcccgaggatcgtgacttgctcgcggtggcggcgctgctgcacgacgtcggtgcgttcgtctcgggccggaaccacgaccgtcacggtgcgtatctgctcgcggccgacccaccacgcgggctgtcggtgcgcgagcggctggtggtcgagggcgtcgtcggctcgcaccgtcgcggcgcgcctcgttcccccgacgccctctcgacggccgatcgcgaccgtgtggctgcgctcgccgcactcctgcgcgtcgccgatgggctcgatgcctcccacacccaagtggtcgaaggggtcgaggtccagctcgaggcggacgagatccgtctcgtggtgcacgccgacgaggcgctcggtgccgagcgcgttgctctcgagacgaagaccgagctgctcagctccctcctggggcgcagagtcgaactcgacgtggtgccggtggcgcgagatggggcggcacgagcgcggtccgtgctcgactgagcgctcgcactccgcggtcgcgctcacggatcggggagcaggacaccagggttcacgatgccgtagggatcccagatccccttcagcgatcggagcgccgcctcgtcgatggggtcgaggaggagccgggcccagcgacgtttggtgcggccgatcccgtgttcggacgcgatgacgccgccgagggccgccacacgtgtgagcaccgtctcgtagagcggaccgggatcggccccgtgtgcgatcgcgaggttgacgtggcacgtcccctcggcgagatggccgaagaggacggtggcgcgcacctcgtcgcgctcggccaccaggtcgaggtgggccgcgagctccccgagtgccccgagtgggacggcgacgtccagcttgaccggggtgccgaagcgctcggcgagcagcgggagcatctcgcgcaggtgccagagccgtgccctctgggaggggtcggtcgccacgtgggcgtcgaggtgggccggtgcgagcaggaggggccgatcgtcgtcgggatagggactcgtgagctggaggatgaggaggaggggatgcgggtcgggcggggtgaggccggcgcttcggacgtcggccgtacgcacgaactcggctgcctcgagccacggcgcaacgagtggccggagcgtctcgaagaggctgacgaggtcgacgaagtcgtcagcgccgatggcgatggcgatgcgggtgcgtgggcgcgggtggacccggagcgcgacggccgtgatgacgccgtagatgccctcgctcccggcgacgaagcggcaggtgtcgagcccggcggccttcggaggccgaccgatgcgacggtgggttcgcccgagcccgtcgacgaggtcgacgtggacgagctggttggccgtcgagccgtagcggacgacccgttgaccgcccgcgttggtcgcgacgagaccgccgagggtggcgttggcgcgcgatccgaggtcgataccgacctcgagtcctgcagcctcgagctcggcgtcgagatcggcgagcgtcacgccggcttcggcgacgacggtcatcgtggccggctccagtcgaacgatgcgtcggagtcgttcggtgctgacggcgatggcgccggggtggggtaccgcaccggccacgagcgaggtcctgccaccttggatggtgatcgcgacacgagcgctcccagccgcctcgaggaggcgcgcgaccgcgggagcgtcggcggggcgtgcgagcgctgcggcatcccctcgcgtcgtggcggtccagtcgaggttgatcggctcgagggccgcggggtcgtcggtccagtcgacgttcgcctcgtcgaggacgcgagccgcatcggacgctgctgccatggggccatggtaggtgtgggcatgctgctcgcgccatcgcccgagggctcttcgagggatcgggttaggctgcctagcggtacgtcggagcgtgcctgtgtccggatcgtggccaggctgctcgagcgagtcgcccgacgacgagcgcgtgtggcgcatggtcgggcggcgcgcgtcgtggcgatgcgacagaagggagcgctcggtggagacggtggatccgagatcgcttcgggtgtggcgtgagctcgaggccgaggccgcggagctgcgcgacgtgcctcttggcacgttggtggccgagggaagcgatcgcgagcgtcggctcgtcctcgatgccgggctgctccggatcgatgcgacgcgacagctcgtacgcgctcgcacgttggagctgctcggtgagctcgcgcgcgagacgaaggtggtcgagctgcgtgaggcgatgttcggcggtggccacatcaacaccaccgaggatcgagccgtggggcacgtatggctgcgcgcgccgcggggaggggcacccgtcgtcgacgggatcgacgtctcttccgcggtccacgacgtcctcgagcgcatggcggaggccgccgttcgtctgcgcgacggcagctggacgggtgtgaccggcgaacggatcgagcgcgtcgtgtcgatcgggatcggcggctccgatctcggccctcgcatggcggccctcgccctggaggccttcggccacggcgggcccgaggtccggttcgtctcgaacgtcgatcccgtcgacctcgagcgagcgctcgtcggcgccgagcccgcccggacgctgttcgtcgtggtctcgaagacgttccggaccctcgagacgctccagaacgccacggcggcgctcgcgtggctgcgctccgagctgggagagggccctgaggtggtggcgcgccacgtggtcgcggtctcgtcgaacgtcgaggccgcgacggcgttcggtgtcgaccccgccaacgtcttcggcttctgggacttcgtcggtgggcgctactcggtgtggtcggcggtgggttttgcgctgatggtcgccgtcggaccggagggcttcctcagtctgctcgccggggcccacgccatggacgagcactttcggaccgagccgatggatgtgaacgcccccgtcctgcacggcttgttgatgctgtggtatcgcacctttctcggcgcccagacctacgcggtgctgccgtacgcggagcgtctcgcgctcttgccgtcgtacctgcagcagctgaccatggagtcgaacggcaagtccgtccgacgcgacggcgagcgcgtggactacgacacgggcgccatcgtctggggagagccggggacgaagggccagcacgccttctatcagctgctgcaccaggggacgaccctcgtgcctgcggacatcatcgtggtcgccgaggcacaagccggtcccgagcgccaccacgacctgctggtggcgaacgccttcgcgcaggcccaggcactcgccttcggccgggacgaggcgtcgttgcgggcggcaggggtgcccgagcgcctcgtgccgcacaaacggatgcccggttcacgcccctcgagcgtggtgatgatgccccgactcgcgccggagacgctcggcgcgctgatcgcactctacgagcactcggtgttcgtccagggggctgtgtgggggatcgactcgttcgaccagtggggcgtcgagctcggcaaggagctcgccgaccagctcgcgcccttcacgacgggcgagcgcgacgtcgagggtgccgacctcgacccgacgacggcgcggctcatcgagtggtaccgttcgtggcggcaagggccgccgaagagagaggagatgccatgaagagggctcgcttgctggcggaacacggccagagcgtctggctggatgcgatctcgaggcgactgctcgccaagggcacgctcgcgcactacatcgacgagctcgcggtgaccggcttgacgtcgaacccgtcgatcctgtcgcacgccatcgccggttcgaccgactacgacgagcgcattgccgatgcggtcgctcgcggtgtccacgatccagaggccgtcgtctacgaactcgcccactgggacctcgccgaggctgccgggctgttcgcgccggtgtacgagcgcaccgacggcgtcgacggctacgtgtcgatcgaggtgcctccccagtacgcgcacgacacccaggcgacgctgtcgtgggcgcgtgagctgcggtcgcgcttcgcggagccgaacgtgctcgtcaaggtacccggtaccccagagggcctccccgcgatcagcgagttgatcgcctcggggatcggcgtgaacgtcaccttgctgttctccgtcgagcactacaccgcagccgcggaggcctacctcgagggcatcgagcggcgttcgagcgccgggttgtccctcgtggtgccctcggtcgcgagcgtcttcgtctcccgctgggactcggccgtcgatccgctcgtgccccgtgagctccagggccgtacgggccttgcgatcatgcgtcggatctacgcggcctaccaggcgctcctcgcgtcggagcgcttcagcaggctcgccggccagggtgcgagagcccagcggctcctctgggcctcgacctcgacgaagaaccccgagctccccgatacctactacctcgggcgactggtggcgccagggacgatcgacaccgtcccggaggggaccctgctggccttcgacgaccacggcgagatcgagcccgtgctcgacgacgacctcgcgggggccgatgcactgctcgaggaggtcgcctcggcgggagtcgatctcgcgggccttggcgacgtcttgcaggagcaaggtgcccacgccttcagcgccgactggacgacgctgctcgacaccgtggcacggcgggtgaaggggtgagcccgcgcggcgtcgtcgtccgcgaggatgggggcacggtcgcagctcgcgtcgaggagctcgacgagagcctgctcggccacgatccagtgcggatccgcgtgcactactcgaccctcaactacaaagacggcatggtcctcggagggctcgggaggctggttcggcgctacccccatgtcgccggtgtcgaccttgccggtgaggtgatcgaagaccggacggggacgttcgctccggggacccgcgtcgtggtcacggggttccacgtcggcgagcgccatccgggcggtcttgcccaagaggccagggtgcgtccggagtgggtcgttccgttgcccgagggcctcgatgcgcgaagggcgatggcgatcgggacggctggcctgagcgccatgctcgcgatcatggccgtcgagcagcgggggcgttccgatcggaccttccccctgctcgtgactggagccgcgggtggggtgggctccatcgcggtcgctgtcgccgctcgacgagggtggggggtggctgcgtcgaccggtcggaccgacgaggcgccctacctgcgctcgctgggtgcgagcagcatcatcgccagagccgagctcgcgagggacgacgtgcgcccgctcgagtcggagcgcttcggcggggccatcgatgcggtcgggggctcgacgctcgcgaccgcgcttgcccagatggcccacggcgcggccgtcgcatccgtgggtcttgccggcggcgaccgcttttgcgcctcggtgatgcccttcttgctccgcggcgtgagtatcgtcgggatcgactcgacgctcgcaccgctcgaggatcggcgagcggcatgggcagcgctcgcgagcgacctcgaccccgcactgctggcggaggtgacccgggaggtggggctcgaggacgtgcccgccctcggacctgagatcctcgccgggcacgttcgcgggcggatcgtcgtcgacgtgaaccgctgagacgtgcccacggtcatcgtcgtgtgtggcccgaccggctcgggcaagtcgacgttgcgtgctcggctcgtcgagcgaggtgcggtgggcatcgacgccgacgaggtggcgcgagcggtcgtcgagccaggttccgaggtgctcgcctcgttggtggcggctttcggcgatgacatctgcgacaacgaggggcggctccggcgtgacgtgctggccgcgcgcgcctttggctcggccgagacgacggcgctcctcggtcggctcacccatcctgcgatccgtgccgagatcgaggcccagttggcgtcagccggcgatggggacgtcgtcgtcgtcgaggtcccgctgtggcggcgggcggacgactggatctgccccgatctcgtcgtgtgggtcggggcgagcgccgagcgcgcgggcgctcgcgtcgcggaggaggggcgcatgagcgaggcggagctacgccagcgtcgtgctcgcttcgacttcgaggcccagcggcacgaggcggacctcgtcatcgacaacgacggtggtccagaggccctcgccaaggctgccgatcgtgtgtggtcgctcgcgctcgctgccgacggtaaaggtcatcgccgcgcgtgacgatgggttcgcgaggaggtgaccatggctgaggtgatcaccgcggagcagctgacggcccggatcgcggagttcgaaccatcgaggagcgtcgccgaacgcgtgctcgcggtcatcgatcgcgacgacatcggtgctgccgagctcgcgactgtcgtcggcacggatccggcgctcgtcgagcgggtcatgcgaacggcgaactcggtggtcttctcgagtcaggccaacgtgcgcaccttgcagcacgcggtggcggtgatcgggttcgagaccgtccgttcgctcgcgctggcctcgttcgtcgagggcgtcatgagcgtctcccggcaggactggcaacgatcggtgatgtcggcggtgggtgcggcggccgtcgcgcgggggatcgggctcgatccgcagctcgccttctcgaccggactcctccacgacatcggccacgcgctcctcgagagtctggacccgagctacgccgccgtcgtcggggcgttccgtgccgagccgctcacggcctcgtccgaggccgccctcgtgcgagccgaacgtggtcgctacgggatccaccatgcgctcatcgcgggcgacgtcctcgcctactggaacttcgccccggacatcgtcgaggccgtgagccaccaccacacgccgaagggttctctgtcgcgactccacggcgccatcgtcgacggctaccgtctcacccactggctcgcctcggggctcgatctcgaggagtacagccgcgccgacgacgtgctgctgccgacctacctgcgacccgagaacctccacgtcgtggccgccgatgtccggtcgcgggccgagacgctcctcgaggatctgttcgggatcccggcgtcgcacgcgagcgcacggtagactcccggtgtagtgccggagcgcttcgaggtccacgcgccgtatcgcccgagtggcgatcagccgagggcgatcgacgagctcgtcacctcgatcgagtcgggcaaccggttcacgacgctgctcgggatcacgggctccggcaagagcgccaccatcgcctggacgatcgagcgactgcagcgccccacgctcgtcatcgcgccgaacaagtcactcgcggcccagctcgccaatgagtttcgcggcttcatgccccgcaatcgggtcgagtacttcgtgtcgtactacgactactaccaacccgaggcctacataccctcctccgatacctacatcgagaaggactcgtccatcaacgacgagatcgaccgactgcggcactcggcgacgtcggccctgctcacgaggcgagacgtggtggtcgtggcctccgtctcgtgcatctacggcctcgggagcccgagcgcctacgaaggtcagatcctccccatcgaggtcgggatggatcagccgatggggctcgtggtgcgaaggctcgtggccatgcagtaccagcgcaacgacctcgagctcgcccgtggccgtttccgcgtgcgaggcgacgtgctcgaggtccacccggcctacgaggagcgcatcgtgcgcgtcgagttcttcggcgacgaggtcgagcggatcgtgagcgtggatcagacgacgggggaggtgctgcgcgagctggaggacatcgttctgttcccggcgacgcactacctcgcgagcccggaggtggtcgagcgtgcgcttcggtccatcagcgacgagctcggggagcggctccgtgagctcgagagcgcgggcaagctgctcgaggcgcagcggctccgcatgcgcaccgaactcgacctcgagatgctccaagaagtcggctactgcaatgggatcgagaactactcccgccacctcgatggtcgcgagcccggacaggcgccctacacgctgctcgactacttccccaaggacttcctcgtcgtcatcgacgagagccacgtcggcctcccccagctccgcgcgcagtacgcaggcgatcgctctcgcaaggagaccctcgtcgagcacgggttccgcctgccgagcgcactcgacaaccgtccgcttcgcttcgacgagttcctcgaacgggtccctcaagccatcttcatgtcagcgacccctggtccgttcgagcgtgagcacgctgggcgcacggtggagctgatcgtgcgtccgacgggcctcctcgatcccaaagtcgaggtccgccccacgaagggccagatcgacgacctgctcgcggagatccgcgctcgggtcgagcgcgaccagcgggtgctcgtcaccacgctcaccaagcgcatggccgaggacctcaccgagtacttcgagggcctcggcgtcagggtgcgctacctccactcgacgatcgagaccttggagcgcatcgagatcgtgcgcgatctgcgcctcggggtcttcgacgtcctcgtcgggatcaacctgctgcgcgagggcctcgatctgccagaagtggggctcgtggcgatcatggacgccgacaaggagggcttcttgcgctccgagacctcgctcatccagaccatcggccgagccgcacgcaacgtcgagggcacggtgatcctctatgcggatgccgtcacgccctcgatggcccgagcgatctcggagaccgaacgccgccggagcatccaggccgactacaacgcacgccacgggatcacgccgcgctccgtgagcgcgaggatcgacgacctcgtcaccgagcgcacgcgcagcgcgccgacgccgacgctcgggcgtcgagcgatcgaagagcggaccgctggcatgaacccggagcaggtgcgcgacgtcatcgactcgctccgcgaagagatggagcgcgccgccaccgagctgcgcttcgaggaggcggccaagctgcgtgacgacatccgggcgctcgaggcactcctcggttcggacgcgatctcctagcgagcttattgccgctatcacaccccctatggtataatcggagataccgctgggggtatagcggttggtacctaggaggacacaggatgctcgatctcatcatcgtcccgacgctcgagctcggcgaccggtcgtacatcgtgcacgacgggcgtcgcgcgatcgtgatcgatccgcagcgcgacatcgaccgtatgctcgccatcctcgcggagcgcggcctcgaggcggtcgcggtcggcgacacccacatgcacaacgactacgtcaccggcggctatgcgctcgcgaaggagctcgacgtcgactacctcgtgttcgagggcgagcaggtgcacttcgagcgccgagcggtcgccgaccgcgaggtgctgcgcctcggcgacatggaggtcaccgtgctgcacacgcctggccatacgccgacgcacatctcgttcgtggtgcgcgatccggccgacgatcggccaccggtgctgctctcgggtgggtcgttgctctatggatccgtaggacgcacggacctcatcagcccggaggcgacctacggcctcgcgaaggaccagtggcactcggcccagcgcttcgcgaccgagctccccgggccgacgatcttgatgccgacgcacggcttcggctcgttctgctcgtcggtgtcggtcgaggaggccggcgactcgacgctcgatggcgagaagcgcgtcaacatcgtctacaagtacgactccgcggagtcgttcgcggacatgttggtggcgacctacgatccgttcccggcctactaccgccacatggggcctgcgaacgtctcgggtcccgcgccgctgcgcatcgacagcctcccgaagctcgacgttgcccaggtgaccgagctgcgcgatcatcacgaggccgcggtcgtggacatccggccccggaagcagagcctcgagggtcgtccggccggcacgctcgcgttcgagtactcgaacgtgttctcgacctatctcgggtggctccaccactacggtcgcccgatcgtcttggtctcgtccgacgaggcgaccgcacgtgaggcggcgctcagcctcggtcgtatcgggatcgacgaggtgcgtggctggatcgagcccgaaccgctgatggatgcctggggcgtcgagcgtctcgagcgcatcagctggcaggagtacgtgcagcagtatcgggggagcgatcacacgctcctcgacctgcgcaatccgtccgaggctcgggccctgccgatcccgggcgccatccagatcccgatctacttcttgccgaaccagatcgacgaggtggcgacggatcggaccgtggtggtgcactgcgccggagggtatcgcgccgcagcgggtgcggcgtggctgtcggcgaacaagcacattcgccctgtcgtcatcgacgacggggccgacgtcggcgcgcagctgctcgcggcgcagtcgtagtccgtcgcggcccgacgacgagacgttaggctcgtccccgccatggtgggtggggacgagcagcgtcgcggcggcgacacgccgctcgtcgtggtcgtcggcggtgcgcgctcagaggttccgatcgataggggcgcggtcgcagcgatcgtgcgcctcgttggtgtcggcgacctccacgaggcggcagcgatcgccgatgagcccagcagcgaacgggctctcgtgggtcgtcgtggcgtccttgcaggactctcgctgaccagcgatgagcccgccatcgcaggcgccctgatcgaaggggtcgccttcgaggcggcgcggatcgtcgatgggctcgacgaggcggtcgcgggctctcctgaggcccgcatccttctggagggtctctacgccgtctcggcggtggcgcaggtggtggcggacgtcctgggacgtgcggtcctcgacggcgccgggcagagggcgatgcccggaccacgcgcgagaagccggcgttccaggtggcgccggtggctcgaggatcaagggagcttgacgtaagcccagccgtcgccctggcgcgccacgaggtgagcgatggcggcaggcacatggccgacatcgctggcgaggtcgctgctcgtcgcgccgagtgcctggaggctgttgtcacaggcgaggacgcggcgccattcgagggcagggctcaggagtggctcgagcggtgagggcgccagcaggcggcgaacggccgcaccttggcagacgacctcgatcgtgaggtccggagcggcccgatggaggttcgcggccgacccgagtgctgctcgcagtgcgtccaggtcgtcggtcgtgacgtggatgagggcacctcgtgcgatcatcggatctgctcggcgtgcaggtccgaacggctccgtccgaagagggcgaggtgcatgaaggcgaacttggcgaaccacagcacgacgaaggaagcgaagtaggttccctggaccacgatgtcctggtcgagtcgggatgcaccgagcgcgagggcatgggcgtgcgccacgtcgactgcccaggtcgagacgatcaggctggtgagtgacatcgcgacgtagggcaggacctcacgggcgagcgacgagcgatcacgacggcgccaggcccaggagcgattgagccagtaggacggtgggatgccgacgagcgtggccacgatggcagcgtcacgcgcatcgaggagatgccagagtgagtagacgacgaggaggaccagctgcgacaagacggcggtcgctgccgacccggccgcgtagcgccagaagcgatcccacagcgggacgaaccgtcgcaggccgaccacctcgaggagtcggcgccccatgcgatcgattcggtccacgctctcccagcatagaaccgggcgccgagcgagcgcggatggtgacgtgttaccgatcggttaggaaccctcgggttgttgctcgtgcatccggatggtcgagtaaggtaacgaggtggtagcgctgcggtcgccacgaggtggcgaagcgcgttgcctgaccggagagtcgctggcgaaaggtggtcacgtgcggcagcaggcagagtgggcgatcgtcaccggcggctcgggattcatcgggaccgcggtcgctcgtgcgcttcgagcgcgcggcgtgcgggtcgcgatcgtcgatcgcaacgcgccgcagcaccgcgaactcgatgtgttcgtcaagggcgcgatcgagcacgagcgcacctggctcgccctcgcgaccgagctcgctggcgagcacgtccgtgcgctctaccacttcgcggcccgcaccagcgtcttgcagtcggtgaacgaccctcacgacgtctttgtgtccaacctggtgggctacgagaacgcgctcgagttcgcgcgcacgcacgaggtcgcgagcgtcctcttcgcgtcgaccaacgcggtcgtgggtgcgggtgacagcggcaccatctcggagcgctcgccgttggcgccactcacgccctatggcgcgacgaaggcggcaggggagatgctcgggagcgcgtacgccgctagctacggcatccacgtcgcgtcggtgcgcctgacgaacgtctacggtccggggatgtggcacaaggactcgatcgtgccgcgcctcctgcgtcatgtggtcggcctgtctgaggcgaccatctacggagacggtgagcaggtgcgtgacttcgtctacatcggtgacgtcgtggacgccttcgtgcgcctcgaggagctcggcttcgtgggcgcggtctcgttcggttccggcacgagcgtcagcgtgaatgagctggtcgatctcgtcggcgacgtcacgggccacgagctgcgcctgcgtcatgtgcctgcgaaggctggtgagatgccgggcgtgagcgtggacctgtcgctcgcgcgctcgctcggcctgaaggctgacgtcgaactggcggagggtctgcagttcgcgtggtcggacttccaggaggatcagggccgcgtcgccggctgagcgcagatcgcgcgcgctcgacgcgcctgtgagcgcgcgttgcggtgaccaccgacgcgggtgcttggcacaggatcgggttcgcgagccccggtggcggctcgcgctccatggcgcgtcacgcgtgtgggcggcctgagggtcgcaaggtcgaacgatcgatggcggaggcggtgtgcttcgagcgccgctcgcggccgagttcgctgcgctgtgcgctctcgctgctcgggtggggcggagtgggcaggcgctgccgacggctcgtgccgtgacgcgcccagcggcggagcgctcagcgttcggagccggggcgtgcttcgagttcggcgaggcgcgcgagcagtgccgagcgccgctcgtgccaccagtgctcgacgggggcgaaggcgctgccgagacgccagcgatcttgttcggtcgcgctctggcgtacgagggcgagggcctcacgggggtctgcctcgaggagcgatcggaagctgaagcgacggcctccgaagcggatgggcacctcggcgcggttggcggcggcgagaatgccgcgccgcgtgagcacgatccccgacagggcgggggagaggcacagctcgaggagcccgtcgaggtcatcgggagtctcgagatccggggcggctcgcaggtgcagtgggagagccgagggcacacccaggcgttcggcgaggctgttgagggtggcgaggaggtgttctgcccacggtgcgtactcggggggaccgagtgcgcgagcggcgcatgcgtacaacggaccgatcggtgcgagctgctcccagaggaaggcgcgtgcgaagtcgagcgcatcgcgatcgagcgcggcggcgaggacggagagcaagaagcccacgtgatcgcagagcgctggggtcgtgagatcggcgacgtaggtcgcgaggaactcgcgtgtgcgctccgtgggctcgccgccgagcagcgggccgcgcgtcaggaagaagctcgtgtaggggggcagctcgaagtcgaacagctcggtgaaggcggcacgcgagcgtcctaccccgaagagggcgaggagctcggggtcgggctcggggttctcgctgagctcggcgaggccccggacgacctcggcgagcttgcgcgtgtcactgtcgagttggttcactggcggtcgccgaggtcgggagtcggaaggcctctggggtcggcttgagcggacgcatgagccagcgagggcggcgcgtcccgtcggggctgacctcgcgggcggaacgagcgagctcgagccagcggtggaacacctcgcgcgaacgagcggtgtcgacgtagacctcggcgtggcggtcgccaggctgggctcgggtcacggtgacgacctggtgccagcagtgcatccccgagatcggatcggggtgcacgccgaaggtgaggttctggtgcacgcccacgtcggtccaccagatgcgctgggtgtcgggatcggccgactcgtagggcgcgacgccgtcggaggggtcgagcgtccagcgtgatccctggcggcgcagggcgacgagacgcatcatgcccttcgatccgacgtcgccgaggcgccaccgtcccatgtggtgcgagcaggcgacgacaccgggacggatgccttcggtgacccacgccttgacgacgaagtagccgagatcggtggtgacgcggacgagctcaccgtcgcgcacgccgatgcgggccgcgtcggtcggatggatccacagtgggttcgtgtgggcgatctcgtcgagccacttcgagttggccgaccgggtgtggatctgcacgggcaggcggaaggtcgagatcaggggcatctgcccgtcggcgagcttcgacggatggacgtggctcgggatgtaggtcgggatggcgtactctggccatccccacgaggcgacggtggccgagtagaactcgagccgaccggagggcgtggggaagcctcgcaggatcgcgccgtcgacctcgacgccgacgggccgacgtccctcgtcgtcggggctcgggtcgccggtcgggacgatgttggcactcgcgggcttcggagctcgagtccagacccggccatggtcgtcgacgtggacgtcgtcgagttcctcggccgggacgggccgttcgtagacctggccgacctggcgcgcgacctcgaaggcaccgtagcggcgcatgtagccgagcggcgtgaggccctccttggccgcggcttcggggagtcctggcaccgaatgctcgaacatccaggcgtagtactcctcgacggagagcttctggccggggttggctcgagactcgaagtagcgccggatacccagggagccgtcggggtcgatgcgccacgacagctcgatccagaactcgttctcctcccacacctcaccgggattgacctggcgggtgtcggtgacggtctcgccgagacgctcacgagccgctcggagcacgggttggcgaaacccgatccactggccgtcgtactgctcgtaggagtgggtgtcgtggcgttcggaggcgtgacccatcggcaagatgtagtccgcgaagaacgcggtctcgttccaggtgggcgtgagcgcgacgtagcacccgactttgtgctcgtcgagcagcatctcgatccaggcaaagccatccgggttggtccacacggggttgtagaccctcgtgaagtacacctcgagtcgcttgccgtactcctccatgaggtgcgggagcaagaacgagagctcgttctgggcaagtggatagtcgacgggccaggacagctcctgccagaccttcgggtgcggcgggacgtggatcggtcgtggcacgaacttgttccaggcattgaggttcgtgccccctggcgtcgcgacggcccccagtagtgcgttcaggaggaacagcgtccgagagacctgccagccaccgaggttgccggcggctgccgagcgccaggtatgcgtggcgagctgggtgccggcgtcggcgacgagctcggcgacctcgcggagcgtggcttcgtcgacaccgctctccttggccgcgtacgcgaaggtgaagtcggagtagagctgcttgagcacccccacgaaggcatcgaaggtcaccgggagctcggggtggaccgcctcgaggtactcgcgccagttccaccaccgctcgacgaaggcgcggttgaagcggtcgtgctggatcaggtagttcgcgatcgagaggttgatcgccgcttcggagccgggccacggcgacatccacacgtccgcgtgcgtcgaggtgttcgacaggcgcgtgtcggcgacgatgagcttcgcgccgcgctcgcgggcttcggtgatgcgctgcgcatgagggttgaagtagtgaccggtctcgaggtgggagctgatgaggtagatcaccttcgcgttggcgaagtcggcgctgggccgatcgatcccgctccagaactgatagccagttcgtccacccgacgagcacacgttggtgtgcgagttgtggccgtcgacgccccaagcggcaaggacacgctcggtgaagccgtcttccccaggacgaccgaggtggatcatgatctcgttctggcggtcctcgacgagcgcctggcggaggcgacgggcgagatcgtcgagcgcctcgtcccagctcacgcgctcccacttcccgctcccgcgggcccccacccgccgaagggggaagaggatgcggtcagggtcggtgatctggttgagcgtcgcgggacccttggcgcagttgcgccctcgcgagccgggatgttcggggttgccctcgaacttgcgcacggccaaggtgtcgcgatcgacataggcgaggaggccgcaggcgctctcgcagttgaagcaggtggtgggcacgagcatcgatcgatgctcgacgcgcttcggccaggcgcgcgagtcgagctcgacccagtcgtcccagcgctccttgggcgggaagctcgcgaggtcgatgcgcgagggcccctggtagaaggtttccccgcgtgcctcggtctgctcgcggagcgcgcgaatgcgagccgagagagattcgacgtcgttcgtagccatggtggtcgtacctccgagggttacgccaacgggacgcgttggccggcttggacgtaggcgtgttcgagcgggaggatgcacaggagcgctgctgcggcaagggccatgccgagcggggtgaggatcccgacgagatcgagcgcgaatcccagccagaagaggcgcccgagtgcgccgtgggtcatctcccacacggcaaggtgggccttggccgtggggtgcgtgatggtgatctcacccaccacgagcagcgcgttcaggatcgcgagcgcgcctgtgagacgctcgaggtagccgaccgtcgagccgggatcggtgatggccgcgacgaagacgctgacggccgatccgagcaggagcgcctggatgacgaggtggatcggcatcagggggctctgccagagatcgcgtgctttggcttgggcgaacaggaacgcggtatagagcgccgcgagtgcggcaaggggaatccccgggatggcgaggatgcccatggcggtcgagctgtgcaggatgccggcgatgagggtcagcgtgtcgatgccgccgaagaggaggagtccgtagccccccctgacgagccagctctcgggtcgacccttgaggaagagcaggtagaagcgttcgggatgcttgaggtcgccgatcaggagccccccggtgatcgcgaggaaggcgagcgagatcgacggtccccagatgcggacgaggtccgacgagaacggcagcttcccgagcaaccacagcgtgatcggcacgaggtaggcaccggccgagaggcccttcgtccaggtgtagaggctgaccaggccgccccacggtgcattgtgggcgacgtcgtagaccagcttggccttggccgacgagttcggcacgtgggcgtcggccgggtggcccgaggcgatgacgtgcggtccgctcgggatctgggaccacatgtacgtatcgccgcgcggacgctcggccgcgatgggatccagggttgcctggtgtgcgccgcgatagaacagcttcggacgggtccccttctccgggttgcgcacggccaccggggtgcggtggacgacgcgggtcgcgcgtgcggtgtcgtcctcgagcttgccgatgaggatggcctcggtcgggcagacgacgacgcacgccggttcgaggccgatgtcgagacgatgcgcacagaagttgcacttctcggcggagtggtcctcgggattgatgaagatggcgtcgtaggggcatgcggccatgcacgccttgcagccgatgcagatggccttgttgaaatcgacgatgccatcgggtcgctgatacatcgccccagtcgggcaggccgcgacgcacggtgggttggtgcactggttgcagcgtgtgacctggaacgagcgccgaacctgcgggaacgtaccgacctcgacggccttgacgtaggtccgcgtcacccccagcgggacctggttctccgacttgcacgcggtcgtgcacgcatggcagccgatgcacttggtttgatccaggaccttgatccaggtctctttggatgtcgtccgttgctccgtgagcacgctcgccccaccccctgcagcacacagccgtgcgtacgatcggcgcacgcacgcatgtcaacgcatacccagtggggattctaggaacgtgctgcggctacgtccaggaggcgccacggcggccccgggacgacaaaggcagcccatcagggcgtgtgagctgcgatgatgggcgattctgccgccagaggctcacagctggccgggtggcgagatgtgagccctggcaacgctattgcctgcgtgacaggcgttattcgaggagtgatcgagccgcagaattagcgcatcgcgtgttcgcgctcggctcgggcgcagaaggcgcagccgacggtcgttcgatcgccgaagagccgatagagcgggcagtagccggtcagcccggtgatcagcatgatggccgcgagcgcgtagagaacaacgctgccgacgctgccgttgccgaccatgacgccaagcgcccagaacactggcgtcgcgacgacgatccgcagtgctcgatcccagatacccatgttccgtcgcattggtgcctccttgagtggtcctagaccatccaacgcgcggctccgacgagcaacgtcccgggcggcaccgacaagcgacgagggtcctaggaggtcgggaccttcgtccgacgacgggtgaggacgagagcccctacgaaccaggcggcgaggccgagggcgctcgcggcgaggccctcgccgaaccgtggagcgtggtagctcatgacgaggtgctggcgcccagctccgacgtcgacggtcatctgatcggaagggctggaaccaacgggagccgggtgaccgtcgagctgggccgaccagccgggcgcccacgcgaaggggaggacgagccgggtcgggtgggtcgtgacgacggtcgccgtgatggtgcccgatgcagcttgggaggcgtcgaggacgcgcaggccctgctcgggctcgatccagtgggcgggctcagggagctcgaatgcgagtgctgcgccccgaacgatcagttcgtgccaactgctcggagcgagggcagtgtcgagcgggccaccgaggaggtaggcgccgctcgaagcgacggcgacgacacggacggggagcgtggcgcccttggaagcgctgagacggacgctctggaccgtctcgccgccgggaatggcgagctggacggacgatgcccggtgctcggtcgcggcctggatcgtcgcgccgctcgtgagcgtcacgctcatggccaggcgtcggacgggactggcgacggtggcggtgagcttcgtgacgccggtgagatcgccggcgtagacgtcgaggcgaccgtcgcggagcgagagcggagatgacgcggggagtcgggacgccgtcggagcttccgtggcgaagtagcggcgtgaggtgacgacgaggcggacattgaagtcgcgaaccaaggtggacagatcggccggatcgaacgtcgactccggcttggtgccggtggcggcgtcgtagcgagcgaggccgagcgagctgtagcccgaggccgacagtgtgtgggcgtagatgttggtgtcgggctgcgcgtcggtcgcgatcaggctctcgtagagatagagctcagggtcgtagacgacgtagcgcagaggtcgtcggagcaacgatgcgaccgtcggtgccgtcggcattcgcaccggtggcgagagcgacgagagcagcgggaactcgaggacttggttggcgacgtcgaggacgaggacgaggacgaggatgcgcagggcccaaccgcgcaagggcgagccgaggagcacgatggtcgccgctcccacggcgatggccatgacgacgaggtagccgcgcagtgcggcgagggagatccctgtgggcagcgacaccacgttgaagtgttcgagcagcgcagcgggcgcgacgatctcgacgagcgcaaagcccacggcgagggtgccaaagacgatgagtgccactcgagtcgggaggtggtggcggaaggagtcggggtgggcaagtgcccagtcggcgctgccggccgcgaggagcacggcggcgaagtcgaccccgatgaggtaacgggacgcgagtcgctggaggtcgaacagcgggagccggtagacgaggtgcgcgaacggcgtgtggccaccgagtgcgaacagcatgctgagcaccgccgcactccacagggcaggtgctgcaccacgtcggagcgtgctcgcacggggacgcacggctgcgaggaggaggaaggcgaggccgagcgcggtgatcgagacgttgatctcgtaggggttgtagttgccgaagtaggagatcagctctcccccaaaagccatgggatagacggcgagcggcgtgaagatccccgaaaacggtccggcaccggcgtagtgcgggggcaggtgggctcgcgtcgacagggcggtaaaggcgagcccgggtacccactggatcgctgcgagcatgagtgcttcgagcgcgcagatcgcgatgacgacgagatcacgaacgtcgagtcgtcgcccgagggtccacacgacggcggccaccgccaagacgacgaggcccgcgagcatggcttcgggcgcgccggcgagcacgtcgagcgcgaagccggcagcgagcccgagggcgttggcaagtcgagaggagcgtccgtaggcgaggcgagccaggaagacgaaggcaagcatccatcccgcgtcgccttcgatcatgtcgaggtggacactctggccgatcgccgcacccgtgagggcgaggacgaggccggcgacggtggcgaccttgaccccgatgcccagggttcgcgccgagagataccccgacagtgcgatggtcgcgaaggcggatccggcggcgacggagaaggcgagccccgtcgggaggacgatgaacgggatgatgaaggggctgaaggcacccgcgttgaagccagcggcgaggggcacgccgctccagatggcgggatcccacagtggccaggagccatggcgcaggtcgaggccgacgagcgtgcgaagcggtgcgttctgcgtcgcgttgtcgccaaagaggagtgggtgccccgcgagtgccgggacgacgaagaggacgatcgggacgacgatgaggatgacgacggctcggcgcgcaccggcatcgcccgtggtcgtcagcgcggcgcgatccatcgctcacgaagataggtacgcgccaccacgcgcccatagcgcaggccgtagcgccagttgcggcccttcttcgaggtgccggcgcggcgagcgaccatcgtgacagggaactcgacgatcgttgcgccggcgaacgctgcggcgaggaggagttcggcggattggtactggggctggtcgagccggagccgtccgaggagctcggccgcgatgacgcggatacccgatgacgtgtccccgacccgctgaccgatgagcgcggacacgacgagcgagaagactcgaacgccaaggtcgcggatggggtcgcccaccgtgctcgtgccgagtcggcgtgagccttgtgcgaacgtggcgacgtggtgatcgacgagatccacgcccgtcgcaaggtcggctgggtcccactggccatcggcgtcgacgatgccgacgatgcgtgcgccccgacggatcgcgaggaggtaaccgagacggagtgcagcgccttggccgcggttgatcgggacgtcgaggacgagcgcaccttcgcggcgtgccacgtcgacggtggcgtctcgggaaccatcggacacgacgacgacgagcggtggtgagccggcgagctgtcggggcacgcgccggatgacgtcggcgatggtggcttcctcgtcgaatgcggggatgaccaccatgactgccgcctcgggcaacctcgggttgtcgtcgtcgaagcgtgcgaggacgaggcggtcgatggcgtcatccgggtcgaaggctgcgctgcgcacgtcgggtgtgacgcgcacgggaccaccacctttctcgagccggatcctcgcgatgtccgaggctcggctcatcctaggggcgcgcgcgaggaggccagggccgagcgctgcgaaggcggcgcgaacagcgccaccgcggccccgatcggtgctagcatgcgctggcacaaaccctacggatagggtgcgaacgacacacgagggcactagttctgtggtagcgtttcgcaacacggtcgatcggctacggacggtggtggatcggggttcggggctggaggcctccagtccagaggtggaggacgagcaacgtcggtgggctgcgtcggtcggatgggacgcacgttcacgcggtcgtgactcagcaggccaacggacgttggcctgaccaagaaggggagtgagagggaggcgcagtggcaaggtccacgagtgcacggattcagcggcatttcacggctccggggctgcacccgtacgagacggtgggatgggagcgtcgcgacgcgcggatcacgaactggcgtaccggcgacgtcgcctttgagcaacgagacgtcgaggttcccgtgacgtggagccagaacgccacgaacattctcgcgcagaagtacttccggggccatctcggcacaccggagcgggagggctcgttgcgccaggtcgtcgatcggatcgtgaatcggatcgtggcctggggcgaggccgatggctacttcgccgacgacgacgagcgcgatgccttcgcggacgagttgcgctggctgctcgtccatcagcgagcggcgttcaactcgccggtctggttcaacatcggggtcgagggcgtgccgcagcaggcgagcgcctgtttcatcctctccgtcgatgacacgatggagtccatcttgaactggtaccacgaggaagggatcatcttcaagggtggttctggtgccggggtgaacctctccaccatccgctcctcggtcgagccgttggcaggtggtggcaccgcttcggggccggtgagcttcatgcgaggcgccgatgcctcagcgggcaccatcaagtcgggaggcaagacgcggcgggctgccaagatggtcatcttgaacgtcgaccaccccgacgtcgaggagttcgtctggacgaaggccatcgaggaacgcaaggcgcgcgtgctcgcagaagccggcttcgacatgggcgtcgacggcaaggatgcgttctcgatccagtaccagaacgccaacaactccgtgcgcgtgaccgatgagttcatgcaggccgtcgtcgaagaccgggagtgggaactgcgggcggtgacgacgggcgaggtcaccaagacggtgcgtgcccgtgacctcttccatcagatcgccgaggccgcctgggagtgcgctgatccagggctccagttcgacaccaccatcaatcgctggcataccacgccgaatgccgggcggatcaacgggtcgaatccgtgcttcccgggctcggccagggtccacaccaacaaaggcctcatcgccttcgaggagttgaccaggcgcgtgctcgatggcgaggagttcctggtctacacgcacgacagcacgagccctgacgatcctacggagcaggtgctgctctcctcgccagaggcgttcatggtcaccgggtacaaccaagtcgtcaagttgcgcttcgacaacggcgccgaacttcgctgcacaccgggacaccgcatcttcacggtcaatcgcggttacgtcgcggccgaggacctcaccccggaggacgaggtgcagctgctggatcttccggcgccagccacggatgcatcctgggtgttgccggtggcaaccgatccggagttctaccatcacaagggcgaccgccgcgacccgatgaccttcccagagcgctggagcgaggacttcgcccacttcttgggttggctcatcggagacgggtcgctctccaatgggacggtcgtggcgacctatgggtctccagacgaccagcaggagatcttgccgatccaccagcaactcctgctcgagatcaacggcaacaggcctctgaaggtgtcgacccaagccaacggcaccgtccagctgcgctttggcaggcaacggttcatgcggttcttggaagcgctcggcatgaagagggcgaagggaccggacaaggatgtgccgtgggcgatcgagcaggctccagcggagatcgtcggcgcctttcttcgaggcttgttcgacgccgatggcacggtgatcgtcgaccgcaacaaggggtcctacgtttcccttggctcgatctcgacgggcttgctccgctcggtgcagcgactgctgacgacgttcggcatcacgagccggatctacaagacgcgttcggggtcgtcgaatgggtcgttctcgtacaccgggcgtgatggggacgtgagggtgtacccgaaccacgatgcttatcagctacggatcacctcggcgtcgatcgtgcgcttcgccgagcacgtcgggttcggcctcggcgccaagcaggcgcggctgcgcgacatcgtgggtggacagcagtcctacgaggttcggcggacggcgcggctgacggagcgtctcgaggacgggatcgagctcacctacaacctgagcgagcccaagaaccattcctacatcgtcgatgggattgtggtccggaactgctcggagtacatgcatctcgacaactcgtcgtgcaatttggcttccatcaacctgcttgcctacctggacgaggacggcaacttcgacgtcgaggggttccgtcacacggcgcgagtgctcatcacggcgcaagacatcctcgccggcaacgccgactacccgacaccgaggatcgcggagacgtcgcgggcctatcggcaactcgggctcggctatgcgaatctcggggcgatgctgatggcgctcgggctcccatacgactcagacggcgggcgcgcctatgcggctgcggtgacggcgctcatgacaggagctgcgtacgagcgttctgcagagctcgccgagcgcctcggccccttcgctggatacgccgacgatgctgagtccatgctgcgggtgctcgggatgcatcgcgacgccttggcgaaggtcgatggcgctccggaggcgatcgtcgaggccgctcgtgcttcgtgggacatggccatcgcgcgcgcgagcgaggtcggcgtccgtaatgcccaggcatcgctgctcgcgccgaccggcacgatcgggtttctcatggactgtgacaccaccggtatcgagccggacttctcactggtgaagtacaagaccctcgtcggtggcggcaccatgaagatcgtcaaccagaccgtgccacgggcgttgcggacactggggtatccggagcacgagatcgaccagatcacggcctatctcgccgagcacgactccatcgtcggtgcgcctgggctcaagccggagcacgaagccgtcttcgcatgcgctgtcggggaatacccgatcagcccgacgggacacctcgcgatgatgggggccgtgcagccgttcctctctggtgcgatctcgaagacggtgaacctgccgagcacctccaccgttgaggacgtggagcagacatacctggatgcctggcggctcgggatcaaggcggtcgcgctctatcgcgacggatcgaaggtcggtcagcccctttcgacgacccatgaggaggattctgaggccatcacgtcgctcaaggaacagctgagcgagctcgaacgccagctcgcagcctcgcggacgcgccccgttcgggaacgcttgccgcgacaccggcggagccgtacctatgcgttccaggtcgctgacgccgagggctacgtgacggtcggggagtatgacgacggtcgtccgggcgaggtgttcgtcaaggtctccaagcaaggctcgacgctcgctggtgtgatggacgcgttctctatcgcagtgtcgctcgggctccagcacggcgtgcctctcgagacgttcgtgcgcaagtacgtcaacatgcgcttcgaaccggccggcatgaccgatgacccggatgtgcgcatcgcctcgagcctcgtcgactacatcttccgccggctcgccatcgactatctgccgcgagaggtgcgcgaggacctgggggtgctgacgacggcggagcggcgaacggagttgctgttcccagtcgaggaggtcagtgagccgacaacgcgtgcgagtgcgcagacgtactctcaggctgagcatcgcttggactcgggtcgggatgacgtcgtgcatgagactgcgactcgtgagagcgggctgcacgtctcggcgagcgcgtcggacgcaccgtactgcttctcgtgtggcaacgtcatgcagaggtctggctcgtgctacgtctgtcctgcgtgcgggacgacgagcggttgtagttaggtcgagcctgtcgcgagttttcgcgttgcgagttgcgagtttcgcgacccggggtagacgcagacggtgaagggtcatgatgcaaccaggggcgccgcatgagcggctcccctggtgctgtcatacggtagggcgggagccgccttggcagcggttcctcacatcgatgctgctctccggtgagaagagtcgggcctctgatccctgcgagcgatcggccgagtagccgcgtcggtcgcccgcagagatcgtggtcgcggtcgaggcgtcgggccggcgggacgagagcgagcagcgctctcgtcgtgaaccagggccgaacgtcgggtcgtgctggaccacaagtcccttcgtggacccgctctgggagcgacgccatggccctactaataccctctggggtatgacgaataccacaacgtcgcacgagcggccggagggggtggggcggcgcatcgtcgtcgtcggtggcgtcgctggcggtatgtcggctgctgcgcgtcttcggcgactctgtgagcatgcttccatcaccgtgatcgagcgatccggacacgtctcctacgccaactgcggtttgccctactacgtcggctcggtgatcgaggaccgtgaggacctcgtgctccagacgcccgaacgtctccaggcccgcttccggttggacgttcgagtcaacgccgaggttgtctcgatcgatcgtgagcgtcgcgaggtccgtgtccgcagcgtggagaccggtgaggcctcggtgctcccctacgacacgctcatcctgagtcctggggcggtcccgatccgcccgagcatccccggggcagaccggatgcgcgtgctgcgcaccgtcgaagatgccgaacggctcgcctcggaggtgacgacgcggcctcggagcgcgatcgtcgtcggcgcggggttcgtcggtctcgagacggcagaaaacctggctcaccatggcatcccagtgacggtggtcgaggcgcgatcgcaggtgctgccggtgctcgatccagaactcgccatcgcgatcgaagagacgctggagcgccacggcgtccgtgtgatcacgggggctggggtggccgaggtccatgcgtggggcgtcacgctcgacgatggccaggaggtcgagggagacctggtcgtggctgctgtcggtgtgcgtccggacgttcgactggctcgcgcagcagggctcgagctcggtccgcacggcggcatcctggtcgacgagacctctcgcacgagcgacccggcgatctatgccgtgggtgacgcggtcgagaaggtcgacgccatcagcggatcgctcgagctcgtgacgctcgcacatgtcgccaaccgccaaggccggcgagtcgccgatcacatctgtggacgcgcggtcgaggcgcgaccgtcgatcggcaccgcgatcgtgcgcatcttcgacacggtcgccgcatcgaccggcctgagcgaacagcgcctacgggcactcggtcgtgcgtaccaggtcgtgcgcgcgcaccccatgagtcacgcgagctactacccaggtgcccagccgatgtcgctcaaggtcatgttcgacccgagcgacgggcgcatcctcggcgcgcaggcggtcggcggcgaaggggtcgacaagcgcatcgacgtgctcgcgacggcgatcgcggcaggattgccggtcgacgagctcgcgaacctggagctcgcctatgcaccgcccttctcgtcggcgaaggaccccgtgaacatggtgggttacatcgccgagaacatccggagcggtacctgcgacgtggtggagccggaggaggtggagtcgctggtgcgcgatgggtggacgctgctcgatgtgcgcaccgccgaggagcatcggcacggtgcaatcccaggcagcgtctcggtaccggtcgacgagctgcgcgagcacctcgaatcgctcggggacgggccgttcgtggtctactgcgccgtcgggctccgtggtcacgtcgctaccacggcgctcctcgagcatggcttcaaggctcgcaacctgaacggtgggcatcgctcgtgggcagcgtggaaggctgctgaacgcatggcgctcgccgggtgagccggctgaggctcacccggccacgatcggcgtcaccatcgacccatggctaggcccgctcggattctgccgtggtggcgaagtagtcgcggtactggcttcgaaggaggtgcttctggaccttgccggtggcggtgcgtgggagttcgtcgacgaggatcaccgcctttggcaccttgaagccggggagggcgctgcgggccgcggcgaggacgtcggtctcggtgagtcctgagccggggcgtggccgtacgatcgcaacgactgcctcggtccagtgcgcgtgcggcaggcccaccacgacgacctcgtcgatgcgcggctcagctccgtagagtgcacgctcgacctcgagggatgcgacgttctcgccgcccgtcttgatcacgtccttgcggcgatcctcgaaccacagcaccccgtcggcatcgaggtaacccacgtcgccggagtggaaccatcccccggcgaacgcctcgttcgtcgcctgctcgtcgtggagatagccctgcatcgcgtgaggaccgcgatagacgatctcgccacgcgtgtaagcgggcacgagctcgccggcgtcgttcacgatggcgacctgcacgttcggcaccgcgccccccacggcaccggcgtgggagagctgttgctccgggaggagcacggtggtgaggggattcatctcggtttggccgaagccgagggcgaggtcgcagccgagcacctccgtcacgcgcttgacgtcggtctcggccatgggcgccatggcgtagatcccgagtcggaggctcgagaggtcgcggcgggagacgtcggggtgatcgatgagcgcgcggtacatcatcggcaggaggaagatctgcgtgatccgttcgcgctcgatgctcgcgagcagagccgcagcgtcgaaggatcggtgcaggacgacggtgccgccgaggtagagcaggcccgtggtgaggccgttcagctgcgccgtgtggaacagtggcatcacgacggcactgcggtcggcgtcgctgtagtgcatcacgatcggaccggtgagcgactcgatgtagaccgcgacgtgactcgagaccacacccttgggcgccgacgtggtgccactcgtgtagaggtaggtcagcggatctcggtcgtcgacgaagcaggccggctcgctggttgcgttcgggtcgacgaaggcatcgagcgtgtgccaggtgccctgtggcgctggttcccactcggcccctgttccaggggcgacgatgacgtcgacgaggtcgtggtgctcggcgatcgccagcgcaccggagatgagggggacgaactgggcctcgaccaccgcgccgcgggctctggcgtggccgagcacgtaggccagctcgttgggcccccacgccagattgatgggcacgcagacggtgccggtcttggcgcaggcgtagtaggtgacgaggaactcgatgctgttgccgctgatgagcaggagtgcggtgcccctgccatagcccgcgtcgaggagggcatgggcgaatgcgttcacacggtcgttcagcgctcggtaggtcagtcgctcgtcgcccgcgatcaccgcctccttctcgccgagacgccacgcgctccgcgtgagcatgtcgccgacgttgacgcgctgaatcaggttgcgttcgagatcgtgcgatgtcatggttccccctgtcctcggggccggtcctcggggcctgtcctcgagcgtgtgctcggagctacgtgcgccagaccacctcgccccccgctcgttggcaagtatgccaggggctggtctcgctgtcgagggatcgaggaccgtctcggcgggcgggtgcgatcacccgtgagaaggtgcgatcagggagcgaggccgatggcgcgcgcccagatctcggtcatcgcatcgacggcggcctcgtcgtcgaaggggaggccgaggtcgtggctgcgctcgacgaagttctcgaccatcccgcacagcaacgccgccgtcacgtcggcgtcgagggtcgggtcggcgactccttgcgcttggagctggcggaggccacgagtggcccgctcgatgaacaccgagcgcgaggcgagtcggcgacgtcggacctcgtcgttgaaggacgcggcctggacgatcactccgtagaggttcccatggcgacggaacgcctcgacgaagcgcgcgttcgaggtgcggatgcgctggcgtgggtctggaccggcgacttccccgacgtgcgactgctcgtagagcgcggcgatgaacgcatcgacgagcgcgacgaagatcgcgtccttcgagtcgaagtaggtgtagaaggtcccgatcgcgacgttcgcgcgctcggcgatgtcgctcacccgggtctcgaggaagccacgctcctcgaagacggcacgagcggcctcgagcagccggtccctggtacgccgtccgcgttcggtgaccggggcggcgctcatcgcctcggctcgccggagcgctcgacgagtcgcacggtcggggtcgggagctggtcgaggctccggggatcattgcgtgcggtcacggtgacgggtacgctaccagatgaaagtgacgtcaggttcatgttctggcatcggcgtggccggcggccctcgcggtcgcctcgaatcgaggggggagcatgcgcttcaccgaggagcacgacgtctttcgacgcagcgtacgtggggtgctcgagcgcgaggtgctcccgcacctggaggagtgggaacgggctcacagcttcccgggccatacggtcttcaaggccctcggcgccgccggtctgctcggcctcgagtacgacccggcctacggcggccagggcgcggaccactcctacacggtcattttcggcgaggagctcggtcgcatgggcttcggggcgctcgccatggccatctcggtggtgaccgacatggcgaccccgtcgctggcccgttacggctcgcacgaactcaagctgcactatctcgtgccgaccctgcggggggactccatcgcatcggtcgcggtgtcggagccggacgcgggttctgacgtcgcggcgctccggactcgcgccgtgcgcgacggcgacgactgggtcatcaccggcaccaagctctacatcacgaatggcacccaggcagactggatctgcctgcttgcgcgcacgagcgatgagggcggctatcgggggatgtcccagatcgtcgtcccgaccgacgcgccggggtttcgggtcgcgcgcgccctcgacaagctcggcaaccacgcctccgacaccgccgagctggtgctcgaggagtgtcgcgtgcccgtgtcgaacaccatcgggaccatcgggcggggcttccagcagcagatggcacagttccagaacgagcgcatgatcgcgtcctactcggcggtcggcgcgatggaacgtgcgctcgagcgaaccgcggcctatgcacgcgagcggatggtcttcggggagccactccttgccaagcagtacgtgcagtttcgcttggcggagctcagcgccgaggtcgatctgcttcgtcactacaactacgcgtgcgccgaggcctatatggcaggcgaggacaccacgcgctttgccaccattgccaagctcaccgcgggccgcctgagccgcgccgtcgctgactggtgtctgcagctccacggtggggctggctacatggaggagacgtgggtgtcgcgctacttccgcgatgcgcggctcctctcgatcggaggcggtgccgacgaggtgatgctccagatcctgacgcgcctcgagggctacgagccatgagcggatccgggctcgatctcgtcgggctcatcgacgacctccaggccgagcaccgaaccctccgtgcgaccctccacgacgcagggtgggaggtgtgggagctcccgacgcgcgcagcgccgtggcggatccgagagcaggtggcccacctcaccttcttcgacgaggtggccatgtggtcgatcgaccaccctgagcgcctcgacacactgcgcgccgcgttcgacgcatccatcgatccgagcgagcgcgccgacgtggtctgggcacgcgagctcgctccccagaccctctgggagcgctggtgccgagcgaacgacactctcgttacccggctcgcccggctcgtcgacgaggatcccggacggcgcctcgactggatcgggccgtcgatggggcttgcgagcttcgtgagcgcgcggctcatggagacctgggcacacggggtcgacgtcgtcaacgcactcggccacgacgtggcggacacggtgagcgaccggcttcgccacgtgtgctttctcggttgggccgcgagacgcttcgcccttgcgacccacggcatcaccgacctcgacgatccactccgactcgaagcgatcgggccctcgggcgagctctgggcctgggggcccgaggatgccccgaatcgcgtgcgcggctcggcgctcgagatcgccctcgtcgtgacgcagcgacgccacgtgtcacgcacctcggtcgaggccacgggggcgcttgctcgtcgttggctcgaggtcgcccaggccttcgccggcccaccgacggtcgcctcgaaggagcgctgagccgtggcagcgccgatcctcgaacgccccgtcgacccgcgcgacccaggcttcgtcgcgaaccgggcggcgatggtcgagctcgtggaacagctcgagtcgctcctcgaccaagccgctctcgggggaggtgccgaggcccacgcgcgcagggccgcgcgaggcctgctcggggtgcgcgaacgtgtcggcctcctcgtcgatccggagagccccttcctcgagctgtcacccctggctggctatgggacggagtaccgactcggtggcgccatggtgcttggcatcggcgtcgtggaggggaccgagtgcgtcatcgtcgcgaacgacccatcggatctcggcggtgccctcacgcagatcagcgtgcgcaagctcctccgagggctcgagatcgctcgcgcgaatcggatgccgctcatccagctggtcgagtcggccgggggcgacctgcggggcttcgtaccaggcgacgatccggacgctgccctgcgtcgcaacctcgagcacttcgccacctccggccgcatgttccacgacatcaccaccctctctgccgagggcatcccgacgatcgccgtcgtgttcggctcgtcgaccgctggtggtgcgtaccaaccaggcctctccgactacaccatcctcgttcgcgaccgcgcgaaggtgttcctcggcggcccgccgctcgtgcgcatggcgaccggcgagctctccagcgacgaggagctcggcggcgccgagatgcacgcgacggtgagcggcctcgccgactatctcgcacgagacgagctcgacgccatccgcagcgcacgcagcgtcgtcgcccatctccagtggcgcaaggcgggtcccgggccggttcggcgcgatcctcgaccgccgcgctacgaccccgaggagctcctcgggctcatgcccatcgatctgcgcggcccggtcgacatgcgggcgatcatcgcgcgcatcgtcgacgacagccgtttcgaagagttcaagccctcctacggccccacgctcatcaccggatgggccgaggtgcacggctttgcggtcggcatcgtcgccaacgacggtgtgctcctctcggaggcgtctgccaagggggcgcagttcatccagctgtgcaaccagcgcgcgacgccgctcgtgttcttgcagcacatcaccggcttcatggtggggagcgactacgagcggtccgggatcatcaagcacggcagtcagctcatcaacgcggtctcgaactcgaccgtgcctcacgtgacgatcatcctcggtgcgagctacggtgcgggcaactacgccatgagcggtcaggcgttcgacacgcggttcgtgttcgcgtggccgacggcccggatcgcgatcatgggaccgacccagatggcgggtgtgatgtcgatcgtacggcacgagcaggcagctcggcgcggcgtcgagatcgacgaggaggccgaagcggtgcttcggtctcgggtcgaggcgttcgcgcacgcccagtcgttagcgctctacgcgacgggccgcgtcgccgacgacggcgtgatcgacccgcgcgacacccgcgacgtcgtgggcatggcgctctctgcgtgtcacagcgcgccggtcatcggggctcggggctacggagtgttccgcctatgatccgccgcctgctcatcgccaaccgtggcgagatcgtcgctcggatcgcgcgcacggcgcgcatgctcggtatctggaccgtgggggtgtacgcgccgcccgatcgctcagcgccgtggctggacgcgaccgatgacgtgatcgggttgatcggtgacggcgtccaggagacctacctgagtgtcgaggcgctcctgcgggcggcgcagcgtgtcggtgcggatgcgctccaccctggctacgggttcttgtcggaacatccgggctttgccgaagccgtgatcgccgccggcctcacgtggatcgggccgccaccggaggccatcgccctcatgggcgacaaggagcgcgccaaggcacacatggctcgcgcgggtgtgccgacgctaccgacgttcgcgcccgacgacccggacgtcgtgctgccggtcctcgtgaagcccactgccggcggcgggggcaagggcatggacgtcgtgcgcgagcgtgcggcgctcggcgcggccatcgacgctgctcgacgcacggctgcgggcgccttcggcgacgatcgggtcttcctcgagcgcttcgtcgaggtgggtcgacacgtcgagatccaggtggtcgccgacgggcacggggcagtggtgcactgcttcgagcgtgagtgctccatccagcgtcgtcaccagaaggtgctcgaggaggcgccctcgccggtcctcgatgcggaccttcgcgagcgcatgggggcagcggcgtgcgcggccgctcgcgcggtcggctaccgaggcgtggggacggtcgagttcctcctcgagcccgacgggtcgtactggttcctcgagatgaacacgcgcctccaggtcgagcacccggtgaccgaagccatcaccggcatcgacctcgtcgccgagcagctgcgcatcgccgagggccgaccgacgtcgctgcgccaggacggcctcggcatcgacggccacgcgatcgaggtccgcctctacgcggaggacccggcggccgggttcttgccccagaccggcacgctcgtcgagtgggcgcctgcggacgagcctgggatccggtgggattcggccgtggcgacgggcaccacggtcgcgatcgagtacgacccactgctcgccaaggtcatcgcgcacgctccgacgcgcgacgaggctgcccgtctgctcgctcgagccttgcgccgtagccggatccgtggcgtgacgacgaaccgggcgttcctcgtcgccctgctcgagcacccggagttcctcgccggtgcgacgaccaccgacttcatcgagcgcactggcatcgcccatctcgctgcggcgcatgcgcctctcgctgacgatgcgctcatcgcggcgtcgcttcgcgcacgtgccgacgaccgggctcgggtggagctcgcgacgacgctgcctgcgggtcggcgcctcgggcggctgccggcgacggcacgtacctggcgcgtcggcgacgaggtgcgcacggtcgcgctcacggaggatcgcgccgggcggttgtggatcggggatcgtcggctcgatcgggtgggggtcgaaggcggctgggtcgagtggttcgagcgggaggtgggctgcgagcttcgacgccggttccacgtgctgcgcgacggcgacaccttctacgtccagggcgacggggtggatgtgcgcatcgagcgcgtcgatccgtttgccgggcctgccacagagcccgcccttcggggcggcctcgaggcgccgatgcccggacgggtcctctcggtggaggtgggggtcggcgatcgggtacgcgccggggcgctgctcgcgatcctcgaggcgatgaagatggagcaccacgtcctcgcgccccacgacggcgtgatcggcgaggtgcgcgtggcggtcggggagcaggtcgatcgcggcgacgtgctggtggtcctcgaggaggggtagatggcgcgcccggttcgcatcgccaacgtgagtggcttctggggcgatcgcgtggccgccgcgcgcgagatggtcgacggcgggccggtagatgtgttgacgggggactggctcgccgagctcaccatggtcatcctcgcgcgccagcgggcccgagatccgctggccggctttgcgacctcctttctcacccaggtcgaggacgtgctcggcacctgtctcgatcgcgggatccgcttcgtcgccaacgcaggcggtctcgcacccgagcgttgcgcagcggcggtggaggcgatcgcagcccggctcggactcgcaccacgcgtggcgttcgtcgacggcgacgacctcgcaggttcgctcgaggcgatcgcagccggcgggacgccactcgtgcacgccgagacgggagaggccctcggtcagcggacggtcctcacggcgaacgcctacctcgggggctggggcatccgcaccgcgctcgacgacgacgccgacgtcgtcgtcactggacgcgtcgccgacgcatcgctcgtcgtaggggcggcagcgtggcaccacggttgggctcgcaccgatttcgaccgaatcgccggcgccatcgtggctgggcacgcgatcgagtgcggcacccaggtcaccgggggcaactacgccttcttcgacgagatcccgaacgccctccacctcggcttcccgatcgccgaggtcgcagacgacgggagtgccatcatcaccaagcaccccggtcacggtggtgcggtcaccgtcgggaccgtgaccgcacagctgctctacgagatcggggcgccgagctacgtcggaccggatgcgatcgcgcgcttcgacacgatcgtgctcgaggacctcggacacgatcgagtccgcattcacggcgtgcgcggggagccacctccccgaaccgccaaggttgggctcgccgtcgcagacggatggcgcctccgcctcggggttgcgatcaccggactcgacgtcgaggccaaggccgctctcttcgagcggcagctgcgcgcagccaccgagggtctcgggctgcgtcgactcgaggcgcacctcgtgcgcaccgacaagcgcgatccgcgctccaatgaggaggcgaccgccactctcgagatctccgccgacgccgacgacgaggcggtggtcgggcgagctctccgcgctcgcgtgaccgagctcgcactcgcgtccttcccgggcctctgggtgagaggggtcacggcccgcccagagcccttggtgcgcttctggccgaccttcgtcggctgggaatggattcacgaacgcgtcaccacgccatcggcgacgatcacgctggagccgccgccgtggagcgacggcgcgcatcgcgaggtcgcccaacccgagcccgccgtcgatgcgaccgtccagccgagcgatgcgttcggcccgtgccggatcgtgccgctcggtcggctcgtcggagcgcgctcgggcgacaaggggggctcggcgaacctcggggtgtgggccagaacggaggaagcctacgcctggctcgctggcttcttggacgtcgacgagctccgaaggctgctgccggaggttgcgccgctccaggtcgagcgctgtgcactccccaacctgcgagcgctcaacttcgtcatccatggactgctcggggagggcgcctcagcaccgcgacgggcggatgcgcaggccaagagtcttggcgaatggctgcgtgcccgactcgtccctattccgctacggttcctcgtgtgagcgagactgacgagatcctgctcctcgagcgtcgagacggcgtggtgaggatgaccctgaacgacgtcgcgcgacggaacgcgctctcgccagcgctcctcgatgcgctccatggtgccctgcgcgaggggagcagtgatgaggacgtgcgcgccatggtgatcacgaacgcgggatccgtcttttgcgcgggagccgatctcgccgcggcgggcacgagcgccggcgatcacgcgacgctcgccgacgtcctccttgccatcgaggagtccccgaagccggtcatcggccgcatcggcggacatgccttcggcggcgggctcgggctggctgcagcgtgcgacatctccatcgcttcgtcggaggcgcgcttcggcttcaccgaggtgcgcctcggtgtcgcacccgccatcatctcggtggtgtgcctcccgaagctgcgtcgcagcgacgcgctcgagctcttcttgaccgcagaacgcttcgaggcgactcgtgccgtcgcgagtgggctcatcacccgtgccgtcgagcccgctcgactcgacgccgaggtcgacgaggtgatcgctgccgtcctccgcggtgctccaggggcgctcgcggtcgcgaagcgcctcgccctcggtcacgatcgcgaggcctcgcgcgaggcctatgccgccatgaccgagctctcgcaggcgctgtttgcgggtgcggaggctgccgagggcatcgcggctttccgagagcgccgagctgccgcctgggttccactcgggctcgggggcgcacgcacctgagcccggtgcgagccgtggccgcgcgacagtgcagtcgcggcatctcgcgcgccgtcggtggatcgtgatcgcagatcccctcgcgcaagggtctcgtgccttgctcgaaccgcccggtcgtccgcggagacggtggggcgagcgcctggcggtgctggtgcgtgccggcccaggagacttcggctcgatggcgcacggcaagcgggcctcatcacgacgagcagggtccgagaggtccaacggtgggcctctccagcggccatcaccctgtgctgcggcgtcatcacggatcttctggacctcgccgcgggcggcggctaccatatcgtcaccattgcgagcgatgaagggggagatgagggtatgaccacagttccgtccggcgacggggataccgcgtcgggccatccgcggctcaggcacaacgcgctcggcgtcggtgacatcctcggggtgtcgttggccgatacggcgccggccatgagctttttcttttcgttcgccgcgatcgctgcggccgcaggcgtggcttcgccgatcgcgatcgtcgtcgccgcgatcgccgttctgctcaagctcaacagcctggtcgagttcaccaaggtgataccgagtgccgggtcgtacgtgtcctacatcgccaaggcgttcggcggtcgggtgggtgtggtcaccgcgtgggccctcgggttcggctacatcgtcgcggtcggctacgtgatggcggtgatgggtggcttcacctcccaggtgatccagcaatacctgcacgtccacgtgccctggcaaccgatcgcggtcgtcttcgtggtgctcgtgtcctacctcgtctatcgaggcgtcaccatcagtgcacgctgggcaagcgcctcgttcgcgttcgaactcgcgctgatcgtcgtagccatgattgccatcgttgtccactaccacaaccagctctcgctcgtgagcctcgatcccgccaagatctcgcggggcatctcgggtctcgggctcgccttcccgctggcggtgttcctcttcatcggcgtcgggaatccgggtgcgatggtggaggagacgcgtgatgcgcgccggagcgttccgcgagcgatctacacagcggtcatcgttgccaccatcatctacgtcctcatggcggtgacgacgtcgatcgcgttccacaacgatccgacgaccatcggcaaccttgccgcgcccttcgtgacggcggcgagccatgcactcgggccctttgcgatcctcgtctacctggccggcttgaccagcacgttctcgtcgctgctcggggcgacgacggcgcagacacggatcttgttcagcgcggggcgcgacggcatgttgccacgaggtctcgcgcgcctctcctcgcggcaccagaccccggtgagcgcgctcgcggtgtactggatcggggccggggtcatgaccttgatctgggccagcaccggcaacccgctggtgcttgccggtgacatcgccaccctcggaaccatcccgatcgcgctgacctacctcgcgctcaacatcgcactgccggtgtactacctgcgcttccaccgcgaggcgttcgccccgctgcgccatctcgtgatccctgtccttggcgttgcctcgctcatcttgccgctgtggggcctgatcaagcctggtcagccctacccgttcaacgtgttcccctacatcgcactcgcggtgatcgcgatcggtgtggtggtctcgctcgccacgggtcatcgtgtccggccgcttgccgaggcaccgttcgatccgctcgctgaggccaccgactgagatcgcccgagcccagctacgacactgccccggccagacgtggccggggcagtgtcgtgtgatgggtcacggcaggagaacggctcaggcggagcgagcggacccgcgagcctcggagaagagatcgtcgtcgggatcgaggaccccgagcgtgtccgcgatggcctcgacgaggcttgccgcggtctcggaggttgcgccctcaccgagcgtctccgcgatgaccgcacggcgcgcatcgtcgagtgcggcccgagcggttcgccccgcctcggtgagctcgatgacgtccgcgtcggtgcgcacgaggccagcgtcgcggagtcgagcgagcgcgtcggacagatcccagccggctcgcgtcgccatcgtgagcgtgctctgtggcagccgcccatcgcgcgcccggaagagcagccaggtcgccgccggagtcgtgccgagtccggcgtcttgtgcgagtcgtcgatacagccgctcgacaccgccgtcgcgtgagagccgttcgaggacgcggctgatggcgtccttggcgggatcggcttcgggcatggcgaatccctcaccgaggtccgcggccgcgacggagcggcgcaggcgcagctcgggcaggaagagcgtgagcacgaaggccaagaggccgatcggcgctgcgacgaggaagactcggtccagggagcttgcgaacgcgtgcaggagctggggcaggatctgggccgggatggcggtgagtgccttcgggctctcctcggcctgaaccgccaggttggccgggaggtggtagcgggtggcgacggcagcgagcttggagtcgagcgcattggtgaagatcgagccgaagatcgccacgccgaacgaggcgccgatggagcggaagaacgtcgccccagaggttgcgacgccgaggtcttcgtagcccaccgcgttctgcaccgcgatgacgagcacctgcatcacgccgccgatccccaccccgagcacgatcatgtcgaaggcgatgacgccgtaggacgtgtgcacgctgaggcggctcagcagccacagtccgaccgtcatgagggccgtgccgacgatcgggaagaccttgtagcgcccgaatcgactgatgagcaggcctgccccgatgctcatgacgagcaggccggccatgagcggcagcagctggatcccgctgaccgtgggggaggcaccgcgaacgatctgcaagaaggtggggaggaaggtgattgcgccgaacatcgcaaagccgaccacgaacccgatcgcactcgtcatcgagaaggtgcggttgcggaagaggcccatgcgcaagatgggctcggaggcgcgctgctcgacgaggacgaaggcgaccagggcgacggtggatgcgatcgtgagggtgatgatctgccacgaaccccatgggtacgtcaacccaccgagggtcgtgacgaggatgtagccggtcgcggcgagggccacgagcagcgtgccgaggtagtcgacgcgatgctggacgcgcgtggagagctggggcagggcgctcgagatcaccgcgatcgcgatgatgccgatgggcaggttgatgtagaacacccagcgccacgagagcgagtcgacgaagaagccaccgagcaacggtccgacgacgctcgcgaccccgaagatcgcgccgaagagcccctggtacttgccccgatcgcgcggtgacaccacgtcgccgatgatcgcttgcgcgcccacgatgaggccaccgccaccgagtccctggagaccgcggaacagaatcagctccagcatgttctgcgacaggccggagagcgccgaaccgacgaggaagatgaggatcgcgagctggaagaagcgcttgcgtccgtagaggtcgccgagcttgccccacagcggcgtcgaggcggtcgaggcgatgaggtatgccgtgaccacccagctcaggtggctgaagccatgcaggtcgttggcgatggtcgggagtgcggtggcgacgatggtctgatcgagggctgccaccagcatcccgagcaagaggccagtgagaatcagcccaaggcgagcgccgtgggcgcgtaccgtcgacgacggcgagagcgtggtgtcggtcatcgaatcctcctggtggtggtgtcggtcatggtgtggtcgaaggcactctggagatcggctccgaagcgccgaagtaggtgggcgagtgttgcaatgtcatcgtcgttccagtcggcgagcgcgtcgtcgaggaatcgtcgatgtccctcgcggatctgggcgaggtgtgctcgtcccttgtcggtaagggcgatgacctgcgccctgcggtcgttggcgtcactgcgacgcgtgacgtagccgagagcttcgaggctcgcgacgtgccgactggcgaccgagtgcgagaggccaaggtcgctggccacctcgccgaggcgcctgggtccgagcttcgcgagtacgccgaggatcgccagcgcgccaccttcgatctcgaggccgagggcgcgggcgagcggaccggtgtgttggcgcgcgatcctcgagagacgcgacagctcctcccagaccgcgctgacatcggctcgcgtcggagcgacgtcaccggaagcgcgcataatggtcgtcctctcattcatcggcgctcccgtctcctgggatcgtcgacggggcttgctcaataggtgtgtgacgaacacaacaatagacggtgcgtcgatgttcccgaccgcgtgccggcttgtggtccgatcggtgctcgagcgccatcagccagctctccgcgcggacaggcccttgcgtctgctgcagcggtcgcggatcgcggttcgtcaccagggggtcgataggctgccggctggggagcgagggagagccgacggtgtcgtatggagttgttggtccgctgctgcgcaatcgcagggccggaccttcgtcgttgttgtgggcgagcccggaggcacggggccctgagacgctcgtcgtcagctctccggcctttcgcgatggcgagccgctgccagatcgctaccgcggtcgcatggtcgggctgaacgtctcaccgccgcttcggtggtcgacgccacccgcgtcagccgtcgagctcgtcctcgtggtcgaggatccggacgcaccgcggcgccgggcaccggtgcacgcagtcgcacgaggcatcgagccggtgctcgagttcttgcccgaaggcgccctcgctcggccgagttcggtaccgggggtcgtgctcggcaagggactcctcggacagcaggcctgggtgggtccgatgccgctgcgcgcccacggtccgcaccactacacgttccagctcttcgcgctcgacgtccggctcgacctgccaagggtcttcacccgcgacgatgtacgcaccgcgatggacggccacgtcgttgcacggggtcagctggtggggacctacgaacgctgaacccctcggtcggcgcgagcgtggtgcgtcgtgttcggatcacgccgacggggactcgtcgaggcgagtcggtagctgggatcggtagatcgagtcgtcgacggccttgacgatcagccaggcgatcgcgaccgcgatcatcgctggtcccaacaaggcgatggtgccggtcatctccgcgaccatcagcatcaccgcgatcggtgcacgagagatgccgccgaacatcgccatcatgcccactacgacgaaggcggaggcgtcgtggccgatcgctgggacgagcggtgcgaggatgcgccagaccgcaaggccggtgaaggcaccgatgaccatgccgggcccgaacacgccaccggagcctccggtgccgatcgacagcgacgtcgcgacgatgcgagcgatgggcagcaccacgatcacgaggagcggggtgtggagcatctggtcgctgagacccttctggacccatccatagccggtcccgagcacctcggggagccagagggcgaggagaccgacgaggaggccgccgatcgccggacggaagtgtcgagggatcgggagccgtcgagcaaggcgcaccgtgccgtagaacgagcgcgcgtacagcaggccgatggccccggccacgaccccgacgatggcgaaccacacgagggtgagcggcgtcgtgagctcgaagtggccagcgacggcgaacagggggcggaacccgtagacagcgtcgaagatcgccgaggcgatgagcgaggcgagcagccctgggagcagtgcttcgtactcgaagtcgtcgcggtagacgatctcggccgcgagcacggcgccaccgagcggggcgccgaagatggcaccgatcccagacccgatcccgaccgagaccgcgacgcgcccgtcctcggtgccgaggtcgaggactcgagcaagcagcgagccgaagccggcgctgatctgggcggtgggtccctcgcgtccacccgagccacccgatccgatggtcagcgccgaggcgatgatcttgacgacgaccgcgcgcagacggataccccgggggtcgtggaggacggcatcgatggcggcgtccgtcccgtgcccctctgcttcgggtgcgagcgtgaacaccagcatgcccgcgccgatggcgcccagcaccacgctgagggggatcgcccatggccgcgcgtagtggagcgatcctggagcattgccctctccggctggcgtcgggacctgatagccggcgagcacggcgaggaactcatgggtggcgaacgtgagggccgcgtagaagatgacggcgccggccccggcgatgacgccgagcgcgatcgcgaggatcacccgtcgtagcagcgtgggctgccgacgaagccaccgtgacgtctgcgttcggatcgtcatcgccgagatcctcctgatcgacgagcaccgtctcgatgtgcgctcgagcgagggtgccaccgatcgggcgtcgcggctgggtcatcgagtcctctcgtcacgggtgctcctctggttctcgagactggccctgggccaggtgccggtcgcgggctccctcgatcaggaagttcaacgagatcgcgaactgctcgaccgtcgtgaagcgcgcgaggtccgcttccatcgggtcacgcggtacgtgctggttgcggaggcgctcggcgcgcaggacagcgaagccgatggtgtaggtgtggagggcggcgtagacctgatgggctgcctccggcgtgaacccgcccgccgcgagccgcgttgccatcgcgtccatacgggtacgagcgagctgcgtcgcgacgggccgacggaggtagagctcgagaagcggcgggtaggcgaggagcagctccagcagccgcgtggcggcgtcgacgatccagtcgcgccaggggagcgaagggtcaggctcccatcggttcgcgaagagcttgtcgaggagcgcttcgaggagatcgtcgcggtctcggacgtggccgtagatcgtcatcggcgccacgccgagcctgcgggcaagggtgcgcatggtgagcccgctcccgctcggatcggtcgcgagcgactcgagggctgcggcgacgacacgctcccgcgtgagcgcgactcgccgagacgtggtcggtttcgagccggcgccgccgactgctccagcatgcacgacgatcagcctagcgcgtctatccgtacgcgtacggcactggttcaccgagattacgcgccgcgagtggcgaggcgacgagtacggacacggcgcccgtggggcgacactcctgcagccgacgacgggcggtgagccctcgctgtgggtcgatcgtcggcgagactcagtcggatgccgcaggggtcgggttcgtctcgctgggcgatgccatgatgcgacgagatcgacgagcccgcggtcgtgtggaggccgtcgccgcctcggctgcgagagccgcctcccgcgagggtgcgaccatgtcggactcgagctcgtcgaaggagcggatgccgaggagtgccatggtgcgcgtgacgccgtcggcgaggatgcgccctgcgaccgcgacgccgcgctctcccccggccatgaggccatagaggtaggcccgcccgacgagcacgaactgtgctcccaggccgatcgcggccacgacatcggatccggcgcgtacgccgccgtcgacccatacctccacccggccatcgagacgctctcggacgatgggtaggagcgcgaggggcgcgagggttcgatcgagctggcgccccccgtggttggagaccacgatggcgtcgaccccgatcgcagcgaggcgctcggcgtcgtcgatacgctggacgcccttcacgacgatcttgcccgaccacagcgatcgaacccactcgatgtcgtcgaaggtgacggtgggatcgaacatgcggtcgatgaaggagccagcggtcccttcgaagcccgtctcgagcgatgcgaagcgaacgggcggcttggtgagaaaatctcgcgaccacgctggatgcagtgcaccctggaggaacgtccgaagcgagggtgtcggcggcagcgtgaggccgttgcgcacgtcacgcatgcgtgccccggccacggggacgtcgacggtcaggattaatgcctcgaaccccgcctctcgggctcgctcgacgaaggcccgggtcggaccccgatcgcgccagacgtagagctggaaccagcgacgcaggtgcggcagttcggccgcgagttcttccggcgtggtcgtaccgaccgtcgagaggccataggggataccaagagacgctgcgacacgaccgaccgcgagttcgccgtcggtgtgcatcatgcgtgtgaagcccgtcggggcaaagccgaaggggagcgcactcggactgccgaggacggtccaggtcgggtcaaccgagctgacgtcacgcaggacatggggtcggaagacgacgtcggcgaacgagccctcgttgcgaagcatggaccgctccgcttcggcggcgccgtcgacgtagtcgaagaccggccgaggggtacggagcttggcgagacgccgcaggtcgtcgatcgttgcggcccggtccagggtcggcaggagcgtgcgcaggccacctcgtggcttgatgaggtcccagcgctcgcgcagctcgtgcactcgtgtcacgtccacctcccatcgcgtcgcgtgaggatcggtggcgagggcgaccggctccacgaggccgccgatggagtacgccgcacggtgagtcagcgcctcgcctgcagcgcctcgacgatgaagcgccgttcctcgctcccttcgacgaagaactcggcgacgggatgataggtgtccgccgttcgcacgatgcgctcggcgacctcgcagcgtcggagcagttctccaatgccgagagtgtccaggatggcccgcggatcgctgacattggcgcagccatgagccgccagaagttcggcgagcgtcgcgctcagggtttcgaggccctcgtcgatggatggcgcgtgcgcgctgtcgtagtcagccatggacacctccgcctcgctggtgagtgtagctcggtcctctgctgggtgctggacggccaggtggacgcacacaatcccgcgaccggccgaagtctcggagtacttcgtcgtggctgcagggatcgatgatcgcgcgccgtgcaacctgcgcagtgtggctcgcgtcgatcaggtcggaagcgctcgcccgcgcgaacgggtccgtcgaggcgaccggggagcgaggagtcgttccgggtcgaacgtgcgcgcgagcaccgcgaggccgacgatctcgacgaggaggagcgcacctgcgagtgcaacgccgtcggccacgctcaggctgataactccttgcacgagtaagacgatcacgaggaggaccgggacggacgcaagcgccgagagctgctgtgccacgcgaacatcactcgcacgactggatgcgaacagtccaaccagcaccgcccaaccgctgagcagcacatcgaggccgagttgacgcacgacgaggggagcggtgatgagatgggcactgaccgatgcggcggctgcgaagtgaacgacgacgagggtgagcgcgtacaggccccacgatccgatgaacgtcggcgcgaggacggcgagcagcttggcgacgtagagttcggtcgcgctgaggggggagctgagcagcggctcgagcgtcccctgatcccgctcgccgacgatggcaaagcccgccagcacgcccgggagcacgagcggggggagcaggaactcgatgctgctcgccgtcgtcaccttgtcgaggagggacatgggggcagcttccggcagcgaggtcagggagagcaccggcgcgaccagcgaaatgaggggcagagcgaccatgctgtagagcacgtagcggttccgacgaaagtcggtgaactccttggcgatgaccgcccgtatccgccaccacgtcatcgatcgctctccttggtttcgcccccgacaagctcgaggtagacctcttccaagcgctctcgggggcttgcgagctcgaggaggcggtcaccggcgtggaccagcgcctccgcgacgactggtgccagctcgtccggctcagctccgtcgatgcgcaacgtgtgttcgtcggtgacgacgacatgggcggcctcgacgacgggtgcgagatgcgccttggcgtcctctgcggcacctccgacgcggacgacgagggaccgctgactcccgagtccgagttcccctggcttgccgacagcgaggagacgctgacgaaggatcgcgacgcgatcgcacacccgttccgcctcatcgagccgatgcgtcgtgatgagtacggtgcggccctgggctcgcagactggcaatgagttcgagaacatcgcgggctgcgaccgggtcgagaccggacgtgggttcgtcgaggaagatcagttccggctggccgaggagcgtacgagcgatggcgacgcgctgacggagacccttcgacagggcgcgacaggcatcgtcgcgtcgactcgagagatcgaccgcgtcgagggcctcacgaatggcgcggtcgacgtcgtggactccgtagagccgtgcgaacaggcgcaggttctcgacgacgctgaggttgccgtagaggcctggagcctccggcatcaccgcgatccggcgtcggatctcgggcccgttggaggcctcgaggtcgataccgagcacacgcgcgcgcccctcgctggggcgcaccagggtcgcacaggtccgtaccagcgtggtcttcccagcgccgttcggccccaagagtccgaagacctcgccgcgatcgactcgaagggtcacgctctcgaaggcgacgcgatcgccgaagcgcttcgtgagaccatcaagctcgagtgcagggtgagcgtgagagtctccagcactccagtcggcgctcgtcgccgagagagcgtggtcgggcatgacctcgaacactaccagctgtcgtgatcctcatcatgccccggacgcggtgagacgaggaacatcgcgacacgtgctgactgaacacgtccgcgaagaccgtcgtgccctactcggaaccaacaccggatgctgcgcgccagcgcgtcttcgttcacctgagtgtggggcatactgacgaggaccatgctcgaggatcgtgagcacgatgtccggctccgggtggtccgcctcgccgccgcgtcgttcgtgttcgcgggcgacatctggcaagttgtcgcgacgggacgcggctgacacctctggttgaggagcctcgtcgtcggctctctccttgtgggactgacggcaccctgcaacgatcccacccggtgtgtgacgatcccgatcagccagaccgcacgggagggagaccacctgatgggagcacgcgccacacaggcgaaggtcacgcttgtgctggcaccaaccacgccgaagccgtcgctgccgttgacaggaaggctgaggcggtagcgccgaggccagcaggttctggtggagggaggatcgtgagctcgcgatgcaaggcgcccgacggtgtgagcgcgacgatcctcgtgatcgaggggaggggcggcgaggccagggtgagagcgagcaagcagccgtcgtggttgcacgcgagggcggcgttgatcggcagtgccgaggctggtgccgcgaggcggagctggtgcaccgcgaagcctgatcccgtgacggtgccggtgtacacgagtgccgacaggcccgtgcgcggctggaggttacttgcgctgacgacgccgacgcacccggtgtcgtggcaggacagggcggtcgctgggtcatcggcgagggccctgggttcagggccgcgcacggtcatgagatgccagatgcggccgccgtcgcggctctccgcgatggcgggggcgatggaaccgtagccgagagcgaaatcgtgctcggcgatcgccacgcaggacaaccccgtcgggcatgcgatcgaaagcaccgagaggtcgttcggggcgttggtgatggtcgctcgctcgaaggtcgtcccggcgttgtcggtgacgagcaccgggaagccgtggtggtggcttatgcccgcgactgccaccacgcagtggcgtgcgcttgcgcacgcgagtccctgggccagcgtcccacgagggagggtatggtccgccacgacatggccgtgctcgagctcgacgaggaacgtcggaccattgatcgatccggtgagcaggtcgcagacggtcgtcgttgggcacgagagtgcgatgggcgagagcagtacggccgcgttggggagctgtagcacctctctcatgctcgggcgtgtcgcgagggagttgaagccgaggagctgcggaccacgtgctgcctcgagcacctcgaagcagatcgattgcacacaggaggtcaggctcgcaggtgatgggttcatcccgagctgctgaccgaggctgatcgaggaaccgacggcgagacggttgccgcgaggtgcgacgtggataatgacggccggtccggcgctgcccggggttgcggtcgcgatgcactcagtcgcaccctgcgtgcagaacaggctgagctcctcagcggccgggctcgatggcagcgtgagcgcgcgaggacgaggtccgagctggaacaccacggacgtggtcttcgtggcacccgagagctgggcgagacagaaggagctcgagcacgccagaccgcgcagcgcggaggtcgacgatggtgcggagatcgtcacggcggtcgcgtgtgctgcggtgagctcggttgcctggaccgctccgctcgaggtgaccgggttcgcgacgaaccagcagttcgctgggtcgcagctcgcttggagtccgaaggcgttcgggctcgggtgggcgagcaccgtcgcaaagcccttcgagagcgagccctcgtaggccccgctctcgaaggggccgttcgtgttggccgtgggagtcgccccttgcgggggagggagcgtcgagaccacgtcgacgcacaaggaggcgttggcgcaggcgatcgagttgcgctctgccggcgcgatgtcggggagctggagcggttcccagggtgcagcagaggtgaggcggacgtagccggcggtggtgccgtcacgcgtaccagtggtccagcagggtccggaagggatgcaacccagtgtggatggttcgtagccggctgcgaccgcgacgctctggagaccgacgctgtcggcagtatcggtctcgaagagctggcccgtgccggagttctcgagtgggggctcggcgaggacgtagcagacccggggactctggcaggcggtcgcgggaacgaaggcgtcggacgggagcgaaatgggggagaaggtgaggcttgcgttcgtgcttgcccagaggctgctcgccccctgcgcgttcgatgtggcgagaaggcaggtcgatccggcgcacgagtactgcctcgagagccctggagtactgacgctctgcccctcgccgaccgcgatcgggatggctcgcaggttcgtcggcagggaagcggcgccggccgggggagccgggcgcgacgacgtcgaggcgatgacgacagcgagcgttcctcccacgaggacgatgacgagggccgggacgacgagtgggccggtacgagcggagcgcgccatggtgggattctacatcacgttgtcgacacggaaagggctgtcgcccggcaacggtgcgagcgtgaacccgtaggaacagctggtgggcgcgatgtcgagcgacgacctcgttggggaccggtcgagtgcacggcgctcctcagggagctgtcgtgccgacactctctgaaccacccccaagtttcgtgcacacctcgtgacgtgtgaacggtctcggactcggccgccagatggccatcgtactcctgttcgacctcgacgggcggacgacgtcccagccggtgcgtgagcctgcgcgtgctggagcggtgcacccaggctgaggtcgtctcctcgaggtccgtgaggctcacgaggggcccgcgcgcgcagggtgagccaggccacacgcactcggttgtggagagaccgatcgtggtctcggcgagcgcgttgtcatagccatccccgacagagccgatcgagggcaccaggcccggcagcaggagcgatttgccaacgtgaagcgccgagtgggtttggcctgcatcttgcgtgatggatcgtgcgttcggttgcgggggtgcccctcgtgtgctcgtcggccctcggccatgcgcagggcacgctcgacgagtcgggtgtcgtggcaaagcacgagacccaccccctttgagatcgtgccggcgaaggcgtcgatcacgaaggccgtggtggcacgccacccgtgagccggacgcaggtgacgtccgccgcgcacagctcgttatggggccccctggtgggggacccggtgctcgcgacggccatcctggaccgcttgctccaccacgccacggtcctgaacatccgaggcgagagctaccgcctgaaggaccgcaccaagcaacggctccgcggtgggctgctgccccaggcagccgaggccatggcgaagggaggtgatgccgagcaccacgctctggggagctatcccctatagttgtgtcgcaggtgggtcacttctgaccggtgatctcgggtcaaaagaaggccggtgcctacaatcggcacccggcgagatcagcgagcggtagcgtgaggacgtcgggtctcacattgagggtggactcggttgtgggggccggtcacatggcatcgagctttctcgggcatctatcgaacaacgatcacctccaggtcatgcgccatcctgcgcagcagcacaacgtcaacgtcatcgagtcgctcatccgtcgtcttcgtcaatgccgcaccttcgaccagtacgacgacgttcagcgcgagctgttccagcacctacactgccgcgaacagcaccgttccgactgccgacgctgtgctgctcgacttcagcggggacgatctcttcccgcattactcccgcagctccctctcggtgtagacccactcgacccagagacctggcgcatcgaggacctcgtcttcgatcgcgtatgtcgccagctccgagcggtcggcgacgcactcgcgtggcgggcatcgggctacgaccgccggtacgtcatcgcgctgagcagcaacgcctccccgggggtcatggcgggaaagactggcctgcctgctgaacttggtgctgcgaccgagcttcgcaagagagggagcttcgctctcctccacgatctcacgaactgcctgcgcatcggggacatcacggagttcaagtcggatggttcgaagctcctctacgaaatcaagtcaagtcccacggcgaagaaaggaccacaacgcagacgcatggaggccgctgtcgaagccgttatgaccggcggcgagcttcccggacgaccgggacaacggatcgtgagcccgacccagcgctgcggaacgcacatccgtgcgttcgtaaccggcatcgacgaggccgtccgccgaggtatcgccggggccgccatttcggatgcccgtgcattgactgccttctcgtttcccacgctcgcgcagactcgatcgaacgattcggcacggcagcttctcgacgatttccatgctgagcgccagagcgcgatcgaacgtgcgggaatcgccaatgttttgcatcacgtaacggtcgcaagcgcaacgcgcaatcacgacttcgttccctctgtgatgcccttcgcgctctttcccctgccacccatccaggccgctctcctcatctgcgactacatcggcttcagcattaccgtcgcgccggagcgaatcgccgatcactttgagcgcctggggttcactgccgacattccgcttgtcacggccaacgacagccttgtcgccactgacacgatcatcaacgtgcgacggggctcccggggtatccggctgcacccaggtgccctctacgaactcctcatcgagtgcctcgacctcggatcgtgggctacggccattgctgaagttgtcgatgactcggacgctccgccccatcccgtgcttgctttcttgacgactcgtgtttggcgctgaggcccacgccagaggggtcgaccaaagcctttccccgacttgaccctcggtgactgtaagcagcgggctggccttcccccctccaggttgacacctgctataggaggaagggatgagccagacaccgaatccaccaccgggcgaggcccccgttcgtcgatgacgaggccgttacccgagccagttcctcaaaggacgccgcagcgttggtgctcgaccagtaccgcaccatcgctgacgtcgctcgcgaacttggcatcaacgagcagacccttgggaactgggtgcgtcaggaacgcatcgaccgaggtgagcgagaaggcctgacgagcgccgagcgcgaggagatgacccgcctgcgccgccaggtcaagcagctcaccatagaacgagacctggcgaaacgttgcctggcctttgcggatcctgcgagggcaaccagtgacccgctaccgctgggttgccaaccaggaggccgagggcgtcccagtagcggcggcgtgccgagtagcgatggtctcccgccaggcgtactacgcctggcgacgctggcgcgagcgcggccctgaccacgagcacctggtgctcacgagcgagcttcgcgccatctgggaggcgagcgacggcacctacggcagcccccgcatcacccacgagctgcgacgacgtggttactgcgtcaaccacaagcgggtggaacgcctgatgcgcgagctcgagatagccgcctgcccacgccggcgcttcgtagccacgacgaggcggggagaggacgcagcgctcctggacctcgtccgtcaggacttcgctcttggtgagccgaagcgcaggtatgtgagcgacatcaccgacgtccgaagcgacgaggggttctgctacctcgccacggtggcagatcttggctcgaggcgcatcgtgggctggtcgctccagcgtcacatgcccgatgacctggtggtcgaggcgatctgcggagctcttcggacccggggcagcctggcaggggcgctcttccacagcgatcgcggtagccagtacctctcccggaaggttcgccagctctgcgcaatgctcgggcttcgccagtcggtgggcagggtcgcgacctgctacgacaacgccgtggccgaggccttcttcgggagcctgaagcgcgagctggtggctcgctaccgcttcgcgaacctcgccccgaggctcgctctgccatcgctacctggatccaccgctacaacacggtccgcctgcactcgagcctcgggtacgtgccgcccgtcgagtacgagctctcctgggcctgccgggaggtggccgtggcctacattcagactgtcaagcaaatggggggaagcccatgacctctcctggctgacggctggagggaaatcgcggacgccgaattcgtggctgcgttcacgaacccttccgtccccatgaagctttgcacccagaccattgtcgaagagcgcaacctctgggtcgagaccagcgacatgctcgctctgggccggctgctcgcagagagcggccaggttgccatctcattgtcggggcatgctcgacgggcgcctcctgggcggatctccacggtggcaagcgctccgtcccacacgatggcaagctggccttggtgagcgtcggcatctcgggacagctcagtcagcctgagcacctcgccagcttgcgcttactcctggccgggtcgaggtcccacggttcgcagacacctcggtggtgccgacgatctcttacgatcccaccagcgcggcgtcgccagcgatcggggaggtgccggccagctccacgaacagacgctcggatcggcggccaatggtcgggaaggggcgcggccacgacaagcaccctcgttgggtggggctggccacgtcctcggtccacctcactccacgaagagtgcctcggcgttgagctcgcggaggatgccttcgaggtcgtcggcagtgggacggaaagggaagtcgcggaacggctcgctggctcggtaggacccgtagggccgggtgcacccaggggagccgtcctcgcctgggcagccgttggtcatgaaagccagcccctcgttggcgacgcgcaagagggtgtcgcgctgaaccgctcgcaccgcgacgaggctccctgcgtcgtcgaacgagaagtcctcgaccccgaaaccgtcgtgctcgatgaggtgtttggcgagctggatccgacgccaacgggtaatcgaggtcttcggcacggcccccatccgggagtcgggctcgggattgaagcagaagagatacggaaggatctgtcggtcgaggagccggacgaagagctcgatcagatcacggtctcgttccccgaggcctaccaccgtgtgacagttcactttccatggaccgaagagctctcgggcatcgtcgacgacctgccaatacttggcccaggacagtccagcgcctccagcggggacatcggttcgcagcgagcggaagagttgttcggtcacggcgtcgaggccgatgccgatcatgtccacccccagcctgcgaaagcgctcgagcttgcgacggttcagtgtcggtggggcaacgaggatggagaggggggtgcggacgcgcgctcggatgcgctcggtgatctcgcacgtgtcctcgaaggcgtagggagaggtcaccatggagatgcacagacgggtcaggcgtcgctcgagcatcgccatgcgctccacaaggtcgtctgtgcgcacgaggggccactccactctgatgaacgacttgtcctcgtagtcgccggggcgggtccgcgcgaggccgcagtagccgcagtcgctccggcagccgtccccgtaattgagcaagaggttgatcccgccgaaggcgaagtctctgctgaagcgaccggagcggaacccgagtgcgatcgccgaggcggccgagatccgcacccactccgggctctcgtgctcacccagcgtccgtcgtcggcgcagggcgaggggcgtcgaggtggtcatgaatgtctcctttctgggagtaggcaggatccgagtcggtggggggcggcgagcgggctgaggctcgcgtggaaggcttccgtgatgcgtcgaggcggagcgaggtggccaagcacgtcgcacgctcgatccgcgaggtagctcgggtcggcgggctcgaaacgcagcgcccgggtgagcgtgatcagccgggcatcaacttcgagaaagtccccggagacctgcacggagctcaccactccaccccgaacgtcgaggtgcagttcgacggtcccgatggccgttcgcagggtcacccgagtcgcgctcggctcgtgagccgagctaccgtggatccagtcccgatcggcgtaggtcgagatctcgaggtcacgtgccagcatgagctcctcggcgcgcggcgcgctctggacccatcgtgaccgaccaaggcccatcgcgaccgcgtcggccaccacggtgacgaggtccgcgccgcaccaggcctccccacggagctcgctgacggtgacgacggagcgtgcgagtagcttggcgcgcttgtcggcaagcttggcggcgggtgggcgtaggacctcgaggaggaggcgatggtcgaggtcggcgaggatcgaagcgtggcagagggtgcccccacgcgcaggtcgatacatccccagaccggcgatcttgcgcccatccacgagcaggtcgttcttgccctcgagggtcgcccgcaggccgatggtttcgagtgcgccgatgaggagccgggcgaacgccgtcagaacttcccgaggggtcgcacgccgctcgggcagggccaatgccacgccaagctgggcatctcccatgaggatggtgccaccgccagtaggtctgcgcccaaggtcgagccccaggcgctcgacggtgacgaggtcgacctcggccgcagcgcgctggtggcgaccgacgaggaccgtatggttacggtacgtgtagcagcgcaggaccggctcgtcgacggcgcactggacgagcgcatcgtcgagggcgagaccctcggcggcaccgacgccgtggtcgaggatgacgcgaagcgagctcacgacacgcgcaccgtggtgaggtcgtcgtcgacgcctgcccagctcatcgagcaacaccactcgtggagcaccggggtgagcccctgctcgcgggcgtaggcgatggtgccctcggcagggtacgcgatgcctgcgaagccgaggtcgacggccgctcggtcgagggcgaccttcgtggtgcccatgggtcgggcgcaccccaggttcgtgcgcagcgagggcaccagcgttcgtgcagcccggaagacctcgaccgtcgcctcgagggatggcggcgggaggtgtcccatcggcgttcccacgagcggtgtgagcaccacaaggatgagggtgtctacccggtgcctcgcgatgagctcaagggcgcgatactccccgaggatgcgaccgtagtgcaggccgatgaccacatgcgggatcactcggaggccggtgtcgtccaagagaccgagggctcgatcgaagtcgtcgacgctcagatcgaggtgatagacctcacgtatggtggcgtcggcgccgatgatgtcgagcatgacggcatccacccccgcgtcggcgagttgggcagcgaggggaggcgtgacgactccggtgtgcaccacgacccgcatgtcgagctcgtctcggatgcgtggcacccaggggaggtgacgcgcgagcggcacgaagccccgcttggtggagccacccgatacgaggatgccctgagatcccgcggccttgagcctacgtgccacatcgaagaggttcgagcccagaccgaccgacaccatcccgtcgaggaccttggacccgcagtgatcacaattgagcgcgcacgccgagccggtcacggacaccggcaggaaccgtctcgggttcgtcgggcgccactccttcgtgctccaatgcttgaggccaggagcgtagaactcgatggtgcgcggttccgacgctgcgtcgtctactgtgcccacggcaggatccactaccacgccagcaccccggccgcacgaaacgcctcgacgcgcttggtgaagtcctcaagcgcctcgtcgggggtgacgaggtgatcgagcgcgcccggctcggttgccatctcgacgagccacgcctcgtagcatcccgcgtagagctgcgtgacgtcgcgaacgaggtggtcattcgtcctcaagatcgttccggcgagaggtgccgcgagtgccccgacgtacttctcggcctcgagtgagccgatggggtcaccctccaccacccggcacgggggctcgaccagtgtcagctgcgccagggtgccgttcacctcgagtcccagcgcgtcgagaccgacgcgcacgatatcgtcgccgaccggcaacgcccagaggttcgtatcgtggtggtagaagcggtcgctacgaacctcaaagccgcggtaaacgtgtgacgtcatcaactcctcctcttcggtatgtccgatcgtcctcgtctccgaggctggcgccgacggaggcgaggagcatggcgagagaacggtcgcgctcgatccttcgccgcaggagcgctggatcggtcacggccgagccctcctcgtggcgcaggcgcgtgaggcgtccttcctccaccaggagcacgcaacgccgaccctcgtgttccaggtcgtggagccacacccccgctcgaatcttgacgctacgtcgtgccgagttgggggctccacggacccagccatcattgtcctcgtcgacgagcgatcgatagcgagcgatgaggtcttggtcgagttcgaggatcccgggccgggggtcaccgaggatctcggccagttcttgcaccagactggcaacgaaatcttcggggtcgaccacgagcgcccgagatggaccgacgtgacggcgcatcgccgcgacggcctcctcacgtgcaatcctcgacagggagaggatgccggcggctgcctctggatcgaaggcttcgagcaggtttccgacgacgaccagactcgcggcgatctcaccggacccatgaccacagaccttgcgaccctgacagctgatctctccgtggccatcgagcacggtctccagcccgagacgcctccaacttcgggcgactcgctcgaggatccacgcagcgaacttcgggcctcgaacggccgctacgacgtggtctcggggcaggatgacctggaaaaagcgttggcgctggtcgagccagaccgggcccccaccaacccggcggcgtacgacggggaccctgcgcgcctggatctcgccccagtcgagctcctctctatgccggtggtagccgagggagacgtacgcggagcgcggtcgtgcgacgagcagcgtcggccgttcacagcgatgggcgaaggcgtgccagatggcatgggagtccactggttcgaggtcgccgagatcgaggacgtcgaggcagcttcgacgcacgaacgctcgggtccgactcccgtcagcgacgggtctacgaaccccgtccgacacgttccccccttcggacgcgacgtcaccacccctcggtgacgaccatgtgagtcatcaagtgcgcatatgcgcatgcgactcccgtagcgtacttgaggcgccacagcgggtgcaaggattttcacgaatcaaggggggtgtaccggtgccaaatcgagccgttgaggatcgttgggcggtcgtgacgggtgcctcgtccgtcatcggattagaggtcgcacggtcattgagcgagatcgggtactcgctcatcctccagggtgcgcgccacgccaacgcgctcgagctccttgcagacgagctggggtcgcgcgggcgtaggcccgtcgtggtacgcgcgaacctcgccagcgagcggggcgtcgaccacctcatggccaccatccgagagcgcacctcgcacctcgacgcgctgtgctggctcgctgcggctggggtcatgcgaccggtgagcgcactcagtctgcaccacctggagtggacgttccgcgtgacggcggggtcgttcgcggtcgtaactgcgggcttgcggccgcgagtgagcatcgccgtctcgtcgctcggctcccagcgcatcgcccccgagtacgccgccatcggcgccgcgaagtcggccctggaaacgctagtcaggtatctcgccgtagaactcgcgccagcctccagtgtcttcgggctgagggttggcctcatcgacacgccggccgcacgacgtctcagccgctacgaggagctcgaggcgctcctgcgaaggcgcgcgcccatggggaggctcgtgacaccagaggacgttgcggctgcggtcgtgaccatggtcacggagatgtcgagcatggcaagcgggtcgttcctcaccgttgacggcggagtcgggcttgtgctgtaagctcgtccgcgtcgtggcctgacgaccacccggatatgactgcgccctgccactgagagtgctccgagcgacaggcccgcgacctaggtcgagaacgccgaaccgatggggttcggatgcgccggggcggtatcgcgctggcgtcagctcgttcattggtgaaccgcgctctgcgtcccggcgcgagccaacggagcccgcttgactcgtgtgtcggatccacccaccgtgaccgcgcgtaggggcgaacacaaagtcatcctgttcgcggcgacggcgcccggccaaccagtgggggccacgctgtggcccatggcagtccgcccaggcgtcgccacgctcggtcgccgtcgcgcactgttatagtccgaacctcgcgggcagccacgatgaaggtgcacactcgagcgctggcgccgagaagcggtattctgtcaagttctggcgaggactgagatgcccgacactccgtcgagggtactgctacgattccccgcgtgcggaggctgcgaacgtcggttgggatcgtgcttcgagggttgcgatggcgcctcgcaacgaccgtgatgctggtggtcacgggaaccttggcggtcgcgacggtgatactcgcaccgctctacataccttcggccaaggatgcgctcgtcgtcagcgtcgtgcgtgcgacctcgctccagcaagatggtctgcagctcaatggcttcggcctcagcgacgattcgcgggctgcgctcgaacgcctgttcgcccgggccccacggctcgaccatcgaccgctgttcggttcgccgcttgcgacggcgttcatgaccgtatcgctgccctcactcaagatcccgtcacgaacgccagggggtgtggcgcagtccgtggtgcagaccacggcgctactcgagaggaccgcaatctgctcgcacctgaggttcgtcgcgggtacctgtccgcgacgcggatctcagggcgtcgcggtctcgacgagggacgcggctgcactgcatctgcacgtcggatccaacgtcaccttcgctgctggtgccatcgcgcccggaacccccggagccctgccatcggtgaaggctccggtcgtgggcatctatgacccgccgaccaccctcagcgcctactggtggggcacgcagtatttcgatttcagctccacgccgaccggcaacgtctatgacccctttgtcgtcgcccctggttacttcgacgggattgcgattcccggtccaccggtcgtcctccgcggtcacggcacggcaacgagtccggcattcgtcgtcggctcgcagtatcgctacctggtcgcactctcgtcgagcgggtcgcccggaggggtcttcttcgcagcgaactcgttgctgggccgcaccttgcaggccccgctcgcagcaccgcagcgcatcacgaacacgaccgctccgggtctcttgcggtcgatatcgggctacctcgactcggtgaacaagcatgcagcgctgaacgtcgtgggttcccaaggcttcgggccattgcccgtcgccgcgtcgtcgctgccgggaaccctcaccaaggcgctcgctcaccagcacagcttctcgacgatctccatcgtcgtcgtggtcgagatgctggcgatcggcgaactggtgctcagcgctgtgatcgcacggtcgatcttggcgcgcgatcccgagctgcgtctcgcacagttgcggggcctcggaacgaggcgtatcgttcagagggcgatcgcagagccactcgtcgccatcgtcctcacgattccgctcggcacggcggttggggtcggcgtcatgcatctcgtcgcgagtcgcgtcttgcccagcggcgtcaccgtcactcttacgacgacagccgtgttgacggcggtcggcacggccgtcgtcggcctgctcaccacggcggtcatcatcatgattgcggttcgacgcggcgtcgtcgaggctccgcgtgccacacagcggcgccgcgtcgtgttccgagtggcgctcgacgtggcactgctcgcgatcgccgcgacgggaaccttcgaactcgtcacggcgatctccgcctccagcggcattgcacctctcgcggccggcgcccccgcgctcttggcgctcggactctctgtcatcgctgcatggctcctcaccatcacagctcggctggtcgctcgtctcacgcgctccctgaaacgcccctcggtctacgtcgccacgcgtcagttacgccagcgcgccagtgcgctgcaccgtgccctggtcgttgggcttgccatcggactcgtcacgttcggcatcggcctcgacgacgtgggaaactcgctggcgcgaaccggtgctgcggtcacgaacggcgctaccgaggtggccgaggtgaccctgccaccatccttgacgatcgccgaagccgtcgatcgcgccgatccttcgggccacgaggcgatggcggcgcagcgagtgtcaactcctgccggtacgacactggcgatccaagcgcggcgtgcgccggggatcttgacgtggtccccgacgctgggcctgcacccggcgctcgcgcaggtggtccagggacttgacccacggtccgctggcggctttcctgtccgcggtcgtcgcgtcgctgtgacggtggagatctccctcacgaaggcccaggcagcacagctggagcgatcctcagcaggcaccgtcacgcccgcaacgctcggcgtatccactgtcaccatggagatcaccacaccgacccccgcgggtctcatcgagtccgtcggtgtgctgtcgggggccgggaaggcggtgacggtgagcgcgaatgtcccgaccgcgtgccgcagcggaggttgtgacctcgtgggtatcagcttctccttggcccagacgttcaccaacttcgagatctccatccttggagtgagcgggattgcgccgtcgcctggcggtccggtactcgcagcgagttcctggcgcgcgagtggggcactccatcgcgcatcacgacctgcgagctggaccgttgccccgtcccaaggtgccctcgacctggtaccacgctcgctaccgccgaccatcccggccatcacgaccgacctaccaccgggacaagccacggctcagatcgtgggcctcgacagctcgaccatcaccgcgacgcccatcgcccaggagcatgccctgccggtcctcggcgcgagcggcgccatcgtcgacctgcggctcgccgagcagtacctccaggcaaccgaccatgcgcaatcgctcgtcttcctcggcccgcgggacccatccgcggtcctccgctcactcgcggccgaaggggcccacgtcgggccaatcacgacggtcgcccagatcgtcaccgccgcacgcaccagtccgacggcgctcgcccaagacctcgtcctcccggcgggcatcgcggcggcggtcctggtcgcagccggcctgctcttcgagaccgtgaccgacgggcgcgcccgaatcgccgagctcgcggcgcttcgggtactcggcatgcgccggagccagctcgtcaccgcgctcgtgctcgagggcatcgctgtcgttgtgctcggtgccgtggtcggcgtcgtcgcaggtgtcgtcggcgcgcacttcgtcttgccacatgtgctaccgccgccaaccacgctcgccgcatccttcgtcattccctactctcttccaacggccccccttgcacgagctgcgctgctcgtcgtgatcctggggggagcagccgtgctcgcaagcgccgtgcgcgtggtcgcccgggcctcgttcgaacagctgcgagctggtgagcgatgactgatcagcttggcggactccccctccggctcgagggcgtggtgcacctctaccccatccccggaggagacgtcgttgcactgcgcggcgtcgacctacgcatccaagcgggcgagatcgtcggactgctcggaccatctggcatgggcaagtcgacgctgcttcgcctccttgcggccctctaccctccttctgccggtcgcatctggattggtgataccgacatcgcccaactcggaccccgagggcgtcgcaagctgcgcggccggaccgtgtccctcgtcctgcagggtccggcggtcaacctcttgccctatgcgaccgttgagcagaacctcgctttcgcggcacgcgatcgcgcctctcgacaccgcgtcggtggcctgttggaactcttcgggcttggacccctccgtcatcgcgtcgtggccacgctctcaggaggccagcagcaacgtgccgccatcgcgacggcgctcgtgcccgggccgcgtgtgctgcttgccgacgagccaaccagccagctcgatcacgaggcgcgcgacgacgtcgtgcgagccctgttcgatgtgcaacgcaacctcggggcgacggtggtgatggtgacgcacgacccggtcgtcgcgagagagctgccgaggctgctcacgatacgcgatggccgtgtcggcgcagagggtcgctcaggcgaggagttcgctgtcctcggcgaggacggtacgatccagcttccccctcacgttcgcgcgatgattccgcctcactcgctcctgcgcgtccgcgtgatcgacgagggattcttgctcgagccggctgaccatgtgtccgaccaaggagatggcctgtgagcgagcccttcgagctcgtcctcgagccgatcgtggtgcgacgggggcgaggatccatcctcgagcttcccgaacttgcgctcgcatccggtgagctcacggcgatcatcggaccgtcggggtctgggaagaccacgctcctccacgtcctcgcacgcattctcgaacccgacgaggggcgcgtcctctggcgcgatgcacacggcgatcaccgactgcgccgccgccagagcgtcctcgtaccgcaagcattcggactggttgctgcgctcaccgtcgcagagaacatcgcgctggcgctcaagctccgcggtgaacgcgcctcggatcgttccccgctggtacgagacgcgctcgcctcggtcgggctcgacgggctggcgaaccgactggtcggtgagttgtcgggcggccagcagcagcgtgttgcggtcgcccgagcattggccgtcgacagccctatcctgatcgccgacgagccgaccagcgagctcgaccccgacaaccgtgcgctcgtgctcgatctccttctcgagcgagcgcgcagcggtccactcgtcgtcctggcttcccatgatccgctcgtcgccgagcgtgcccaccgaacactggaactcgccgagggtcgactcgtcgacgatcgctggacccccgagagccaacgcaacggaagccctgagcagccgtgatgtgtcaggccgctggcgtcgccggctcgacttcgggatcggctgctcggcggccccgcccacgcgacagtgacaacaacgcggcaatggcgatgaacaccatcgaggtgtagaaggcggcgtgcagaccgtgcgtgaagacgtctgccaagtgtccgctgagcttggtggtgccgacgaagatcgcgaatgcgagccctcgcgggatggaacgtgccgcagaaaggatggcgacggagaaggagaagaccatcccgatgttcgagaacgtccggagcatgcccgaggcgatgccgaacacttcggggggagcagctttcatgacggccgagttgttcgcggggaagaagctcgagccgccgatgccgttgatgatgctcgcgacgacgacgagcgccagcgtgacatcgttgctgagctgtgcgtagacgaacagcgcgatcacctgcacggcgaggccgacggtcgcagggatgactgggccgacacggtccgcgagtcgccccgcaaacggaccgacgacaccgcccaggagatagcccggtacgagcagcaaggaagcgtcgagagcgctcaggccccgcggtccttgcaggtacatgatcacgaggaagagaactgcgtagttcccgagggcctgaaacgtcgctgccaggagcgacggtgtcatcgtcgggatgcgaaagatgcgcaggttcaccatcggctcgggatggcgtagctcgatcaggacgaagacgccgaggatgacgagtccgccgacgaagaacgcgacgatgtgggagtcgagcggccgcgtcgcgagttgcgtcactgcccagagcagcccgaagatcccggcgccgagcgtgagcatgcccccgatgtcgaaacggtggtgccgtgaggtcgcttcgttgtggagcacacgcgtcgcgagggccacggcgacgatgccgatcgggacgttgatccagaagatccaccgccacgagacataggtgacgatgaccccgcccaacacgatcccgaggaccgcacccaggctccaccccactgcgttgaagccataggcccgaccccggcgatgaggcgggaagatgtcagcgatgacggcaccggagttggccgacacgagtgcgcccccgacaccctggagcactcggaatccgatgatcgctgcttcgttccaagacagcgcgcacaaggcggaaccgacgacgaagaccacgaaccctgcttcgtacatgcgcacacgtccgaagaggtcgccgagcttaccgacctgggtggcgagcagcgtgatcgtcaagaggtacccgatcacgacccaaatcaccgaactcagggccacgtgcagcgcacgctggatctccggcaaggcgagcaccacgatggtggtgtccaccgcagcgatgagcacgccggccatgatgaccgccaaggcgagctgcgggtgatcggtcacggacgagtggtaggacgcatcatcagtgcgagtagccatggctctccccggtcgaaggctcgtcgaagcttgctagttccaaccttatcgacgagtcgggtgttcccgtctcagaatctgcgatgcgtcgaggacgggggcgagcggtaggcttcgtagctgctgtggcgggtagttcaattggcagaacgcctgactttggatcaggaggctccaggttcgagccctggcccgccagccatcgccgttcctctcgacgcgctctgcgtggagctgtccggccttcgaacggcctttgggtcgccgacgttccccacgtgagactgagcgcctcgggccgaccgctgtggtagcaaggcgcacccgacgaatcatgagcatggctcgatcacccgctgccgcgacggcgaccgaacccgactccgccggcacgaacgcatcgggaacgtgagcagccgaatccatgtgaccacgcgccgccagaaccccgacgttgccatcgttgccgcttgacccagcgcttgcaggagtcgaccgttcttcctcgcattcgccaggtcgtgcagagcgtcccttcggctggaagatcatcgggaatcgccaacggcctgcgcaccgctgatcccgccacgaacacccgagccgtgcgtcaaccgagccgaggggccacggcatggtccatgtgtgaagccggggcgctccgtgtcgccagtcgtgacgaacgtgtgccgatcgctgctctcggccactcgcgagccgcggaacgcgacgcggcgaagcgcacgcgctgggttggagcaacgtcgaccgcaacgctcgcacagtggccgtcacaagggccgcctcacgaagatgcgcgtcgagcctcgcgacgccgtcaccgaggtccaagcgaggacagctcgcagcatgcctcgcgtgctcgcatccaaaccgctcgtctggttcctcgaggagcaccgggcacaccagcgccgggagatcgaacgccctcgccccctcagcggtcgagctggggcctgctcccggttcccctctgccttcggtcggccccttgcgcttggtgcgccgaaccagcacttcggatgcctgtctgtgacttctctggccatcatctcctcgagccaaggagccttacggcctcgcctcctcgtctcgcgcgtgtcgttcgcgcctctctgcggccgtcctccgctcgaaggcatcggcctcgggcagggcaagagcagttcgggtgatcaccgacactgcgtccgcagccccgaccacccagcgggacctaggctcgaccatcgtggtcgctggcgcacgtcatccggttcgttggttcctcgccgaacgcggcttgctggcggctgcggtgggcatgcttccggtcggcctgtccttctcgctcctcgacatctacgctcgcgcgagcgcgctcgggatcgtgctcgcactacagggcgtcggcctcgtcgtcagcttgatcgtcctcggtggcgtcggcgacctcatcgcacctcgtcgcctcctcgtcctcgccgatgcgctctacgcagcctcggctgcggcgttggccctgctcgcgcagacccacagccacgcactcgtcgcctatggggccgcctccatcgtcaccggtgcctccgcgggtctcgtcaactcggctctgcaggctctcctggctgcggtggtgtcgccacaggatcgacagcgcgtgaacggtctacggagtctgttgcgcaatctcgtccaggtcgcagctcctgcgttcgcaggactcgtgagcgcgatcgcatccccaaccgtcgtgctctggctcgccgcgatcgtcgccgccctcggcacgctcgctgctcgcgcgctccccgatacaggcgcgggagcacaccacgacgctggcctgctcgccgaactgcgcagcggttggcgagcgtactgggcctacgggtggctcgtcgctgtcgacggcgccttcgcactgtggcacctcgtcgtctacggaccgctcttcgtgctcggccctgtcgtcgcgcgtgcccatgatcacggtgcgctgggctggggcctcatgctggccggcgtcagcgttggtggcgtcctggggggcgcgctcgtcgtgcgcctgaggcctcgtcgcccactctccttcgccctcatcgcattctcggttacgtcggtgtggctcggtgcgctctggttcgaggcgcccctacccgtcctcgtcgtcgccgccgcgatcgccggggtcggcttcgagcttctcatggggctgtgggacaccgtcttccagggcacgatcccccggagtgtgctcggcaagctcgcagcctacgactacctcgcctccgtcggaaccctgccgctcggctacgccttggcagcgccgctggccgcgatcgtgggcgcacgcggtgtcttcggacttggtgtcgtgatcacggtcgcgatcacgctgggcaccctcgctgtgccgagcgttcgtcatctcccctcgccggcacttcccatcgacgagtgagcgccgacgactcctcggccgcgggttgagtccccgcgccgcatcgtcgcgggctccgctggcagctaccgtacaacgcacctgatccaaggagtgtcccatgaccgatagcgtcagccaactcgccgatgaccagcccacgacacgcctccagcgtgtgctgaatctcgtcccgcgagcgctgtcatcgagaccccacatcatcttcctcgcggtgctcggtgtctacctcgtgctcctccccctcgcccacgtgcacgtgtcggcgttcgcggaactcgtcggcgggaactacacgaacgttacgagcgatctcggggcctgcatcgccgccggcggtacgatccacatcatgcgctcgcaccggcagcaccgcagcgagctcgccgagctacgccgactggtcgaggacctgtcgcgcacgctcgggtcggggtccgagtaaatccgtcgccgctcgcaccacgatccgtcgacgctcgcggccggctgcgcggtgcctcgagacggcacgtcacaccagctcggacggccatccgtcctatcctggaggcgtggcacgcgcacagcccccgggcgcagctgagccacgtcgaccccgccgacgtggttggcaccgtcgcacctttgaaccggagcgcggatggggatcgctgggcgacgagggacgcgccgtcctgcgtgcggcgcagcggcgcatcgcacgcctcgtgtcctcggactcgctggccgagctgccaccagagcccgaggaggaggtggcctatcgcctcctcaccgccgcccttcgggcaggcgccgtcctcctcgcggctggggccgccacgctcgatgtcgagcagaccgtcctcacctttgccaacgccctcggcctcgcagggtgcgaggtcgacgtcacgttcacgtcactcaccggctcgtaccgtcgtggtgcaaccttgaagcccatcaccacgctcgtcgtggtgcgcgatcggacgctcaacttcgccaagttggccgcgatgacccagctgcgtgcggccgtcctcgcgggcgaggttcccccggtcgatgtcgagcagcgactcgaggcgatcgagcggctcaccgtgcgccgcggtcgcttcgtcgtggccggctgggcgggcatggcggctgcgttcacgatcctgctcggcggacagctcctcgccggtgcgcttggcttcgtggcgaccgccttgatctacgtcctcaaccgcggtctcgcccggcgcggcgtcccagacttcttcttgagcgccatcggggcgacgctcgcgaccaccacggctctgctcgcgatcgtggcgcacgcgccgaccgtgcctgccctcgtcgtcgctggcggcatcatggccctcgtgcccggcgtgaagctcgtctcgagcgtccaggacgccctaagcggtttcccgttgtcagggaccgcccgtggcgtcgaggtcctcgtcatcgccaccggcatcgtgaccggcgtcagcctcgtgatctacgtggcacgactcgcgggtctgcacctcgccatcggccccatcccgctcgcctccttgctctatgtgccggtccagatcgcggccgcggcggtcgcggcagccctctatggcatcgcgacatcggtgccgcgttcgttcctcccttgggcggcagtcaccggagcgctcggatgggggattgtcctcgtgctcgaacacaacggcgtctcgctcgtcgtgtcgacggcgctggccgcggtctgtgtcggcctcctcggccaggcgctcgcctccatccacaccacccatccctacctcttcgtcgtccccggcatcatgccgctcgtgcccgggctcaccgtcttcgagggcatgctcgcactcgtcgaggggcacggcggtgccgcgggtctgctcctgcagggcctcgccatcggcctcgcgatcgcggcgggggtcagtctcggttacctcatcttgcgctcgcctgtgagccgaccgactcggcttcgctaggcggtcgcgacctgtcggccgccgcggtgcacctccccggtgcggcctcgcgaacgtgggcggtctcgtgtcgtggtgccacgcccgccgtcatcatgcaggcgctgcatgacgagcccagcagaccggctagggttgaccggctcagctaccttgcgtcgttcctttggagctccgatgtctccgcgtcccgtccgtcgtcgtcacctcgctggggtcgtcctcgcaggcattcccttcaacgtggctcagggggccgcgttcccctactgggtgctgtatctccacagcgacctgcacttccccaccgccttggcgggtctcgtgatcggcaccgagggtctcgcctcgctcggaggcgcgctggtcggcggggccttccaggatcacttcgggcctcgacgaacggcgcaactgggcgcagtgatcgaagccgtggccgcagcgtcgcttgtcgttgctcgtagcccgcttgcggtcgcgggctgcttcgtcctcttcggtatgtcgaccttgcgctatccggcccgatcgagcgcgctcctcgccgcactgccggacgatctctcggcgaccaccttctttagctgggacttcatgggcgcgaacaccggcttcgggctcgggatcgtggtcggggcgctgctcatcggtgccggtgacgcgacggtgatgcggggcttgttcgccgccctcgcggtgacgagtgccctcctcgccgtgacctacgagctcatcccgaaccagagaatggctcgcgaacacctcgagcacgcgtcgtatcgcgcagccatgcgttcgtcgctgttctggtacgtcggcgcgtggggcctgctgctctcgctcgcgagctactcgtcgttcgacgctggcgtgccggccctgatcggcatcgagctccacgcgtcgccgcacctgatcgcgctcggctttctcacgaatcccgtgctcatcgtcgcgttccagcaacccgtgagacgcctggtccaccgactccggtggcgccgcgcaaccatggcgaccgcagcgatcttcggcgcgtcgtggttcatcttgttcggggccctgtggctgcggaccgagttcgagctcgccgtcctcgtcgtcagcttcgccgcgaccttctcgctcgccgagatgctgatggctccccttcgaacccagctcatcgccgcgctcgcacctgagcatctccgcggtcgcttctacgggatgagccacttcgcccgcggtgtcgccggtctcgtcgggccgagcgtcgcaggggccatgatcggtgcaggcctcggcttctggtggctgccgctcgtcgcgagctcgggtgccggtgccgcctgggtcagccgaaagatctttcggacagctcccgccgagctgtccgagcgcacctgacgcaaccggttcgacggctcagacggcgctcgcgtcgactcctgccccaaaggccggacagtgcggcgccagcggacaggagcgacactggtagccgggtacggcatcggcccagagaccgtcggggacggaatcacgacgcagtgtctcgcgaagctcgcggagacggcgagcccgtcggacgacggtcccgatcgcgcccacgccctcgtcgagcagcgcctcatcgacgaggcgacgccgagagcgaccggcttcgatgtcgacgaggcccacccagtcgagatcgacaccaccgatcgtcgcgaccaccgcctcgaacgcgagcgcggtgtcttcgtagccgtagggtcgatgatcgaggacgaagacgcccgcccgctcgcccttcgcatcgaggagctggaggtcgatgaggctccgcagctggacggcgccgaagcgcacggtgcgccgacgcggctcgagcgcaccggcgtgctcggcctcgagcacgccgatcgtctccgctgcgaaggtgatcacttcctgctgaacgaggagtcgctccccgcgtgtgatcgccttcgtcgcatggccgctcacccagtcccaggcccagtggtcgcggatcgaggagcggagcgcgcgatagagcgcgtgcggggtcggtgcctgctcacgctcgtcgtaccagcgcacgacgagctccatcgcgagggtacggcgcacgaccgcgacggacggctcgaacggggcatcgatcaccgaggagccgaggtcgcacgcttcgcggaggtctcggctcgtgaggcggaccggcgcgccgccgccacgcagctcacggacgatcgcctcgacacgtcgcccgaggtctgctcgctcccctcgtgtgcggctcacggcgccgccgcctctgcgtaggtggcacagtcctcgcggaacggacactgggtacagcgcggacctgcgcgctcgatcggcgcaccagcgaggccacgcgcggcggcccgaagcgcatcggcgaccaggcgtgcgccatcgcgcacgacgcgctcgctcatcacgagctgtcgcgcatcggcgaccgcttcgccagggccgaggaggatgatgctcgctggaggtggcccgtagcgcaggccagccagcagcgcgtagaagcggagctcgctctcgtgctcctcgctgagggcgagcgacgacttgatctcgacgaggtggtggggtctcccgctcgcggccccacccaccacgagatcgaagcgcccggtgagcagcacgtggtcggtgaggtccgcccgtgcgcgcacctcggttcgtggccaccacgcctcctcgatgccaagacgctcgacgagtcgcgcgcgccgggtgacgacgtctgccatctgctccgcatcgagctcgaccgtcccaccgtcggcagtgacggcttcgagccacagcgcgacgtcgtcgccggcatggtactcggcgccgtaggcgaaccacgagcgcaccccggcctcgaagaccgtgccgaggtccatggcgcggttgcgcggcgtggcgatctcacggcgcagctcggccgtcccgtagcgctcacaggccacgagtgaggccacgatgcgcttggtcaagcgccaggtctgctcggtggggagttggctggccagctcggcgagctcgtgacggacctcggcgatgacgtcacccgcgaccgggtcgcctgggcgccagagcgcctcgacgagcgctgcctcgctctcgagccagacgatgtccgtggcgctcacgaggccgactccgaactctccagcgaagccggcacgtcgaggggtttgagacgacccgcaagcaacgcgtcgcagaccgcgagcgtgccctcgacgaacgagcgaccgagcgctccggcgacctccgagtcgacacgcgaggcactccagccggtgagcgccagccgacgggcgaccacgagcggccacacacgtgccaaccaccgctcctcgatcctcgcccgacgaccgtagcccctgatccacgccgcagcacgctcctcgcagtgcggggcgtcctcgaggaagctcagcgctccggccagatctgccatcgggtgtgcgaagccagcgtcgtcgaagtcgatcggcaccaacgccgagctctgggtgcgcacgacgttggcggcgcgcagatccgagtggatgaggagcatctcgtccaccgcatcgagcatgctggcgacacgttcggcggctcggtccatgagacgccgctcggacgagctcgcgcaggcaagctggtagctcccccagtgggcatgcggccccaccagcgcgccagcatcccagcgccaccgacgaaaccacggtggcgggcgccaccgacgcgcgtggttctggagttgggcagcaacctcaccaaggcgctcgaaacttgccggatcgtcgctgtcgcctgctcccacttcgcccgccgtccagctcaccacgaccaccggtccgtctctggtgtcgacgagacccggggggccatggagctgggcgatgggccgcggggcggcgacacctgccgcatccagcgctgcgagccaggcgagttcgctcgccagttcggtgaccgtgcgatagccaggacgcgggacccggagcgcggccaccggaacaccgtcgcaagaggcctggaacaccacgttctcggagacggcgacgggcgtcaccgtcgccccgtcgagcagcggcaccacgcggcacgcggcttcggcagcctgaacggcccgctccaggagatcggccatgaccgaacgctacccgctcgctgagcgccctacactgcatcgtgccgatgcaggtcctccgtccgcagctcgccgtgctcgtggccgccgtcgccagcctcgctgcctgcggtagcgccgtcccctcgccgaaggctcaccgcctcctcccggcgacccatccgctcgcacctcggccggtcctcgtcgctccctctgccgtctcgaccgaccccggaccaggtgccctcccacagacacccgcgcttccgtctgcgacgacccagagcttcaagaccagtgtcgctgacctgtgggctgcgatcgtcaccgataatccggccctcgccatgcccgccttctttccgctcccggcctacctgcaggtcaagtcgctcaccgacgacgcgcacgactgggcggttcgcctcgtcgcgcacttcgtgctcgacatcgaggcagcgcacgcggtcgtgacgtctcatggcggcaccccgacgctggtgggcctcgaggtgcccacgacgaacgcgaactgggtgccgccgggcacctgctacaaccgactcggctactggcacgtacccggctcccgcctcgtctaccaggtcggcacgacgacctactcgatcggtgtgctctcgctgatctcctggcgcggcacgtggtacgtggtgcacctcggcgcgatcaaccgcccgagcgacgaaggtgccgtcgacgcgcccgccgtcggggtcggttccttcgggcccccgggcggttgctgagcggcggtcgagtaccgttccaagggctcggcaccggctccggtgccgaggcacccacgatcgacgggaggggaacgagcatgctcatggtggcgagtgcgaatggccgggccggcatcgatgccgtatttcctcggctcctcgaaggagcgctgaccccgttggacgccgtcgaagaggcggcctgggtcaccgaggacgatccggccgatcactcagtcggtaccgggggcctccccaacatcttcggtgccgtcgagctcgatgcgtccatcatggacgggaccaccctcaaggccggtgcggtcgcggcgttgcgaggctttcgtcaccccatcagcgtggcccgagccgtgatggaacgatccccccatgtcctgctcgttggtgagggtgccgcagcgttcgcacgcgcggtcggagccgaggccgccgtgctcgagaccgctgaggcgctcgcttcttggagaacggcgatcgcctccctgcacgccgaggagctcgcctcgacgctcgcgatggcacgagcactcacccgcgatcccgagcgggccgtcggtacggtcaactacctggcactcgacgaccgaggccgcatggccagtgccgtgtcgacgagcggatgggccttcaagtggccagggcgagccggtgacagccccgtcatcggcgccggcaactactgcgatgcccgtgtcggcgcggcggcatgcacaggctttggcgagctctcgctccggactcagctcgccagccgctgcgttggcttcctcgaggccggggccacctgcgaggaggctgctgtgcgtgcgatcgagctggtgaaccgcctgcaggtcgatcccgccgagcgcatcatgcacatcgtggtcctcgatcgagatgggaaccacgcggcggcgtcgacgcgagcgggaacgacgtatgcctggcgtgatgggtcacaaccacactgccagctctccccgagaacgcacgtcccccccgagggctcatccgtcgtaggctaagcagcacacgatccgacgggaggtagtcgtggctcctgaggaacgcaggacactgccgggctccgccatgcctcgtccggcgggcgcccaggtgctcggccagatccccgacgacgaacgtgtcgaggtgaccgtcgtactccaaccgcgcgcccccctccctgagccagggccgacccccatgtcgcgagcggagcttgccgatctgcgcagtccacccgagggagcgctcgaagcgatcgctcgctacgtcgccggtcagggcctcgaggtcatcgcagccgacgcacctcgacgccgcatcgtgctcgcgggaagcgcagcacggatcgcggctctctttggtatcagcttcgtgcgactccagctcgagggccgacggtatcggacctacgaaggggagatctcgcttccggccgagctcgcccccctcgtggtcgcggtcctcggtctcgacacccgccccttcgcgcgctcccatcggcgtccggcggtggcgccgaacgcacccacgaccgctccgaccgtcgcgcgcgcctacgacttcccgaccgcctacgacgggcgcggtacgacgatcgggttcatcgagctcggaggcggcttccaagagagcgacctcgtgcgctactgcgaggggctcggcctctcgacgccccaggtcagcgtcgtcggcgtcgacggcgcccgcaacgccccgaccggcgaccccaacgggcccgacgcggaggtgatgctcgatctcgaggtcgccaccggggtggccaacggcgccgacctcgtgctctacatggcggcgaacaccgacgcggcgttctacagcgcgatcgccaccgcgcttcgcgacgccacacacgctcccgtcgcgatctcgatctcctggggcgcaccggaggagtcctacccagccaccacgatcgcggccttcgagagcgtgctcgaggaggcggtccatgtcggcgtgacggtcctcgtcgcggccggcgaccaaggctccacggacggcgtcgacgacggacgcgcacacgtggactaccccgcggcgagcccctacgtgctcgcgtgcggtggtacgcgcctcgacctcgacggcaccacgatcgtcgccgagacggtctggaacgacctgccgaacggcggcgcgaccggcggagggatctctgcgctcttcccggtcccgtcgtggcaagcaggcatcgcaatgccaccgagcgccaatcccggtgccggaccaggacgcggcgtccccgacgtcgcgggcaacgccgatcccgacacgggctatcggatcgttgtcgatggggtcgcaaccgtcgtcgggggcacgagtgccgtcgcaccactctgggctggcctcgtggcacgctgtcaccaagccggcgctcgtggcggcttctggaacccgctcctctacgcagcccggggatcgtcggcgttccacgagatcaccgtggggtcgaacggagcctacgacgcagggcccatctggaatgcgtgttgcggcctcggctcaccgaacggcaccgccatcctccaaacgctcagagcgtgaccccgacgaacgcaaccctctgggccacgtccgatccgacgcagcccagggcgtgccgtgtgagtgtcccgcgtcgaggcgtacccggctcacaccaccgcaagttgacgcgtgatcgcgacgtcacgctcgagcgtcgcgtgcacggggcaacggcgatcgacctcgttggcgagctgctcgtagcgttctggcgtgctcgggccacgaagctcgacgtgaacgaccacgtcgctcacacagggccgagccgcaccgtcgagcgtcgcgggatccagcgatccctcgacacggaccgtgaccgaatcgagtggaacgttctgcgcctcggccacgtgctggtaggtcaacacctggcacgaggcgagcgcgccaaggaggaactccaccggacttgccagcgtgccatcggatgcgacctcgaagcggcgaccccgtgcgagctcgatctcggcacggccggcggcgctcgtcgtcgccgtcgctccaaagcgcacgacgggtcgtggaccggacgatgacggatttgatgctgaacgtgtcatacgcatagcttactatcccgatcggctttatcaggtataggtcgactggttatcaccgcaccggttacggaggttgcatgcagcaggtcatcaccgggtggacgaccgacgacgagggcgactgggtcgcactcctcgcgtgtggccatcgacgccatgtacgccatcgccctccactcttcccagcgccctgggtcctcgacgagatcggacgctccgaccacgtcggtcagccgatcgactgtggccgctgccgccaagggatcttgccgccgctcaccgacgagacggcaaccctgacctggatcgacgctcgggcgaccgacgtcgagtgggtcatggggggacggacgaatcactgggagctcgtcgtcgtagccgaggggcgagtgcacctggagctcaccttcgctgacggcgacacgacgacgtggtggctcgagggcggcatgcagcgggccctcccggtcggctgcgcgtaccgcctccgaacggcgacccacgcgtcggtccttctcgcacgcttcgaccagtcctgactcgaccgacgaccgcagtgacgctcgagcccgcgagcgcaccgctccctcgccgagacgcccgctcaccccagcaccggcgacggacccaccacgatcaagccgagcccgatgagcgtcacgaagaccaccccgagcacccgctgtagcacgcgcatcgcaacctccgaatccgggccagacacagtcccaacgcctcgacacagccccaacgcacgacgagccgggatcccgaaggatcccggctcgtcacgaaagcccggtcggcggcgccctactctcccagggggtctccccccaagtaccatcggcgctggtgggcttaacggccgtgttcggaatgggaacgggtgtttccccaccgccatggccaccgcccggacgatctgcggcgtcgagcgctccagagcgagcacgaggagctccaagtcctcggccgattagtaccggtcggctgaacacgttgccgtgcgtacacctccggcctatcaacgtggtcgtctaccacgggccttaccaggttgaccctgtgggaaacctcatcttgagacgagcttcgcgcttatatgctttcagcgcttatcccttccgtaggtcgctaaccagccgtgcccttggcaggacaactggcacacgagcgctacgtccgtcccggtcctctcgtactagggacagcctctctcaagtttcctacggctgcatcggatagggaccgaactgtctcacgacgttctaaacccagctcgcgtaccgctttaatgggcgaacagcccaacccttgggaccgacttcagccccaggatgcgacgagccgacatcgaggtgccaaaccttgccgtcgatatggactcttgggcaagatgagcctgttatccccggggtaccttttatccgttgagcgacggcgcttccacatgcgaccgccggatcactatgccctgctttcgcacctgctcgacatgtgggtctcgcagtcaagctcccttgtgccattgcactcgacgactgattgccaaccagtctgagggaacctttgggcgcctccgttactctttaggaggcgaccgccccagtcaaactgcccacctgacgcggtcccggacccggattcacgggtcgcggttagagctccagcaccgacagggtggtatttcaaggacgcctccagggaagctagcgctcccctttcgcaggctcccacctatcctacacagtcggaaccaaagctcaacatcaagctacagtaaaggtccacggggtctttccgtcctgatgcagctaacgagcatctttactcgtacttcaatttcgccgggtctgtggttgagacagtggggaagtcgttacgccattcgtgcgggtcggaacttacccgacaaggaatttcgctaccttagcaccgttatagttacggcggccgtttaccggggcttaggttcagagcttcgcccttgcgggctaacccctccccgtaaccttccggcaccgggcaggcgtcacagcgtatacatcgtcttggcgacttggcacgctgctgtgtttttagtaaacagtcgcttccccctggtttgtgacaccccctcgggctccgggcgcgaggcccttcaccctaccgaggtcttccttatcccgaagttacggaagtaatttgccgagttccttaaccacagttctcccgctcgccttggtattctctacctgcctacctgtgtcggtttggggtacgggcgcctcgatcactcgctagaagcttttctcggcagcatgggatcagtgacttcgcccgaagtgggctcggagtcgcgtctcaggcttcgtgaggtccggatttgcctggccctcgccctacacgctttccccaggaacgaccaacgcctgggatcacctaccctcctgcgtccctccatcgctcaaacgcgatcggggcggtaccggaatatgaaccggttgtgcatcgactacgccttgcggcctcgccttagctcccgactcaccctgggtggacgagccttgcccaggaaccctgaggcattcggcggaggggattctcacccctcgttcgctactcatgccagcattctcactcgagcgcgctccagctcggctcacgcctcaccttcacggcacgctcgacgctcccctaccgcccggtgacgtacgtcaccggacccgcagcttcggtgaccggcttagccccgttacattatccgcgcggaaccactcgaccagtgagctattacgcactctttgaagggtggctgcttctaagccaacctcctggctgtctgggcggttccacatcgttttccacttagccggtactttgggaccttagctggcggtctgggctgtttccctctcgaccacgaagctcatcccccgtggtctcactgccaggctctggagcatcggcattcggagtttggttgggatcagtaaggctgtgggcccccatagcccatccagtgctctacctccgatgctgaacacctgacgctgcacctcaatgcatttcggggagaaccagctatcaccgagtttgattggcctttcacccctatccacaggtcatcccccctgttttcaaccagggtgggttcggccctccacgggatcttacccccgcttcagcctgcccatggatagatcactcggcttcgggtctaccgcaggcaactctcgtcgccctgttcagactcgctttcgcttcggctcccccacgcatgggttaacctcgctacctacggtaactcgctggctcattcttcaaaaggcacgccatcgccctcacgggctctgactgcttgtagaccaacggtttcaggatctgtttcactcccctctcggggtgcttttcacctttccctcacggtactagttcgctatcggtcgcctgggagtacttagccttacgaggtggtcctcgcagattcacacgggctttcccggatcccgcgctacttgggtggcgacggggaggcagctcgcttcgcctacggggctgtcaccccctgtggcgcgacgttccagtcgcttcggctcacgcgctgcttggtaactccctggaggggctggcgcaccctcctcgtcgctcccgctacccccggacggcaacgccgccaggcttgacaccgcccgggtttgggctgatccccgttcgctcgccgctactaggggagtcgcggttgctttcctctcctgggggtactgagatgtttcaattccccccgttccctcctcctgccctatgtgttcaggcaggggtgacgtggcattccccacgccgggtttccccattcggacatccatggatcaacgcttggtcgacagctccccatggcttatcgcagtcgcccacgtccttcatcggctccaggcgccaaggcattcaccgttggcccttcgtaccttggagttgtgatactcgtgctcgctctggagttctcaagctgccgcgcagcaggtgcttcgcgaagagggagccagtgcttcgactgggtgcggccactcgttgtggccactccttagaaaggaggtgatccagccgcaccttccggtacggctaccttgttacgacttcaccccaatcgccgaccccaccttcgacggctccctcccttgcgggttgggccaccggcttcgggtgttgccgactttcgtggtgtgacgggcggtgtgtacaaggcccgggaacgtattcaccccggcgtgctgatccgggattactagcgactccgacttcacgcagtcgagttgcagactgcgatccgaactgagaccggttttttgggattggctccccctcgcgggttggcgaccctttgtaccggccattgtagcatgcgtgcagccctggacgtaaggggcatgatgacttgacgtcgtccccaccttcctccgaattaactccggcagtcccctacgagtccccggcatgacccgctggcaacatagggcaagggttgcgctcgttgcgggacttaacccaacatctcacgacacgagctgacgacagccatgcaccacctgtgaagggccccgaaggacaccgcatctctgcggcttttccctccatgtcaagcccaggtgaggttcttcgcgttgcatcgaattaagccgcatgctccgccgcttgtgcgggcccccgtcaattcctttgagttttagccttgcggccgtactccccaggcggggcacttaatgcgttagcgtcggcacggagcccgtcgaatgaggccccacacctagtgcccaacgtttagggcgtggactaccagggtatctaatcctgttcgctccccacgctttcgctcctcagcgtcagtaccggcccagatcgctgccttcgccattggtgttcctcctgatatctgcgcatttcaccgctacaccaggaattccacgatcctctaccggactcaagccatggcagtatcggatggcgacaccaggttgagcctggtgatttcacatccgacttgccaagccgcctacgagctctttacgcccagtaaatccggacaacgctcgccccctacgtcttaccgcggctgctggcacgtagttagccggggcttcttctgcaggtaccgtcagtttcgtccctgctgaaaggagtttacaacccgaaggccttcgtcctccacgcggcgttgctgcgtcaggctttcgcccattgcgcaatattccccactgctgcctcccgtaggagtctgggccgtgtctcagtcccagtgtggctgatcgtcctctcagaccagctacccgtcgtcgccttggtgggccgttaccccaccaacaagctgataggccgcgaggccgtcccgtcgcgcccgaaggctttgctccctcgaccatgcggtcaggggagcacatgcggtattagcaccggtttcccggtgttatcccccacgtcggggtgggttcctcacgtgttacgcacccgttcgccactcggtggcaagccaccgcgtacgacttgcatgtgttaggcacgccgccagcgttcgtcctgagccaggatcaaactctccattggagatcgttccgagggtggagtccaccctcgctcgcctcgccccgggacacgtgggtctcgggtgagggagagtcgatcatggttggtgggtttggtcccaccgtttgtgttgtcggggtgacaccgagcttgtgctcgggtcgcccgcactggcttgtcttccctcttcgcgatgtcaacctgcgcccctgtcggggctctgccacgagggcacccgaaggtgctcgttgtggatggtgggttgccccacccccagcggtgctcttggagcacgtgggattcatcagtgtagcggggtcggaacgggtcgtgcacggttgggggacatcttctgtcgagatgggacgtcccgcgtcaagtaccatcggcccatgcctgtctatcgactcggttcccgcagcccccgcatccatcccgacgcattcgttcatcccgatgcggtcgtgatcggcgacgtcgagatcgacgaggaggcatccatctggccgcacgccgtcctgcgcggcgactacggccacatccatatcggcgcccgcacgtcgatccaagacggcaccgtcgtgcacgccacggccgacctcgcgacacgcatcggggcggcctgcgtcgtcggacaccttgcccacctcgagggctgcaccgtcgaggatcacgtcctcatcgggtctgggtcggtggtcttgcaccgcgccgtcatccactcccacgcgctcgtcggcgcccatgcgacggtgaccaacgacaccgaggttccatcccacgccctcgcactcggaacacccgcggcgatccaccccgatcgcgtgcccgccggcaccttcgacgatgcggtgcagcgctacgtcgagaacgcgcgccgctaccgcacggatctcatccgcatcgagtagcggtcgattcgcgcgacgagccgaccgcccacctcggtcaccgtgacgggcatgccgaagaccgcggcgagcgcatcggcgtcctggaggatcgcacgagtaccaaagcgggtgatccccgctccgacgaggagcacgtggctcacctgggcggggagctcctcgacatggtgggtcacgatgaacgccgcgcgcggtcgtggcgaccgctcgagcagctcttcgagcgcccacagggcctcctcgcgaccgatgagatcgagatgcgaggttggctcatcgagcacgatgatctcagggcgccccgcaaaggctctggcgaggaggactcgctgacgctgaccagcagacagatcctcgatggctcgatcacccacgttcgccaggcccaccctcgccaacagccggtccgcttcgacgagttcctcgtcggagagctcgaaccacgcacgacgaaggccagcatgaggaccgagcgcgaccgcatcgcgggcgctcgtcgtcggcaccagctgagtcgtgagctcgtccgcgaagtacccgacccgtgcgcggaagctgcgcacgtcaccgtggcgcaggtcgcagtcgaggactcgaagctctcccgagcgcgggcgcaaccggcccgcgatggccgcggcgatggtcgacttgccggcaccgttcggacccacgaccgcgaccaccgcgccgtcggggacgtcgagcgtcagcccttcgagcaccgtcttcgtaccacgggcgatcgagagattcgtcgcgctgatcaccgtcgcgttcgccatggaacgccaccctacgcgacctagatggcgattagcagcacagcgaccatcgctagcaccatgccgacgatctggcgcgggctcgggctgacacgatcgatgacgagaccgagcacgagcgtcacgaccggatagacggcagtcacggccacgatgggtgctgccgttccaagcggcgcggctcgcagagcgagaaagtagagcaagtaaccggcgacacccgcgaccccggccgcgatcgcaagtggccccatgtagggccgcaagaacgcgatcgatggtaaggcaatgacggcctcgacgagcacgacaccgagccagagcgacagtgcggaagccgaatgacccgcccgagcggagaagtacccccacaccccccacgcaagcgcgctcccaaccgcaagcagcaccccgaggagaacggatcgcaccgctccagcctacgtctcgcgaactgccggcgattcctcaagttcgcgtcgaccgcacccgatacgatcgcagggagggtcatgggacacgactcgagttcgatcatcctgcgagggcgcgaccagatcacgcacgacgcgctcgcacaacagcttcggctcctcaggacccacgcgggcgcgatgggtgtcgccgtcgtgcgggtcggagacgatgggcgcgtcgtcatcgaggcgctcgacatggaccgagccctcctgcgtgagggtgaggagatcgtcgtcaccgacccaaaggtgctgcctgagcgcgcagacgcaccgagtctgcgaccggggcgcatcgaaagcgacctcttgacgttctcgccactgcatggtctcgtcctcgtccccttcgagagtccacaggaccagtcgctcgcactccttgtgttcgctgcgcgcccgctcctcgtgaccgacgacgcactggtgcttgcagcccgcaccatcgagaccttcctgatcgccgcgagccgctttaccgaggaactgcgctacctgaagggcaccctcacacagtcggagttctactccgaccgagaccccctcacccacgcgctcaatcgtcgtggtttcatcggcctgctgcatcgcctcgaagccgactggccgcaccggcgaatggcctacgcgatcatcgtggccgacctcgatcatctcaagcaagtgaacgaccaccaagggcatgccgccggtgacgcgctgatccagcgcttcgtcgagaccctccgctccaacctgcgtgagccggagaacgtcgggcgtctggggggagatgagtttgcggtcgtcgccaagctcaggacacccgccgagacgcagatcctcctgaaccgcttgcgcaccgcactcgacgccgcggggatcgctgcctccctcggagcggcgagccgcgacgtcccgatgccgctcgaggaactcctcgtcctcgccgaccgagcgatgtacgacgacaagttccgtcgccacgaagccatcgagggcatcgaggccacggcaccatcgctcttcgaaccaaccctctagcgatcgctgcctgtcgttcgccaccggtcccgatgccgatcggaacgcggggctcatacgcgcctcgctgacaccacagcaaagccacacatgagcaagggggcgcgctgcgcccccttgccttcgatcatgtccctagcccgggccctgacggatgcggccaagttgaccgctgcgggcaccgacgtgcaggcgctgatgagtgcgagacgccgcactcagcggagtggctcaggcgtccgcgctgtcgtcgtcgcccgtgccgtcaccggttccctcctcgccctgaggcgggccgatgtagttgccctcgtcgtcgtagtactcggcaaaggcctctcggtactcgggtgcgagctccccgccctcgagcgcctgacggatcgacaggctgatgcgccgacgaccggggtcgagatcgatgatcttgacccacagctcctcgccgaccgagaccacctgctccgggagatcgacgtggtggagggccatctccgagatgtgcacaagaccttcgatcccgggcgcaacttgcacgaagcacccgaacggcacgatcttggtgacccgtccgtagaccagctccccgatcttgtgagccgaagcgaactcctgccacgggtcccgctgcgtcgccttgagcgacagtgagatgcgctcgtgctcctggtcgacctcgagcaccaggacctgcacctcatcgccgaccgagacgaccgacgatgggtgatcgacatgattccacgagagttccgacacgtgcacgagcccgtccataccgccaaggtcgacgaagacgccgaagtgcacgatcgacgagacgacgcccttgcgcacctcgcccgggcgaatcgaggtcaagaagcgctcgcgctgatcgcgctgattctcctcaaggtaggcccgccgactcagcacgacgttgttgcggccccgatcgagttcgatgatcttggcctcgatgtcttggcccacgaacggtgcgagatcacgcacccgtcgcaggtccacatgggacgcgggcagaaagcctcgcagtccgatgtcgacgatgaggccacccttgacgacctcgatgacctcgccgcggaccacgccgtcgcgagccttgatcgcctcgatctccttccaggccttctcgaactgggcccgcttcttcgacaggaccaatcgcccctcgcggtcttccttctggaggaccaaggcgtcgatccggtcgccaacgctgaccacgtcggcggggctcacgtccttacggatcgagagctctcggagcgggatgaccccctccgacttgtagccaatgtccaggaggacctcatccttgtccaccttgacgaccagtccgctgacgatgtcaccctcgtcgaactcgacgaggctcttggcaatcgcctcctcgagtccctgctcgccaaggtcgtcgaggacgatcgcgtccgaggccgcgggagccccatgctcggatcccagctcgcgttcgctcgcggactccgacgccatctcttcagtcatgctcgatccgatatccttctgcttcttccaacgccaccagcgcggacgtgccacgccatggccgaggatagtcggccgaatgccggccgctgcggctcatgcgtcagctttggcacgaccccaacttcggccgacgccgctctgtactcgcagcggcacccgtagtgcaaaggcgtgctcgagcacgtcctcgacgagggcacggacgtcgtgcgcgcgctccgcgacagcctcgaccacgacttcgtcgtggacttggagcacgagtgcgccatcggtagggctcagcgcagcgtgcaagcgcaccagggcgatcttgaagatgtcggccgcaagaccctgtgtccccgcgttcatcgcctgccgctcggcgccttggcgaacggtgcgattgggtgagtcgaggtcggggagatagcggcgccgtccgagcagcgtcgtagtgaaaccctgcgctctcgccgcatcgacggaagcatcgcggtagtgccgcagccccggaaaggccgcgaagaaatctgccagtatcccctcggcctccgcgggagggacaccaagacgttgggcgaggccgtaggcctccatgccataggacagaccataggtcaccatcttggctaccgaccgctgctgcggcgtgacgcgctctgctggtacgccgaagacacgcgcagccacgagggtgtggacatcgccatcgcccgagaggatccgtaccagctcctcgtcgcccgacaggtgtgcgaggacccggagctcgatctgtgagtagtcggccgccacgagcacgtgaccctccgtcgccacgaaggcgtcgcggaaccgcttgccctcgtcggtacggaccgggatgttctggaggttcggtcgctcggaagagatccggcccgtgcgtgcgacggcctggttgaaggtggcgtggatgcggccgtcggcaccgatctcactgcgcagaccttcgtagaacgtcgacagcagcttgtcgagctcgcgaaagcgaaggatcgccgcgacgatgggatgagcgtcgcgcaagctctcgagcacacgggcgtccgtcgagtaccccgtcttcgtcttccggcctgccggcaacccaagccgctcgaacaggaccaccgcgagctggcgcggtgagttcgggttcagctcaccaccggcgtagtgccggacctccgcgagagcacgatcgcgctcggtggcgagctccgtaccgatcgccgccaggacgtcgcggtcgatcgctaccccatggatctccatgtccgtcaggactcgcgtgagcgggatctccacgtcggtcgcgagacgccacagatcgtcctccgtcaggcgccgctccaacgcttcgcgaatcggatggacgacctcgacccactgcctcgctccgagcggcgccgcttccgcttcgaggggcccccggtcgtcgaggtgtctcccgagccagcgccgcgccagttggtcgagaccgtgagcaacgtccgcagagtcgaccagccacccgagcacctcgagatcgacgagcgcgcgtggctcgagcggcaccgcatgctccatcacgagcgagcgcacgatctccttcgggcctgctcccacgaggacgcacgacccgagggcctcccacagatgcgtgggggcatcctccggagagcccgcccaaaccacgccctcgacgccgagcgcgagctcgaccacgcggctacgtccggggtctccagcgaacgtagccgccaccgccaccgtggcacctggtgcgagccgctcgacgacggcggcggcgctgacgtcggtgaggtgcgcaaccggcgactcgaccggcggtggttcgtcgccggcggtcggccgaccctcgaacgcccgcaccagggcctgaaacggacgccgcagctcgaaggtccccaccatgagcgtctcggcccgccgcgggtcccacggaccgagtcgcagcgcatcgagggaaggtagctccgcgacgtctcgacgcagctgcgtcagcaggcgtgcctcgaggagctgtgagcgcgcctgctccagcgcctcgcgttgccgcgccgagagggcatcgaggtgagccaagatcccttcgatcgactcgaaccgatcgagcagggcggcggcggtcttcggcccaatccctggcacgcccgggaggttgtcggagctatcccctcgcagggaggccagatcgccgtagcgggctggtggaaccccgtaggtctcgaggaccttggcctcatcgaaggcctcgagattggagacccccttgcgcgtgaggagcaccacaatgagcgggtcctcgaccagctgcaagaggtcccgatcgccggtcacgatgcgggtggcgatcccggcgtcgcgggcgcgcgtggcgagggttgcgatgacgtcatcggcttcgaacccgctcgcctcgacagcggggacgccgatcgcctcgagcaacccacgagccgcatcgagctgctgtcgcaggtcatctggggtcggtgccctcgtccccttgtagctctcgaggatggcgtcgcgaaaggtcgggccctccgcgtccaacgcgaccgcgaggtgcgtgggccgggtttgggcgacgacgttggcgagcatgctcgcgaacccgaacagggcgttggtcgcgaccccgctctccgtgcgcatcatcggctcccgcagggcgtagaaagcacgaaagaggagtgagtagccgtcgagcaggaggaggagctggcggtcagtcggttgtggagctgggactgagctcaccgttgatcacctgctcggcgatggaccgcacccgcgtgcgctggttcatcgcggtcttctgcaagaaccgaaatgcctgcgcctcggtgaagccatcacgctccatcagcaccgccttggcacggtcgaggagcacgcgcgtctcgagacgctccgcgatccgttcgtgctcgtcacgcaatctggccagctcagcctcgatgatctgtcgctcgtcgaaccgagccctggcgagctcgagcgcagcgacgagctctcctgcctggaagggcttgaccagatacgccatgaccccagcgtctcgcgcctcctcgacaagggcacgctgtgagaaggcggtcaagatgaccaccgcgaccgggacggagccttgcacgcgtcgcgccacatcgagcccgtcgagtcccggcatcttgatgtcgagcacggcgagatccggcttgagcgcaccgatcgcctcgagcgcctcgtcgccccgcccgaggtcggcgacgacctcgtagccctcgagctccaacatctcgcgcaggtcgcgccgaacgatcgcctcgtcctctgcgatgatcacgcgtgccgacatgcacccctcgctgctcgactcgcgcccacgctagccgcagcccggttccggtgctctcgccctagcctccagatcgtgatcaccgccctttccctctgggtcgccggcacgaacgcgtggatcgcgtctgccgacggccgagagtgcgtcatcgtcgatgcgcctccagagccatggcacatcgtcgagcggctcgacgcactcggcctccgcgtcagcgcgatcattgcaacgcatggtcatctcgaccacatcgggggcatgcacgatctccaacgcgcccgtaaggaagatgggctggtcgaggtgtggcgttccccagcggatgcgcactacttcgtggaccccctcgggaacgccccgctgctcgcagacgccgtcgacagatcccgtgtcaccgtcgccacgccagaaatgatccgcgatctcgacgacggcaccgtggtgcgtggggcaggtatcgagctgcgtgcaatctggacccccggacacacgccgggatcgacctgcctcctcgcgaccatcggcgacgaaggcaccgtgctcttcagcggcgatcacctcttcgcgggctcgatcggacgcacggatctccccggtggctcactcgagcacctgctcgcctcgatgcgcgatcgtatcctgccgctccccgacgacctggtagtcctgcctggccacggaccaacaaccacgatcggcagagagcgagcaacgaacccgtatctccaagacctgcgctgaccacaggcagcgcaatgaacgtctcggcggattggaacccggggctcgccgaggcgatggcgccgtgcccggggcgggactcgaacccgcacgcctgttggggcagaggcttttgaggcccccgtgtctaccattccaccacccgggcttggccgcagcctaccgtggctcccccaccgagccaagccgcgcgcacgtcacggtgaccggccccaagaccggatccaccctcacggtgggacccgacgtcctcacgctaccgctcgcaggtccccccgggcaccgatcatctcgagtgcggagaacgtccgactcctcgtcgaggtgcagaggatgtgccgctggctctcgacgtcgagcccccggacctcggcggggccgaggtagccggcggatccacaggcccacgttgtgttggtgcggtgcgagtcgtgcccgaggagcactccggcctccgacacagagccgaacagctccccatcgagcacctcctcgcggacctgggcgcacagtgactcgcacaccccgttaccgccacagcgagcccggatcggtgaaccacgaggtcactccgagttcgctcgcccagcttgccacggaacccgcgacgaactccggggcgttgtcgacccgaagaaagccttgggctcctcgctcggcgacgaggccatcgagggtggcgacacgtcttcggcgtcgatcgagtgccccaccacgcaaggccagctcctccctggtggaggcgtccaccacgcatcgcaccgtgagcgccctcccgtcgtcggtcgcgtcgaaccggctccagtgcccagatcgcgttcgcctggatgggcaggtgagacaccgtttgtcaaccccccacgcagccggcgactcctcgcatggcgcgggaggactcaggcggcagcccgaggcgatggtccgggggcacgtccaagggcacggttccggttcgccacgtgacgcccctcgtcgtagggcacgccctggcgagggttcgccagggcgaaggtacgcaagacctcggtgatggtcgcatccaggctggactcgggcttcgtcggcacccgacgctgggtggagcgaggctggcctgtcacccggcacgctcgtcgctcggagacctgagaaccgctggcggagccggcgcacggctccccgccggcggtccggggtcagacgtttccctcggccagctcctcagagctgtcgatgtcgagggagaactctgccaccaacttcttcaagcgccggttctcggctcagagctccttgagcctcttcacgtctggccccttcatgccgccggaggtctgcttccagccgctaccaggtggtcttggtgatgtgcaaaggcccgggcgacctcggcgaccgtggcgcccttggtgagcagctgtccctctcggccagcctccggaggatctgctccggcctgtggggcttcgggcccttcatgtggtctccctcccgcatgtccagtctggtcggggttctcacagagcgggtggtctcgttgcaggggggccagccaagttggggtacaggtcatcgatggcacccagttgcatatcaccaaatcctctcccactggcgtcaaatagatggactcgaggagacgagagcacgtgtgagagaggatgtcaaccgatcatcggtaagtcgggtggctggtagcatgtccctgtcgtggtcgcgtaggctgcagcccgttcagtcgccgccgtgtgtcggcgatccaagccgacccggcgcgaagatgccggccggatcgaacaggcgcttgatgcccgcgtcgatgcgcaactcggtcgcgctcgcgtgggtccggaactcctcaagcttggcgaccccgatgccgtgctcgcccgacaccgcccccccacggcgaacgccctcggcaaccacttcttccacgacacgccgtgcgctggccacatcgtcggcgaacaccgacaggtggacgttcccatcgccgacgtggcccgttgcggcgaggcgcaccccataggtggaggcgacggccgcgaccgcatcgaagtagtctccgagcctggctggcggaacgaccacgtcgacgatgtcgcgggcaccgagagccctcaccgtccacagggccgcttctcgggcgcgcagcacggcccggccttcggtcttgccgagaacccatacgccatcggcgccagccccctcgagtacggctcccgccagctcgaccgctcgtgcaacgtcgtccgcgtcgacacgctccaccgcaacgacgaggatcgcgccgtcggcgagcgcccagccgggtagcccgagggtcacgcccgcaaagtgagccatcgcctcgagcgcgctcggttcgaggtactcgatcacgcttggtggcggctcgatcgactgcagagcctgcaccgccccgagcgcaccacgcatggtcggggcatgagcaacgaacaccgcctcctcggcacgcggcgcgagccgcaatatcgctcgctccacgatgccgagcgtgccttcggatccgatgacgagctgcaggaggtcgtaacccgacgagcgcttgtagagggagcctccgagcgtcaagacgcgaccgccacccgtgaccactgtggcaccgagaacgttctgcctggtcgtaccgaagcgcaccgctcgcattccgccggcgttcgtcgcgaccgtcccgccgatcgaagcggcgttctcgccaggcgacacggtgtagcgcaagccgtgatcggcgagcacgtgatcgagttcggcgaggctcgtgccggcacggacgacggcgacgcgggacaccgtgtcgacgtcgtccaccccgctgagccgctcggtactgacacagacctcggttggccgacagaccgctccgccggccagccccgtccccgcccctcgcacgacgagcgggacctggcgacgctcggcccagcggacgagctcgacgagctcgtccgtgtccgctgggcgcacgagcgccatcggccggctcggcgcgaccgtcaaggactcgtcgtgccagtagcgctcctcgatcatctcgccgacggcgagatgatcgggtcccacgatcgaaccgagctcctcgaatgcacgctgcacggatcgaccttaggcagtggggctccggagggcaaggcttgccccggtttcgccatgcccgacacccacgcagcctcgagtctgtaacccaatccgacgcgagagcatctaactgatgaaggctggagaaggggcaggtacctacgcagtgacggagcggcgcagacgcacaccgagcagggcacctcacgcagggtagctcgtcagtgtcatcggctctggtggcgcgacacgaggcactcgccctagggcgtggctacgagggagaggtcgtgcgcacgggatggggcgtcaggcgccacgatggatcgaggtccgtcggacgcgcacgagcgcagcggcaggtagtcagcaggtagtacggagagagggaaagggagtacagccatggtggtgtttctgttccccggtcagggctcacagcagcccggtatgggggcagcctggcgcgaccatccctcgttcgaactcgtcgacgaggccagcgacgtgctcggtcgcgacatggcctggctgctcctcgaggcggatgccgagacgctccagatcacgcggaacacccaggtggcgacgctcctcatgagcgcgatcgcgctcgacgccatcgagcgcctcggcatcgcaccgcagctcgctgcaggccactccctcggtgagtatgccgccctcgtggccgcgggcgggatctcacttgaggcagggctgctcctcgttcaagagcgcggcgacgcgatggcccaagccgccgaggcatccccgggcgcgatgatcgccctcctcggcgcgacgcttgaccaggcgcttcagctcgtcgatgcgatcggaccggatctgtggctcgccaaccacaactccgacacccagatcgtgctctccggcacgaccgacgcggtcgcgagtgcggaggagcttgcacgcgagtacgggatccggcgggtcacgcggctcaaggtcggtggcgccttccattcgccctacatgctcgaggccaaggatcgcctgcgcaaggccatcgcccagacgaagttctacgacctcgaggttccggtgatcgctaacgtcgatgcgcgcgagcacgtccttgcgagcgaatggcccacgctcctcgccgagcagctcaccagcccggtgcgttgggccgagacgatgagcgccatcgccgccgctcggccggccctcatcgtcgaggtcggccccggcggagtgctcgccaacctcgccaagcgcgccatcgccgacattccaacgatcgcggtggccaccccagatgacctcgaaaccctggtggaacggctcgccggcgacggaccggtcgccgaatgggcgacctcccaccagggcgagcgcctctacggctctgagcgccttatcgtcgcgccggtcacgggcgtgttccagccagcccggccggctccggagcccggcgcgcccgtccgagtcggtaccgaagtagggacgatcggcgacactccggttcgatcggccttcgccggtacgctaaaggagatgctggccgtcccgggcgagcgcgtcaccgctggccagccggtcgcctggctgtcggagacgagcgcttccgaccacgcaccggccgccatcgcaacccccctccacgaaagcaggtaagtcacactatgggagcacggatcatcggggtcggccaggccgtcccggatcgggtcgtcaccaacgccgatttcgaggcctatctcgacacctctgacacctggatcaccgaacgcaccggcatccgcgagcgccgcttcggcggcaccacctcgagcctggccatcgaggcggggcgacgcgcgatcgccgacgccgggttgacccccggcgacatcgacttcctcgtcctgtcgacgacgacgcccgatcagacggtcccggccacatctgccgaggtatcccaccagctcggaacccgcggtggcgccatggacctcaatgctgcctgcgcgggctacgtctatgccctcgtggtcgcacgtggcatgatcgcctctggggcacaccgggtgctcgtcatcggatccgacaccctctcgcgcatcaccgaccagaacgaccgctcgacggccgtcctcttcgcagacggtgctggtgcggtcgtcatggagcgtgccgacgaggacgacctcctcggctgggacctcggtgtcgacggggcggcgcgccccatcttgtactgcgaccacggcggctacatgtacatggagggacgcgaggtgttcaagcgcgccgttcgcgtcatggttgagtcgtcggagaccgcgatgaagcaagctggcgtgaacgccgacgacatcgcgctgctcgtaccccaccaggcaaacctgcgcatcatccaagccgccaacgaacgcctcggcatctcgctcgaccgtacggccgtcgtgctcgatcgctacggcaacacctcgtccggctcgatcccgctggccttggccgacgccgtcgcccaagggcgcctccatcccggtgatcacgtcctcttcacgggctttggtgccggcatgacctgggcaagtgcggtctggcggtgggccagatgacccacgtcctcgtcaccggcgccgcaagcggcatcggcctcgcgaccgtacgcaccctccaagcgagtgggtttaccatctcggccggcgtccaccaccgccccatgcccgacgacgtgctcgcagcgggcaacgtgacccccgtcgagctcgacgtcacgaactccgagagcgtcctcaaggcggtggcagcggccgaggcggccaacgggaccatcgaggcactcatcgccaacgccggcctcaccgacgatcagctcctgcttcgcatggatgaggcgtcgtgggccgcgacgatcgacctcaacctcacgtccgcattccgactcgccaaggccgtcgtcccgcgcatgctcaaagcccgtcgcggacgcatcgtcttcgtctcgtccgttgttgccctgctcggttcgccaggccagacgagctacgcagcagcgaaggccgggctcgtcggcttcgcgcgttcactcgcgcgcgaagtcggatctcgcggcatcaccgtcaacgtggtgatgccgggcatgatcgacaccgatctgctgcgcgcgaccggagagcaacgactcgcgtccatcctctcccaggtgccgctcggtcgcaccggtcggccggaggaagcggcgtcggttctcgcctttttggtctcggacgccgcgagctacgtgaccggatccgtcatccccgtcgacgggggtctcggaatgggcatctagcgcactcgcgcagcgcgagcggagagcctgtcggccgctcacgcgcccgtcgtgacaggcagtacggccgcaaggccatggaccagtaccacacaggaggaaccacaatggaccgcaccgaggcattcgagaagttcaaggtcaccacggtcaaggtgctcggcgtcgagccggaccaggtcgtgatggacgccagcttcgcgaacgatctcgacgccgactcgctggatctcgtcgagctgatcatggcgctcgaagacgagttctccgtctccgtgcccgagtccgagctcgagggcgtcgataccgtgggcaaggcgttcgagctggtctacgggaagctctcgtgagagttgaggcatccgagcccgaacggttcgcgtctcggcgcgtcgccgtcacgggcatcggcgtcgtgagcgctgtgggcatcggcaaggaggccttctgggagggcctccttgcaccagcacgcacgggtgtgcggcgcatcgaaggatgggatccgtctgcctggctcgggccgaaggagatccgccgccacgatcgctacaaccagttcggcgtcgccgcagcgcagatggcatgggacgacgccggagcgccatcggtcgatccggcgcgcgccggtgtgatcatggggaccggcgtcggcgggctcgagagcctcgagaaccagatcgtcatggcggagaagcgcggctacgaccgcatcacgccgttcctcgtcccgctcttcatggccaactccaacgccgcgtcgatctcgatgcgcttcggtctcaacggtccttgcgagaccatctcgacggcgtgcgcggccgggaaccacgccatcgccaacgctgcgcacctggtcgcgatggggcgcctcgacgtggccctcgcgggcggtgccgaggcagcgatcacgccctcggcgacagctggcttcaccaacatgaccgcactgtcgaaggaggggatctctcgaccgttcgatcgtgaccgagacgggttcgtgatggccgaaggtgccgcggtgctcgtgctcgaggatgccgagcatgctcgagcacgtggcgcgcacatctacgcctacatcgaggggacggcctcgaccgccgacgcccaccacatcaccgcacccgcccctggcggcgtcggtgcgcgcagcgccatcgagctcgccctcgccgatgccggcatcacccctcgtgacgttggccacgtcaacgcccatggcacctcaacaccgctcaacgaccttgccgaggctggtgcgcttcgtgccgtctttggtgacgccgtaccgccggtgaccagcatgaagggggcgctcggccacgcgctcggcgccgccgccgcgctggaggcggtcggggtcatgctcaccttcgagcaccagctgatccccccgacgcaggggacggtcgccctcgatccggagatcgacatcgacgtggtcctcaaagatcctcgcccgctgccgccggggcgcatcatctcgaatgcgttcggcttcggcggtcacaatgcggtgatcgtcttcggcccgccttcgacggactgaacctcgcgctcgccgcgcagcacacgcagcgagacaacacgaagggtcgcccgaaacgcctcgggcgaccctttgctgtgccacctggctgtagtccggctgcgcgcttgacgcatggtcgcccgatcggtcatcgtcatagcaacgaaccacggggccgagccccgacccttagcgagggtcgcaagcatccgccaaccctcacgtccgctctccgctcccggcgccccggcgttcgcccctgtagcggacgctcggggatgcgagactcagcgctcgcgagaggcgtgttcgccgaggatgatctcggcgccacgctcggcgatcgcgatggtcggtgcgttggtgtggccgcgaacgatctctggcatcaccgatgcatcgacgacgcggagcgccccgacgcccctcacccgcagcatcgggtcgaccaccgagcgctcgtcacgtcccatacgtgcggtggaggtcgggtgatagatggtgtgggccacgctctcgagcgcgagtaccgctcgttcgtgggggtcgagccgctccccatggtccggcatcaaaagacgtccggtcgtgtgcgcccggagcgccctcgaggtccgcagcacctcgagccgctccagccctgcgatcatgcggttcctgtcgtgtccgtcggggtcggacagataggcggggtcgatacgtgggcccacgagcggatcggggctcgccagcgtgacgctgccgcggctctcgggcgtgagtaggatcaccccgagcgtcagtccatcgaccgtgatgggcacgagaccctcgccgagataggcgaccggcgcgaagaggacctcgagatcgggtgccgcaaggcccggatcggatcgccagaacccgtaggcctcggcgatgttcgaggtcagcatgcccctccggcccacgaagtagcgcaccacttcggcagcgctggtcgctgagcgcagcgtcggttcggtcgtctcgaggaccataccggccacgaggtgatcgcggaggttccggcccacctcgggggcgtggtacaccacccgaatcccaagccgtcgcagtgcaccctcgtcaccgatgcccgagagcatgaggagctggggcgtgttgaccgctccggcagcgaggatgacctcggcgcgcgcgcccagcgcacgccgctcacggccgacgagatactccacgccaacggcgcgccccccctccacgatcacccgcgtcacacgagcctgcgtgcgcacgacgaggttggggcgatggcgcaccggccgcaggtacgcatcggcaacgctcgcacggcgtcccgacgcctgcgtgaccaccgtctcggtgaagccttccgggctcgggaggttcggggcctcgacgaccccgccggtctcgcggatcgcgtcgaggaacgcgcgcgtcacgggccgtggatcgcgctgagcctcgacgggaacgaccgcacgccgcatcgccgccatcatcgggtcgaagccccacgcaggaccggcgagctcggcccagcggtcgtagtcggctcgcatcccgacgacccacatcatcgcgttgatcgacgaggagcccccgaggcccttgccacgcggccagtagatggagcgtccttggaggttcggttgcgcaacggtgcgataggcccagtcgtagcgcgatcgaaacagtcgcgcgaacccggcggggatatggatgagtggcgatcgatcgcgcggacccgcctcgagcaccacgacgcgatgccgaccatcggcactcaagcggttggcgagcaccgcaccggccgatcccgccccgacgatcacgtagtcggcgtgctcgtccaccaccgccccttacgactcgctggccccgctgcgactgcgtcgaccgggtcggcgaccacgctcgtgggcctccatccgccgccgaatgagctcgcgccgttctcgcagctcgcgataggtcagctgctccgtcgtctcgtcgacgccgaggctcgccttcacgcccgacagatcgatcagctccggcgagaccgccacgccgatctcggacgtgatgcgcgcaccgtacttcgtcatgaagtaggcagccagacgagcgatctcggcgaagaggtcgatgtcgggggcgagcgtggcgagcgacgcgtccacgaagagcatgttcttcacgaagagcatcagctccttgggcatgcgagcacccgagccgagcagcgccttcgtgatctcctggagctcagcgacgagctgctcgggctcgagttccgtgggatcgacagccggctggtccagcccgagatcgtcgatcacctgctcgggatcggtcccaggcgggagcgcaccgagatcgatcagcgcctgcacctgcgtcgtgagatcgttcatcgagcccgccatcaacagccgcaagaaagcgaggcgcttcggctcgctcaggcggccggtgatcccgaagtcgagcagcgccaccgtgccgtctggctgcacgaacaagttgccaccgtgcaggtcgccatggaacacgccgtggagcatcgcgccctcgaggaagctgacgagcgccgcacgcaccacctcggtcgtgtcgatccccgcgtcgtgcatcccgcgggcgtcgtcccaccggtagccgtcgaggcgctccatcacgagcacccgccgcgtcacgaactccgggtggggcctcgggacgacgatggcgcgctgctcggtcgcggcgagcacggcagcgatgtcgagcatgttggcggcctcgatgcgaaagtcgagctcctcgacgatcgtctcggcaaacagctcgacgagtgccggcgggttggccagtgccgccaccgggatcctgccgacgaggtgcggcgtgatccacgccatcgcggcgaggtcccggcgcaccagctcggcgacgcgcgatcgctggaccttgaccgccaccggcgtgccatcgcggagggtcgcgtagtagacctgggcaatcgacgccgcagccaccggagatggatcgaaggatgcgaacagctcttcgagcggcgcatcgagctcctcctcgatggtcgagcggacgacggcgaagggctcggccggcacgcgatcgcgcagctgcttgaactcctcgaccagctccaccgggaagatcccctcccccgatgagatgatctggccgagcttgatgtaggtggggccgagcgtctcgaaggctcgtcggagccgcctcgagaggccccggcgcgacgcggcacgaccccgagggcgatcgaacaaccgccatgccccgagggcgacgccaagggacaggcccgtcccaaggacacggcgcgccggcggcacccgccgcggcgccgtcaacctggggatctgcgcctgtgccctcgcccgcagcgcgggcacaccctcggcccacaggagccgacctgcctccacgcgccatggaccatgttcggtgaaggaccactgctgttcgtcagaggccacgatggcgagcctaccgggccctctcgcgcaccgaccggttctaggggcggcgctcctcatggcctccgaactcccggcgcagcgccgagagcacccgattggcgaacgcgtcctcgccccgagaggcgtagcgcgcaaagagcgcggatgcgatcaccggcgcgggcaccgtctcgtcgatggcggcgagcacggtccagcgaccctcgcccgaatcggcgacacgaccctcgagctgttcaaggtgggggtcgtccgccaaggcccgcgcggcgagatcgagaagccaggatccgaccacgctccctcgacgccagagctctgcgatcttggccacgtcgagttcgtagcggtaggcgtcgggctcacgcatgggggccgtctcggcgtccgcggcgagcgcgaccgaacccgcgttggcatgctcgaggatggagaagccctcggcgaacgccgccatgaggccgtactcgatgccgttgtgcaccatcttgacgaagtgtccagcaccgtgcgggccgcagaggagatagccctgctcctcaggacccaccgcgacgtcggctcgcgtgcgcggcgccgcgtccacaccgggcgcgagggccgcgaacgccggctccaggcgtgcgaacacgtcggggtcaccaccgatcatcaagcagtagccacgctcgcggccccatacaccccctgacgtgccgacgtcgagatgatggatgccccgagcagccagggtcgctgcatgggtcacgtcgtcgcgatagaacccgttgcccccgtcgacgacgacgtcgtccggggcgaggagggagccgagctcgtcgacgagctggctcgtcagcgcggcgggcaccatgagccacaccacgcgcggtgcctcgagtgcatgcacgagttcgtcgagggagccatgcacgctgaccccgagggcgctcgcggaggcgcgtgcggcctcggcggggtcgaatccgtgcacctcgatgcccccgcgctcacggagccgagccgccatgttggcacccattcgacccaagcccaccatgccgatctgcatctcacggcctcctctcgcctcgcctacgctactggttgacgtcctcgatgctccatcgcacgatcccccgcttcgtgcaacgcacgcacgaactcgccgagctccgccggtggtgccccctcgagcaccctgcgcacgatcgccgaacccaccaccgcgccgtcggcaccggcctcgacgaccgcagccgcgtgctccgggctcgagaccccgatcccgacgagcaccgccaactcagcacgcccggcgagccgcccggcgatctcggtcgccgtctcggcgagctggtcgcgctcaccggtgacgcccatcaacccgaccgcgtagacgaagccctccgcagcgcgcacgatgcgctccatgcgcgccgggggcgtcgatggcgcgacgagctgcacggtctcgagaccgacctcgcgcgccgcccgccaccacggctccgcctcctcgatcgacagatccgggatgatgacgcccgcaacgccggcctcggccaggcgtccagcggcacgttcgagcccctggtgatagagcaggttgtagtaggtcatgaccacgagcggcacgccaacgaccaggttccggagcgcagcgatcgtaccggcgaccgtcgtgcctcgctggagcgcgacctcgctggctcgctggatggtcggcccgtccatggaggggtcggagaacggtatgccgatctcgatcgcgtccgcaccaccctctgcgagcgcgacgacgtcgtcttcccagccgtcgcgcgcgccagcgcacacgtacgggacgatcacggaccgtccacgctcgaccctggagcgaaggtgggcaccgaggccgctcaccgccgacccccgaggtacgcagcgaccgtctccgcgtccttgtcgccccgtcctgacagagtcaccacgatgcggtcaccgggctgtgtgcgcgccgatccctcacgcagcacccacgcgagagcgtgggccgattcgagggccggaacgatgccctccgtccgcgacaacgccaccagcgcatcgacgacctcgtcgtcgccgaccggttcgtaactcacgcggcccgtgctcgcccagtaggcgtgttccggaccgaccccggggtagtcgagaccggccgagatggactcggcctcgcgcacctgaccgtcctcgtcctggaggagcatggagtgcatgccgtgcaccacccctggccccccgcgtccgatggcggcaccaccggccggctcgaccccgacgagccgtgccgacgtctcgacgaagcccgtgaaggtcccggccgcgttggaaccaccgccgacgcaggcgacgacgagctcggggacgccaccggcctgggcagcgaactgctcgcgcgcctcgtcgccgatgacacgctggaactcgcgcaccatccaagggtacggatgcggacccatgaccgaaccgatgcagtagtgcgtgtccccgagttcggcaacccaggcgcgcatcgcctcgttcaccgcgtccttgagcgtgcgacttcccgccgtgacctccacgacctccgcaccgagcagtcgcatccgaaagacgttgagcgcctggcgctcggcgtcgaccgctcccatgtacaccctcgcctcgagcccgaggaacgccgctgccgtcgccgtcgcgacaccgtgctggccggctcccgtctcggcgatgagtcgccgcttgcccaaccgccgcgccagcagcgcctgaccgagcacgttgttgatcttgtgcgagccggtgtgggcgaggtcctcccgcttcagccagacctcgcgcccgacgagctccgagaagcgctctgcccgatagagcagggtgggccggccggcatacgtcgccaacagacgcgcgtattcgtcccggaatgcgacgtcggcccacgcagctcgaaatccgctctcgagctcgagcaccgccggcatcaacgactccgggacgaagcggcctccgaagtcgccgaagcgaccagtcgcgtccggcgcgttcgtccccttaggctcgatcatggtcatcggtctctccttccaatgctgcagcggcccctcgcgcagcctcgatgaactgtcgcaggcggatcgggtccttgtggccaggtcgagcctcgacaccgctcgagacgtcgacgccgaacggcatcaccgtctcgatggcctgcctgacgttgtcgggtcgcagcccgccggcgaggatgagtcgccgcatcggcgagatcccgtcgacgagcgaccagtcgaacaccgtgcccgagccggggctcgcggcgtcgacgagcagcgcccacgccggttgctcgatcgcgcgatcgaactccggcgatccggccgcaacggcgcggatcacccacggcgtgcgctctgcgagccaggcgagcccgtcgttcgagatctgaccgtggacctggacgccaccgagtccggtctcggcgaggacctgcgccatgcgctcgggcagttcgtcgcgaaacacgccgaaggtccgtacgccagaaggcaactgcgggaggatctgggcgatccgcacgggcgacacctgcctcgggctcggcgcgagcacgaagccgagcgcgtcggcaccgagggcaacggccagcagggcgtcagactgattcgtgatgccgcagatcttgatgaacactcgcacctcgctcgacgagcgcccggacggtcgcgtaggggtcccgagcacgcatgcaggcctcaccgatcaggacaccgtcgaagcccacgagccccgcgagatcatcgggaccacgcacgcccgactcagcgagcctggccgcgcccggcgggagcgccgcgagcacgcgacgcgcccgatcggtgtccacgcgaaaactcgtcaggtcgcgttgattgacgccgacgacgtccgcggcggcaagctcagcaagctcgagctcgctgagctcgtggatctcgaggagcacctcgagcccgacgtcgtgggcgacaccagcgagagatgcgacctcctccggctggagcgccgccgcgatcagcaagaccgcgctcgctcccgcgcgacgggcccggagaagctccctcgcgtcgacgatgaagtccttgcgcacgatgggaagctcgacgtgctgcgcagctcgctcgaggtcagcgagggtgcccccgaagtgcggtgtgtccgtgagcacgctgaccgcgaccgccccagctcgctcgtaggccgagactcgcgtcgcaacgtcggtctctggctcgacgaaccagcccttcgacgggctgcggcgcttgaactcagcgacgacaccgaggccagccgatgccaggagcgccgagcgaaggctcgggcggggctcgatggcgtcgagtccggcgagcagactcgtgaacgactcgtcgtccaaggcggcacgccgacgatggtaggcgacgatgtcggtcaggtagtcggccatgggcccagcctaggtgccctgcggcccggctcgaggcaggccgcctcgcagctcagggcaccgtgtgataccggtccgttttgcttgcacaatgcaacagaaggtctcgacttcgctagaatgtggccagagcgcaccgcagtacgcgccagctacggaggtcgatcagcgtgacgaagtccaggggatccatcagggaacggagcttccgcctcaccgaacacccgcactacaagtggatcgccctctccaacacgacgctcggcatcttgatggccacgatcaactcgtccatcgtgctcatctccctcccggagatcttcaacgggatccatctcaacccgctcgcaccgtcgaacacgtcgtacttcctgtgggtcctcatgggctatctcctcgtcacggcggtgctggtcgtgagcttcggacgcctcggagacatgtacggccgcgcacggatgtacaacctcggctttgcgatcttcaccctgttctcgatcgcgctctcagcgacctatctccacgggaccgccggtgcgtggtggctcatcgtcatgcgcatcggccagggcatcggtggtgccctcctctttgcgaactcggctgccatcttgaccgacgccttccctccgaaccaacgtggcctcgccctcgggatcaacaacgtcgccggtatcgcgggctcgttcatcggcctcatcctcggtgggctcctcgccccggtctcctggcgtgccgtcttcctcgtctcggtcccggtcggcctcatcgggaccgtgtgggcctacctcatgctgcacgacctcggtcagcgggtgcgagcccacatcgactggctgggtaacgccgtgttcgcggtcggcctcatctcgatcctcgtcgggatcacctatggcctcgaaccctacggcggaagcgacatgggctggggcaacccgggcgtcatcgcggccatcctcggcggtcttgcaaccctcggcgtcttcgtctggatcgaacagcacgttccccaacccatgatcaacgtgcggctgttcaagatccgggcctacctcgccggcaacctggcgagcctgctcgcctcgctcggccgtggtgggatgatgttcatcctcatcatctggctccaggggatctggctccccgagcatggctactcctactcgcagacaccgctctgggccggcatctacctcgttcccctcaccatcggcttcctggtcgcaggaccggtctctggattcctgtcggatcacttcggcgcccgtccgttcgcgaccggcggcatgatcgtcgccgcgatctccttcatcgccctgctcaccttgcccgtcaacttctcgtatctcaccttcgccggtctcttgctgctcaacggactcgcaatgggcctgttcgcctcacccaaccgcgccggaatcatgaacagcctgccggtcaacgagcgcggcgtcggggcggggatggcagcgacgttccagaacgcggcgatggtgctgtccatcgggatcttcttcaccctcatgatcttcgggctcaaggcgagcctgcctcgccatctctacgacgggctcacccaacagcacgtgcccgcctccatcgcccacgcactcgccaccctgccacctgtcggcgtcctcttcgccgccttcttgggctacaacccgatggccaagctcctcgggcccaaggtcatcagtgccctcccgcactcgaacgcggcgtatctgaccggccggtccttcttcccgaacctcatcgcctcgccattcggtcacggcttgacggaggccttcaccttcgcagccatcgcgtgtgtggtggcggcggtcgcctcgtggctgcgcggtggcaagtacaccgcggccgacgtcgagccatcggactcggccgatccctccgtcgccgacgccgtctccgagccggtcgctgggggcgacgcctgagcgaagcgcctgctcgcctgcccctgctaggttgaccgccgtgggacgccatgtcctcgtcgtcgaagacgatccggcgatcgccgatctcctctgcgtgtactttgccaaggaggagggcgaggtccgtgtcgtctccaacggcgaggacgcgctcagcgcgttcgatgcctcggtgaccctggtgatcctcgacctcaacttgccggggcgcctcgatggcctcgaggtcgcgcgggcgattcgccaccgctcgaccgtcccgatcatcgtgctctctgcgcgcgacaacgaactcgatcgagtcaccggactcgaactcggtgcggacgactacgtcacaaaacccttctcaccgcgcgagctcctcgcgcgggtccgggcgatcgagcgtcgtgtcgaggcgaatccctcgtccgcagcggcgctctcgttcaacggcgtcgactgggacccacgggcgcgtcaggtcctccgtgacggggtgccggttgcgctcacgaaccgggagttcgacctcctcgggtacttctttgcccacccggcgacggcactcacccgccgtgagctgctcgacggggtgtgggggccggagtggtacggggacgaccgaaccgtcgacgtccacgtcctgcagctgcgcaagaagctcggcggcgccatcgccatctcgaccgtctggggtgtcggctaccggttcgaccccgaggagcactagcgtgcgacgacgccgtcgcccgacgatccgaacgacgctccgcgccgggctcgcgaccaccgccgtgacgaccgccctggcagccggcgtcggcacgctgctcatcttccgctccatcgctctgcacgagaacgagagcttcctcgcgcgccaagcgagcgtggcggccaacgtcgcaagccgcgccgagcacttcttcctcggtccccacggcgcccataccttcggcgcgcgcaggttggtgcgcctcgatccgtccggccatctcggcggccccgtcccggccgagctgcacggcgtcgtcctccatccgccacagctcgttcccggtcacgtctccttcgtggtgcgaggtgacaccgtctgggccctcgaccccgtcatcctcgtcgaccgccacgcccaacgcacctacgcggtcgtcctccatcgctcgctcccgtccgagctggtcccagccctcttcgtcgtggcgctgaccttgctggcggcgctcgtggccatcttgctcgccgacgcctacacccgccgcgtctcgtcggtggtggcggacctcgcggcgctcgccgaacgagtcagccgtggcgaccttgcccaggcaccgccgtccgagccgatcgcccagcgagaactcgacgatctgcgacaggcccttgcggagatgatcgcctcgctgcgcagtgcgagcgagcgtcagacatccttcctcctcgccatctcccacgacctgcgcacgccgctcacgagcatccggggcttcgccgaggccatcgaggacggcgaggtggttcagccggcccatgccgcaagcgtcatccaacgcgaggcgcagcgcatcgagcgcctcctggccgacctgatgagcctcgcacgcctcgaggccgatggcttccgcgtcaccgtgacccccctcgatctcggcgatctcgtcgagcaccttgccgagaccgctcgtctgcgcggccgcacccaagggctcgaggtgcacgcgtcgctcgcaccggatgcgcgctccgtgctcggcgacccggagcggctctcgcaggcgctcgccaacatcctcgacaacgccgtcaagttcgcgcgcagctcgatcgacgtgatcgtcacccggcgcttggagagcgtccgcatcgagatcaccgacgacggacccggcatcccgccgtccgtgcgcgaccagctcttcagccgccaggtcgcgccacgcccaggtcgcaacaacgagatcggctctgggctcggcctcttgatcgccgcacgcctcgtccaggccatgcatggtcgcctcggcgcgagctccccgatccgatccgacggcggaacacgcatcgtgctcgaactaccggccgccgtccacgaccgcgtaccctcgcaggtcggctgagccagaggccgacgcttcactcgcaatcgcggccaccagtgcatcggtgagcgttgtaggcgagcctgcgtcgccgcgaccgtggacgaccagatggagcgcggcaagtgcgcccgtgagcgctggcgtgatcggacaggcctcgactgcgcactcgtggccgcctcgatggcgccagtgccacgcgagcgcgcccggcagcgtcgtgtaggccgccccgacggcctcggcggcgacgccaggatcgacccaggcagcatcggcgcgtgccagttccgggcgaccgaggaagtagccctgtccgagctcgatgccgagcgcgcgcgccacctcgaactgggcacgtgtctcgatgccctcgagcacgaccgagcacccctggccctcgccaaggcgcgccacggcatcgagggtcacgatggcctgcaggggattctcaccgagggcagcgaccacgtcgctcgcgaccttcacgagatccaccgacaagctcgcgagccggacgatcccctgaccgctgctcccgacgtcgtcgagtgcccgacgcacgccaagcgctcccagcgcaacgagcgtggcctcgagcgatgagggtgctccggtcgagtcctccaggacctcgatcgtgagccgccacggcgcgaccgcgtagcgctcgaggacccggcggatggtgtcgaccgaactcgggttggcgagcaccgcggtcggtgcgttgaccccgatcgcgaggtcggggcgcaggcagttcgccgccaggccgactgcgtcatcgaggacccgctcgaagagctcgccgagctcggcagcggagagaaagggcaggaactccgccggcgaccagagtcgacctcggccatcgtcgagccgtgcgagcgcttcgagcccgatgacactcgcgtcgccgaggcgaacaatcggctggagtgcgagccgtacgcctccaccacgcagacgcgtgaggatctcacgccggccaagcgtcgagtgatacccacgacggagcaacgcgatacggtcgcagatcgcctcgacgagccgaccgagcaagggttctgtcgcatcgggtgcgacctcgaccgcgaccacgagcccccagacgctcgagtcctcgcgtcggcacacgatcgccccgtcgccgacgacctgctcgtccacgccgatgacgcgccgcgccagcggtcccgacggctcctccagcgcggcgacgagcgcggctcgctcgcgcccagcgcttcctcgaacgcgcaaccgacccgccccggtgacctcgacgagcgccgcgccatggactccggcgagcccgcccgcgacgtcgacctcctcgaggaccgacccgagcggtcgaccgtcgaggccgtcgagcgcctcggaccagcgggccctcagcacccgacggcgagcaccggcgacgttgagaccggtctcgagtcgcgccatggcgatgcgggtcgacggcggtacgtcagcgagctcggccacggcgccgccaccccatctcgccaccgccctcgctgccgccgccggaccgtcgacgagcgcgtcgagcacctcgtcggggagcgcgcctccgagcgcgacccgccacgaagggtcctccgcgagctccgccgtggcttcggggccccacggatccacgatggcactgcgggcgtcgctcgctcctgcacctcggacactccgggcgcgcttcgcctcgtacatcgtggcatcggccacgcggagcagccccgcgagatcgccggcgtcccgcggccaccaggaccatccgacgctcgccccgatcgtcaccgcaaggccggcctcgagctccacgggtcgccggagggcacggccgatgcgctgtgcgagatcgcgtgccgccgcctcgtccatcgcaagcgctgcgaggatgacgaactcgtcgccaccgaagcgtgccaccagtgccgacggcagccggcgcgcgacctcaccggccacacgcctcgccgcctcgatgaggacctgatcgccgacgacgtgaccaaaggagtcgttcacctccttgaagtcatccaggtcgatgagcatgcacacgaccgcacccacactcgcatcgctcgtcaggcgaacgagccgctcggtgagcgccatccggttcgcgaggccggtgagtggatcccgcctggcgatcgacctcgcctcggcttcggcacggcgcagtcgatccacgagtgcgaactctgcgacctcgcggtcgatggcgccacggatgcgaggctcgaacggcgcgagccaagcgcgacggcgtggatcgtcggcgacgacctcgagaccgtcgccgtcccttccctgcagcacccgcacgcccggcacgcggccgaggatgcccgccgccgcttccaggaaggctccgacgctctgggcaccctcggcggcaccagcgagctccgcgagcgcgcgctcgagcgcctcccgccaggcgagttcggcctggtagcgctcggagtctcgcacgaagcgctgcgtgacgagcgccgacgcacccaccagcacgacgatggcagccacgagtgcgctcatgggtccgctcgcggcgtcgaggacgctcgttcgggcagtgaactccacctcgaccggcccgagcgcactcgcaacctgtacgtgcatcgtggccgcagtggcacgatcgaacacgcgcacgcccccgatcgcaaggctcaccgccctgacgccggtctgtgccggggctgcgacctgcaacgttcccggcgcgacaagggcctcgacgaggtagtcgacctgcgcacttcggcgtgcatggatcgcaacggcgatctcgaacccgttggacacacgaaccaacctcgtccccgacgcgccgacggcgacaggatcgaccgcacgcccggcccgccaccagatggatcctccgtgcggggccacgaccgcgatcccctcgatggctgattgacgggcgacgaaggcctcgagcaccggcaccatggtcgccggcaacgacgcgagcgtcggacgaggcccgatgagcaccgtcccgacggtgtcgagatcggcgacgacgaggtcggctcgcaccgcgacgcgccgagcccacgcccgtgcaacggcgttcgcaagcgctcgctccgacgacacactggacgcgtccacacgccgcaaccacgaggccccgacggtgagcgcgaggaggagcggcatccagatggcggcgaggacgacgagacgccaccgtccccgcagccgccatgtcataccgagagtgatcgaccaaccaggtcgcagagttgaggcgcctagcctgggagcatggacgccacgacggtcgccacagcctcggggccgagcgacgcctcggggcccagcgacgcgttcaccgcacccttcgttcgggtccaggtcaccggtcgggatgcggctcgctacctccagggtcagctgtcccaggacgtctcgaccctgaaggcggacggccagggggcgatcagcgtgctcctcggcgtcgatggccacctcgtgacctggctcagggtacgtcgcctcgccgacgatgccttctggctcgtcgtcgccgaggcgcatggcgaacgcgtccgccaacgcctcgagcacttccgcatccgcacccaggccaccatcgagctcctccctggccacctccacgttcggcctccagagggcctcgagcctctctggcccctcgaccaggacgcaccgttcgtcgacgcgcccgccgacctcgcccgcttccacgccgaacgcctcgtggccggcgccttcgatcctgcgagcgatctcgtcgacggtctgctcgcccacggagtacccacactcgtcgagcgtgcagtgagcttcaccaagggctgctacaccggtcaagagctcgtcgcacgcacgtcctcgcgaggagcgccggccccgatcggcctcgtcgcactcgagctggccgagccgatcgccgtcgctcccggtacggcgctcgtcgtcggcggtgtcgacgccggagcgatcacgagtgccgcggtggtcggcgaccgtggctacgccgtcgcctaccggcgccggcgcgcgcgcgagcacacgcacttcgacgtcggcggcgtcggtgcgacggtgcgatcgtccgcaccctagcgaggctcacacgaaccgctcagagccgcagacctctgcccgtgacgctgcctcgcacagtggcgagggtcgatcgcgcgctcaccgctgaccacagctcgccccaggggacctcgtgtgacgacggcgttcagacctcgatgaggcgatcggcgacggcgactgcccgggccaccgccgctgccttcgccacgcactcggtcgcctcccgttccgggtccgagcctgcgacgatgccggccccagcctgcaggagcacccgaccgttctcgagccagacggcggtacgaatcgcgatcgcgaagtccatcaccgcgctctcggggtcggtgccatcgcgaccgacgtagccgacgacgccgccgtagaccacgcgtcgcttggactcgagctcgtcgatcagctgcatcgcgcgcaccttcggggcacctgacagcgtgcccgccgggagggtcgccgcgagcgcgtcgatcgggccgacgccgtcggtcagctgaccatggacgctcgaggtgagatggatcacgcgcgcgaagcgctcgggcaccatgaactcatcgaccacgacgctcccgaagcgtgccacacggccgacgtcattgcgggcgagatcgaccagcatcaggtgttcggccctttccttcgggtcggcgagcagctcctcgatgagagcctcgtcgctcgccccacccgaaccccgcggccgggaaccggcgatcggtcgcgtccagacgacgccgtcgcgcaccgtcgcgagggcctcgggcgaggagccaacgatcgcacccccggcgtccgtgatgagatacatgtacggcgacgggttggtgaggcgcagcgctcgatagagcgcgagagggttcgcccgggtcgtgagctcgaagcgatgcgacagcaccacctggaacacctcgccctcgtcgatcgcctgcttcgcgagccggacggcgtgcgcgaacggctcccgaaacccttgatcgagcagcgccaccccctcgctgggatcgtcaccaagtggccaggcacgcaccggtcgcccgacggccgactcgaggtcggcctcgagacgactgagcgccgccctcgccgctgccgcggccccgacgggatcgtcctccacgagcagcgccgacgagagcgtgagcgactgcgcccagtgatcgatcacggcgaggtcacccgcgaggaggagccgcgcctccggcaggccgacgtcgtccgggtgcgaactcggcacgctcggctcgcgctctcggaccgcctcgtagccgacgtggccgacgaacgctgccgagaacggtccggccatcgggcacccgtcgtcgacggcgtcgacctcgagcccctccgaccaccgacgcagcccatcgagaatgcccggtgcctcgtcgaggaccgagccgtcggcagcctcgagtcgggcgtggccgacctcgccgatgacgcgcgccaagggccgacgcccgacgaccgagtaacgcgaccagcgaccctgctggtcgaccgactcgaggatgaagcccgcctcgccgggcgccaccaaccgctcgaacacctcgatgggtgtgagtgcgtcggcgacgtagcgggcccggacctgaacgagacgcagcctcacgactgccccagcaccggatgcatgaagcaactccacgcgcccgtgtggcacgcaccgaccccacgctgacgcacgcgcacgaggagcgcgtcaccgtcgcagtcggtggtgacggagcgaacctcttgcacggcgcccgaggtctccccctttgcccagtaggtccgccgtgatcgcgagtagaaccacgtccgtccgtcacgaagggttcgtcggagcgcctccgcgtccatgtaggcgagcatcaggacctggtcgtcctcgtcgacgacgaccgccgggacgagtccatcgggaccgaaggcgacgacgtccacggagaccgcctcgcctggggcaaccccctcgatatcgctcacaggtacaaccccgtctcgtcgtcgagccgatcggaggccaccgcgtggagatcccgctcgcgcaagatcacgtaggtctccgagccgatctccacctcgtaacgatcctcgggcgcgaacagcacgagatcacccggacgcaccgagcgcaccgccggaccgaccgcgctcacctctgaccacacgagacgtttggcgatctgcgcggtcgcggggatcacgatgcccgagcgcgcgtggcgctccccctccgacggagggacgctgaccaggacacggtcggccaacatcgtgatcgcagccttcttgggctccaccgccacctcccgttgcaccacgctagccgccgatggggcgcacgacgagacccgccgcgtcgagcgcggccttgacctgagcgacgctgagttcgccgtagtggaacacgctggcggccagcaggcccgtgacgccggtccgcgcgccgtcgacgaagtgttcgacgatcccgacgccacccgacgcgatgacgggcaagctcgtgcacgacagcaccagctcgtagaggtcggtgtcgtagcccgcacgcgtgccgtcgcgatccatggaggtcacgaggagctcgccggcgccggcatccgaaacccgccggacccacgtctcgacgtcgagaccggtggggcgacgcccgccgtgggtacgcacttcccagtcgcccgcgcccgtacgagcagcgtcgatggccaccacggcacattgggacccgtagcgaccggcgaccgcctcgacgaggccgagatcggcgaccgccgccgaattcatcgacaccttatcggctccagcctcgagcaacgcggccacgtcgccgagcacacggacaccgccgcccacggtgaaagggatgaagactcgtgacgcgacacgctcgacgagatcaacgagcgtcgagcgctcctcgatcgaggcggtgatgtcaaggaacaccagctcgtcggcgccctcggcgacgtagcgctcggcgagctcgacaggatctcccgcgtcacgcagctcgacgaaactgacgcccttgacgaccctaccctcggcgacgtcgagacaggggatcaccctcacgctctgcatgcgctgagtgcctcgtcgaacccgagcgagccatcgaggagcgcagtcccgacgacggccccccacacggcccctcgtgcccctcggatcgccgcgagctttgccaggtcgtcagcggaggcgaccccgcctgaggcgatcacctcgaccggcacgacctcgcacagcccctgataggtaccgagatccggtccgctcgccatgccgtcgcgtccgacgtcggtcaggagctgggtccgtacgccgcgtgcgaacagtcgagcggacgcctcgaggagccgccgaccaccagagcgttcccatgcgctcacgacgacctcgagcgccccttcgtcgccacgccgatagtcgagcgccgcgaccagatgctccggatcgagctcgtcgagcgtctcctcgacgagtgccgtcccgagcaccacgcgcgacgcgcccgtctccagcagttcggcgatgtccctggccgtacgcacgccgccaccgacctcgaccgacccgccggcctcgcgcacgagcgcgatcaggtcgccgaccatgtcggcgttacgacggtcgccgggcgtgcgggcacgatcgaggtccaccacgtggaaccaccgcgcgcctgcgtcgagggcgccctcgacgtagcggcgaggatcgccgaaacgccgcggcgcatcgaaccggccctgccgcagccggacagcctctccgtcgagcagatcgacggcgaccacgagttccacgcctaacactcctcctggacccatcgccacagcgcatcgaggaagcgcagacccttcgcccccgagcgctcggggtggaactgcacaccgagcagcgcatcgcgaccggcggcggcgacccaggtgccaccgaactcctcgaaggcaagcgccgcaggcgtcgtcgcgacggcgtaactgtggacgaagtacacccacgcaccctcgaggaccgccagtggccccgaggccccctccgccactcgcaaccggttccactgcatctccggcagacggggcgcagggctcatgcgctcgacccagccgggcaagagaccaagtcccacacgatcgggcgcctcgtcgccgccgtcgaagagcgcctgcatgcccacgcagacgcccaaggtcgccatgccgcgctcgcgacggcgcaccatcgcctcgtcgagaccggtcgccgcgagagcgtcgagcacgctgccgaggtgaccgacgccgggcacgacgagcagccgcgcctcgtcgaaatcggctcggtcgctcccccgcctgaccggatggccgagtgcccgccacgcccccacggcagccccgatgttgccgataccgatgtcggcaacaacgatggcagcgctcacaaggagcccttggtggagggaatctcgccgcccccgctgacggccgtcgcctgggcgagtgcccggccgagcgccttggccatcgcctcgatctggtggtgggtgttcgcgccccgaatcgaccggacgtgcagcgtcaagcggccgcctcgagccagaccccacaggaactcctcgacgtgctcgagcgcgacccccgggctgcccaggaggagcccacgctcgccctcgagggcgacccatgcgccgggcctcccggacaggtcgacgacgacctcgacgagcgtctcgtcgagcgggatggtggcagccccgaagcgctcgatgccgcgtcgctcaccgagtgccccatcgagcgcctgaccgagcgcgatgccgaggtcctcggtgaggtggtgggcgtccacctcgacgtcgccgcgtgctgcgacctcgaggccaatcctcccgtggcgcgcgatctgggtcaggacgtggtcgaagaagggcagccccgtcgacacgtcctcgcgtgggcccccgtcgagctcgagccgtacccggatgagcgtctcgcgagtctcgcgatcgatgatccccacacgcccactcacgcgagcacctccccgagtgcagcgaggaacgcatcgttctcgtccgcggtgccgatcgtgacccgaagcgtgttggagagcccgggccagcgcgacgcatcgcggatgaggatccctttcgccacgagtccctcccatacctcggtcgcaggccgacccggatcgaacaagatgaagttggtcgcactcggccacacgcgcgcagcgagcgtgccgagggcctggccgactcgctcgcgttctcgaacgacgagggctgcgcgtcgtgcgatctcgtccacatcggccagcgcagcgacggcgaccgcctgcgtcaccgcgttcacgtgatacggcaggcacgccgaccagagcacgtcggcgacctcgggcgcacagacggcataacccagccggagtcccgcaagcccggcggccttcgagagcgtacggatccgcaccacgtgatccccaagcagggtcgcagggccgagatcggcgaagtcggcgtaggcctcgtccacgagcaccagccgatcgtcgcaggccaggacgcggtccatcacctcgggcggctcgagcatccccgtcgggttgttcggctggcacacgatcacgagctccgagtcggcctccagactcgacggatcaatcgacccgtcggatcggcgcgcaccggcgaccaccgtggtgcgcgtcacacgggcgatctggcggtacatgccataggtcggctccgcgagccacaggcgtcgaccgggcccaccccaggccgcgagcacggtctcgagcacctcgttcgacccgttcgcgacgaagatcgaggtcggcgcgacaccgtggagcctgccgagcgcagcgcgcagcgcctcggcgcgccgatcgggatagcgcgccagatcgagcgcgaccgcctcctcgagcgccctcgcgacggcgggcggcggaccatacggcgactcgttggtgttgaggcgaaccctggcgggaacctgggccgagtggtagctcgcccccagcgcatcctcgagcgacggagccggcctcaccatccggcctcccgacggatgcggatcgagtccgcgtgcgcgacgagcccctctgcgtcggcgagcgcctcgacggcccagcccagccgactgagcgcctcgtcgtggacctcgacgacgtggaggcgacgctggaagtcttcgaggccgagcacgctcgcaaaacgcgccgtcccagccgtcggcaggacgtgtgaggggccggccacgtagtccccgaacgcggcactggctgctcgtccgacgaagaccacaccggcgtggcggacccgatcagcgtcccgaaccgcctggtcgtagagcagctcgaggtgctcaggcgcgatcgcgtcggccaccaggcgagcttgatcccggtcgcgcacgagcgcgagatagccgtgcgcctcgagcgtgctctcgagctgggcgcgcctgggactcgcctccacgtaggccgcgagctcttcgagcacctgctcggcccagcgggcgtcccaggtcacgagccaggccaggccatgggggccgtgctcggcctggaccgcgacgtcgatcgccgcgacgcgcggctcaagggagccgtccgcgaccacgaccacctccgaggggccggcgaaggcacccggcacaccgacgtcggccgcgacctcttgcttggccagcgagacgaagaggttgcccggacccacgatgacgtcgacacgctcgagcgactccgtgccataggcgagcgccgcgaccgcctgcgcgccaccggcgagcagcacggtgtcgaccccggccagatgacaggcggcgagcgtcgcgtcgtcgaggccaccgtcgggcaacggcggtgtggcgacgacgacatcgcgtacgcccgcaacccgagccaccgtcgcggtgtgcacgacgcttgagggatagcgagcctgtcccccgggcacgtagcagccggctcgctccaccgggacgatcctgcggcgcacctcgatgccgtcggccaccagcgacgacgccgccgggcgctcggcctcgtaggcctcgcgcacgcgatcgcgagcgacccgcaacgcctcggccagccgccgatcgaggcgctcgtaggcggcggccatcgcctcgcgaccgaggacgagcgctcgcggccgcacgccgtcgaagcgctccgtcagatccgccagggccccgtccccacccgtgcgcacactctggacgatctcacgcacgagtgcccgtggcccttccaccggcaacgccaccccgggaagatcgtcgcgccgcagggcgccagtcgtctcgcgaagatcgacaagggtcagcgatgccatgggactcctcggacagcagggcagctcagcggcgctagtctaccggcggcgaccgcgacgaggaacgtggcgaccgtaacggaggaacgctgtggccgaggctcacgagctcgcctcgatcgcgagcacctacgaggagctcgctcgacgcatcgaggccatcgagcgctcgctgctcgccgaccatcgagacgggccggcccagtcgctgcgggccgcgtgggcactgaaccgagccctcctgcgcgaactcgatgaggcgcgtcgccgtctcgagagctgatgcgggtcccagccctcgctacgttcgcggcaaccttcgcgtaacgtacccctggtagtcttcgctccatgacccacctcatcgaaacgtggggcgtgctcgcggtcttcgcgctctcggtcgcacagtcgctcggcgtacccacctcctctgagctcaccttcggcctcgtcggcctcctctgggccctcggacggatgaaccccgtggcgggcatcgccgccggtgtcatcggcgaactcatcggagcgatcgtcgcctggtggcttgccgccgctgcggtcgagtctcactggtgggcgcgcttcgaggcgcacccgctcgtggccgcctttcgtggtgtgctcacctccctccttcgccgccgcttcggcgtgctgatctcgcgcctcatccccctcgagcgcaacgtcgcagcctgggcggctggcgtcgccgaggtctcgctcggtgcgctcgccctccagagtgtcgtcggatcggcgatcttcgccaccgcgtttgccctggccggctacgaggccaaggacgcgatcaccaccatcgcgcaccgagccggccagatcggcgaggtcgtcgcggtcattctcgtcgtcggcgtcgtgctcgccatccgtcagatggcccatcgtcaactcgggcgcagccgcgcagctcgctccggccacgcggccacccaacccgacgccaccgcacccgacaccaccgccaccgaggatcgactcgtcctccagctgctgccgtcggagccactctcgtcggccgcctacctcgacgcgctcggccggatccatcagaccgaaccgccatctccggacgtctccgccgacgagggccgccgcgccccacggcgcgatctcccgacctcaggtagccgctagcgagcgcctccccgccccagacccacgccggacggctctcggtgccgaccggcacccacacgccaacggaccgacttgcgccacgtgcgggcgcgtcatcggcgctgcaggcacccgaggagtcgagcacgcccatcggtgagcgccatgtcccaggaccgtgcgtagcgacccgtggcaccgcggacctcccgttccgcacggcccctcgctgcagcagcgcccctagacgccctcggccggcgcgaagaacccgtcgcccaccgcctggagcttgatcaggttcgtcgttccacgcacaccgaacgggatgcccgccacgatgacgacgagttcgccgacctcggcgagacctcgctcgacagccgccgcgagcgcctcgtgcaccatcagctcggtcgacggcgtcctcgccacgacgtgcgggatgacaccccagctcagtgtcagcgaccgcgcagcgcgcggatcgggggtcgcgccgaggatcgccaccgctggacggaagcgcgccagcacccgagcactgtgtcccgactcggtgagggccaccaccgcacgcaccgggacggatcgagtcatccgcgtggcggcctctccgatcgcatcggcgacggagtgggccacaggcgagggcctcgtgagcagcgtgagcgcctggttgtccacctcgcgctcggtcgcacgcgcgatgcgatccatggtggcgatggcctcgaccggaaaggccccaacggccgtctcggccgacagcatcagtgcgtccgagccatcgagaatcgcgttggcgacgtcggatgcctcggccctcgtcggcgaccccgcctcgatcatcgactcgagcatctgggtcgcagtgatcaccggcttgccggcttcgttggccaggtggatgatctgcttctgcaggagtgggatccgctcgacgggcatctcgactccgagatcgccgcgggcgaccatcacggcgtccgaggcagcgacgatctcgccgatgcgctggatcgcctccttgcgctcgatcttcgcaacgagcatcacgcggctcgccgcgcccgcgcggtcgatctggcgtcgagcaacctcgaggtccgaggccgagcccacgaacgacagcgcgatgaagtcgacgcccgcctccagcccaaaggcgatgtcggcgaagtcgtcttcggtgagtgcgggcagctccagatacgaatccgggaagttcacgcccttgcggaccgacagtggccccccctggacgaccgtggcctccacccagccgtcctccgagcggtcgaccacgaggcggaccgcgccgtcagcgaaggcgatcgtcgcccctgggggcacggtatggaggatgccgagccgactgatgtgaatcgcggcgtggcgggcgctcccctcctcggcgatctggacgacctcgccgggctggagctgtgtcgcgtcgtcggccagcgactcgatccgaagcttcggtccggcgagatcgagcagcacgccgaccgtcttgccggtccgagcagcggcttgacgaacgagctcgatcgagcgggcatggtctgcggtgctgccgtgtgagcagttgatccgcgcgacatccatgccagcctcgatcatcgccgtcaaggtcccgaggttcgatgaagccggaccaatactcgcaacgatcttcgtgcgccggtgctcgcgcatgcgcctcctctctcgtcgaggtcaggctacgtgccggcgctgccgagctcgacgagtccgcgcgcgacgtgctcgagaaagcgccgaatcgtcgcgtcggcgacccgatagaggagcgtctggtcgatgagcagaccggtccgtccgagcggcggtcgatagctcccctcgagccagagctgacagagctcggggccaaccttcgaaaccccgagcaggccgtcgagccgcggaaagagccacggagcttgcgcgccctcccacgtcatcggaagctggagttcgtcgtcaccgaggcgccgtgggctcgcgatccgaaacgccaccggcgtgcgcaagagtccagcccgaagaccgagcaccgcgcgcagaccggcgtcatcggccgtcacctcgctcgcgagatcaccgagccactcggcactctggcgcgacagcagcggggcagcgacctcgaacggcaacggcagctcgacgaagtcgcggacgaagcgcaccgggaccgacccgtcgtgctctcgctcctcggcctccacgctgtcctccacgaactccatgccctccgtgcgtgaaccgcccgaggggctcacccacctctcgtctctaggctacgcgcgccacgcatctaggccaaggagtacgcctcacggtgtgacactggtccctagccggtggggtcggacgaccgtgctgcggccggcggaacggatgccaggaccatcgcagcgagcgcgagaagtccaccgaccaccaccggtaggcccagggatgcatacccgaaggccagcgacgcgagcgcggcgaacagcggttcggccgcatagatcacggagatctgcacgctgtcggcgtgagcgagcgcccaggcttggaccacgaaggcgagtgcgctcgcgagcaccccatcgtagacgatggccgtcaccgcgatcggcgtgaggtgcgtcggcacgagacccgcacccacgagcggtgccgcgaccacggtcgcggccgcgatcgtcgtcatctgcagtgccgctgtcaccatcgcatcaccgggagacccgagctcctcgagcacgacgatctgagccccgaagaagccggcgcacgcgagttcgaggccgatcccgacgaacgacgcatgccctcgtggggccgagagcaccacgagggcgagggccgcgaggacgataccgacgagctgacgagcgctcggacgtcgaccgagcgccatcacgaagatcggcacaaccaccaccgacaagcccgtcagaaaccccgcgatggtcggtgacacgtagcgttgaccctcgatctgagtgaggtagccgccaaagagcgcgaggccgctcgccaggccggcaacgacgctccgtcgatcgatgcgatggccccgtgcgagcgccagcacccacagcacgagcgccgcgacgctgaagcgtccgaaggtgagctcgaccgggccgagactcccgagtgcgcgctcgttcagcggaaaggtgactccccagatcgccgtgacccccacgacggcccacgaggcacggccccttgccggactcctcacatcgtctccggtagcatggcggcccaatggccctcgagcagcacagtcctcgcctcacccgaccactcgtcctcgccgagtcggtcgcctacctcctgatcggcctcgtcctcgtcgtcatgagcgccgagacgctgtggcaactcgcgcgcgccgtgttcgtcgacgtctcgctcaacggcgacgtcaccgcccagctcgtcggcgccctgaacgacgcgctcttcgtcatcattctgctcgagctgctctcgagtgtgatcagccaccttcgcaagggaggtctgcagcttcgccccttcctcgtgatcggcatcgtgtcatccgtacggcgtatcttggtcctcggcgcgcagctctcgatctcccgaacccatggcgcgcagacccgctcgagcctcgaggagcttgccctcgacgcaggggtcgtcttgatcctgaccgcggctctgtggctcagtcgagttcgtccgcagcgccgacgggctcgacgagtacgggcttcctggcagcgcccacctcgtcgagacgcctgaccggcgtcgtccggggcgcctcggcgagctcggccggcgtcgtccgcgcgatctcgacgagccgctcgaacgcctgcgcgagcgcctcgagcgtctccggagactcggtttcggtcggctcgatcatgagcgcctcgtcgacgatgagcggaaagtagacggtcggggcgtggaacccgaactcgagcagacccttggcgatgtcggaggcacgcacgccggcctcgctgcgaaactccttggcgctcgccacgaactcgtgcatgcacggctcgtcgaaagccgcgggcaacacgggctgaaggcgctgctggagccacctggcgttcaagacggcgacttcactcatgcgacggaggccatccgggccgtggtagcgcatgaaggcccaggcacgagcgagcaccagtgcgttgccgtggaacgcgtgcacgttgccgatggacgacggtggcgtccaccactcgagctgccccgttgcgccagggcgaggcagcggaccaggcaggaacgcctcgagggcgctcgtcaccgcgacgggacccgccccaggaccaccgccgccgtgcggggtggcgaaggtcttgtggaggttggagtgcacgatgtcgaaacccatgtctccgggtcgcgcgacaccgacgatcgcgttcagattggcgccgtcgtagtaggcgagcgcgccgacctcgtgcacgagccgcaagatctcggcgacgtcacgctcgaacagccccagcgtgttcgggttggtcaacatgatgccggcgacggagtcgtcgagcacgcgtcgcaggtcgtcgagcgagaccaagcctcgcgcatcggagcgaaccgtcacggcctcgtagccggccaaggtcaccgaggccggattcgtcccgtgcgccgagtcggggatgatgatccgtcgggggtctcgccccgaagcccggtggtaggcgcccatgatcagcagaccagtgagctcaccggcggcacccgccggtggctgcagggtcgccgccgccatgccggtgatctcgcaaatcgcagcctcgagctcggcgagcagttccaaccaaccctggacggcacgctcgggtgtgtcagggtgcaccccggcgagccctgggagggccgcgacctcgtcggcgaacttcgggttgtacttcatcgtgcacgaccccaacggataggcccccaggtcgaccgagtagttgcgagaggccagtctcgtgtagtgggcgacgaggtcacgctccgatacctcagggagcgcggccggctcgcgacggagccacggaccgagctcctcgagcgacgcctccgggatcgcactgtgacgcagcgtgtcggctcggcggccccggaccgacaactcgaacgccgtcggctcggcatcacgtccgacgagcggggcggacgctgcacgaccgcctgggcgcgcacctcgggtcgacacctagcggacctcctttgcgatccgatcgacgaacgcgtcgatctcctctcgagtccgtgcctccgtcgcggtgagcacgagccaggtcggctcctcggggaccaggacaccggccagccaaccatcctcgaggagccgctcgcggaccggccgcgcctccacctcgagatcgacgacgaactcacgaacgaacggccggccgagcaccgagagtcccgcggcctcgagtcggtcagcgaggtagtgcgcggcgttgtagcacgagcgggcgagctcgaccatgccttgcttgccgcgccacgccaggtagacgcccgcccagatcgcgagcagcgtctggttcgtgcacacgttggacgtcgccctctcacgccggatatcctgctcgcgggtgcgcaacgtggtcacgaagccgcgccgaccctcgacgtcgaccgtctgaccgacgaggcggcccggcacgagccgcaccagctcgctccgggtggcaaacagcccgaggtagggcccgccgaacgagagcgggatgccgaggctctgtccctcggcgaccacgacgtcggcgccgaagctgcccggcggctcgagcaaggcgcacgcgacggggtcggcaacgaccaccaggagtgcctccatggcgtcggcgacccgacgcgcctcccgcaggtcctccacccgcccgagcgcgttcggatagccgatgacgagcgccgaagcctcggcgtcgaccgctgcgaggtcggtcgccagatcgtcacggagacccacgctgacgagctcgagtcctcgcccgcggcccaaggtggccagtgcgccccgatagcggggatgaatgccctgcgacacgacgatacggttccgcttggtggccccgaccgcgaggttgacggcctcgaccaccgcagcggcgccatcgtagagcgaggcgttggcgaggtccatgccgaagaggcgcgcaatcgaggtctggaactcgaacagcgcttggagcactccctgagagacctccggctggtacggggtgtaggccgtcacgaaggcactctggagcgcgagcgctcgcacggcactcggcacgtcgtggtcgtaggccccgccgccggcgaacaccacgaggtcgcgtcgagcgccagcgttccggcgcgagcgccgttccgcctcctcgagcacctcgacctcggccagggccgggggtagttccagcggtcgccccaagcggagcgacgcggggatcgatgcgtagagctcctcgagcgacgccaaccccacctcggccagcatgcgctcgatctgcgcctcggtgtgcggtacgaaactccccacgaccacctcctcaatgatcacgaacgcaggtcgacgaacgggacggctgcacgctcgaggtccaacgacccgcgagcacgaaccgcccggaacggccctgccgcggcctccgggtcgacgtaggcgaggccgatgccgacgcccgcgagcggcgagtacccacccgacgaaatcgagccgacggccgtcgaggcggcatcgacgaggacgtcgtgggcgcgtggaggctgtctcgtcagcgagcgaacgccgatcagaatcgggttgacacccgcggcctgctgggcgagcaacgcctcacgaccagggaagggccccttctcaaacgcgacgacccagccgaggcccgcgttcagcggcgtgaggccaggtccgagctcgttgccgtgcagcggcaggccagcctcgagccgcagcgagtcgcgcgcacccaacccgcaggcgacggcccctcgctcgagcagccgttccatcaacgccaccgcatcgtcaggggcgacctcgagctccacgcctgggccacctgtgtagcccgtgcccgcgacccgcacctcgatgtcgccgatgcggcctgtcacgatgcgattgcgcgccggcggctctgctccctcgaggagagggccgagcagggccgcagcaccaggcccctggagcgcgaggatgcatcgcgagcgagtgatgtcacgaccgccgagtgcggcggtcacgttctccgtattggccgcgttcggcatcacgtggaatcgctcgcgatcgacccaccacacgatgatgtcgtcgagcaccgatccatcgacgtcgagcaggtgcgtgtactgcgctcgctgcggaccgatcttgcgcagatcgttcgtcagcgtcgcttgaagccggtcgaacgcgtcgggtccctcgacgacgaccgtaccgagatgggagacgtcgaacactccgacgccggtgcgcaccgcgaggtgttcggcgatcgtcccgctggggtaggaaactggcatctcccaaccaccaaagagcgtgaatcgagccccaaggtcgcggtggaggtcatagagcgcggtgcgttcgggcaccccgccatgctaccgctgagcgcggacgtggcgctcagacgcccggccgagccgagacgatcggcagctcgatccgttcggcgtcttcggtcctcgagagccgcagtcgctcgcccatcgggtcgatctcgagccccacgtgggcatgatcggcgcaccacgcctggagcacctcgagcacgctcgtccccggatcctgcgcgacgatcgttgcgctcatcccgggcgtggcgaccggctcgtaggcgatcaacacggacccacccatgaccaacacgctgagcagcatcgcctcgggcacctcggcgaaggcgagccacgcctggtgcgccatgtactgctgggcccgccgacgtcggatgccctccatgaaccgccgatgccgccgccacccgatgaggaacgccgtgatcccgagcccgagcacgagcgacgggaacaccaccaacgccagcgtcgacccctgaggcacacttctagtgtacgacctcaccacgcgccgagcacgagcggccaggctcgatagcatgagcccatgcctcgctcgctgcggcgcgccgttcccactctgatcacgctcgcacgagcggcgttgttgatcccgttctggcgtctcgccgtcgacgagcaccgcacgggagccgccgccgtcgtcgccgtcaccatcggggcgaccgacttcctcgacggctacagcgctcgtcacctcgacgccgtcaccaccgtcggcaaggtgctcgatcccacgctcgaccgagtcgcactgctggtgagctggctcgtcgcactcgaggagcacctcttgccgacctggttgctgtggttgatcctgcttcgggaggtcgccgtcagcgccgtcacgctcacgtcgctcgtgcgcacgcatcgacgccaagacgtcgtcttcgtcggcaaggcgggtaccttcggcctcctcgctgccttcccgctggcgctgattgcgcgcgccacacgcctcgacatcttggccaagggagccaccctcatcgccaccgtcgccctcgcactcctcaccgttgccctgatgcgctacgccacccagctccgagacgacctcgataggctgtcgcgcgaagcaccacctgcttcgtaacgaggcacccccaccagagcgaacccgggaggcgcaccgtgcaggctgtcatcatcgccggaggcgagggaacccgccttcggcccctcacctcgaccactccgaagccgctgctcccggtcgcgaaccggcccatgatcgcccgcgtcgtcgacctcctcgtcgccaatggcattgacgacatcatcgtcaccgtggcctacctgggctcggccattcgcacctatctcggcgacggcaccgactggggagcgcgtatccgctacctccaggaggagtcgccgctcgggaccgcaggcgcggtccgcaacgccagacacctcctcgaggacaccttcatcgtgctctctggcgacgtcgtgacgaccgtggatctcgaggccgcgcgacgcttccaccacgaacggggcgccagtgcgaccatggtcctcaccaccgtccccgatcccaccgagttcggcgtcgtcgcgaccgaagacagcggagcggtcaccaggctcatcgagaagccgtcgtggggcgaggtcttcacggacacggtgaacaccggcgtctacatcctcgaaccgtccgtcctcgatcgcatccccgccaaccgtgcggtggacttctccgaggaggtgttcccgcagatcctcgacgaccgcggagcgctgtttggctacgtggccgacggctattgggccgacgtcggcaccttctcgggatttcaccagacccaccacgacgtgctcgacgggcgtgccggcatcgctccctcgggcttcgaactggctcccggcgtctacgtcggtgaccgctcgacgatcgacccctcggcactcttggaggcgccgtgcatcgtcggcaacgacgttcgcatcggccccgggtcgaggctcggcccctacaccgtggttggccacggcgtgcgggtggggtccgacgtccatcttgacggcaccatcgtcttcgaccacgcatggatcgccgacggggcacgtctcggccgcgcgatcgtcggccgcggcgtcgacatccgccgccgggtcaacgtacacgatggcgcagtgctcgccgacggcgtcctcgtcggacgcgacgcggtggtgcgagccgacattcgggtgtatccgggcaaaacggtcgatccgctcgccacggtcgccaactccatcgtctgggagagtggcgcgagtcggacggtgttcgggccgctcggcatctccggcctcgccaacgtcgacatcaacccagagatggcgacacggatcgcgatggcgctcgcatcgcagctcccccccaacggcgcagtcctcgcggcacgcgacacctcacgggccgcacgcatcatcaagcgcgcgatgatggtcgggttcaacgccgtcgggctcgacgtctgggacctcgaggcaacgaccaccccggtcctccgtcacgccgtggccgccaccgatgcggtcgccggggtacgagtcgccctcgacgccgacgatccccaagccctgaccatcgagctcctcggggccgaaggcgccgacctcgtcgcgaccgagcgacgcaaggtggagcgcgcgctcgagcgcgaggagtttcgcagggtctccgcgagcgagatcggcgatctcgtcatggtctcccacgcgaccgaccgatggaaggcagcggtgaccgccctgctcgacatcgagcggattcgggagcgcgccttcaagctggtcctcgactactcgtacggcgtcgtggcgtcgagccttccgcaagcgatcgcgtcgttccacgcggacgttctcgccacccacgcctacccctcgaccgcacgcctcatacgacttcgactggaggagcagatcgccgaactcggccgtctggttcgaggcgccaaggccgacctcggtgcgatcgtgaacgccggcggcgaacggctgctgctcaccgatgcgcgcggtcgcgtcgtcccgatcgccggtatcgccaccatcctcgccgagcacctggtcgcgaccgggaaggtccggcggctcgtggcgagcgcggccgtcgcgagttcggtcgccgacaccgctcgcgccctcggcatcgagttcgcatggtgcgggctctcgcgagctgatctcgccgccgccgtcgccgatgcaccaggaacgctcgccatcggccacagcggcctcgtgttctactccggatgcgcgagctcgtcggacgcagccgtcaccctcggactcatcttggaggccctcgccaccaccggaaccgatctcgcccatgtcatcgaccgcacgcccgccgagacgacggtggccgaggcggtacccgtcccgtacgcggtcctcggtgcgacgatgcgggggctgcgcaccttcgccgaggagcaggggccggtcgagctcgtcgcgaccgatggccttcgagcgcagttccaggaccgattctggctcctctcgcccgacccccaagaaccggtcgtgaccgtcatcgtgggtgcggccgaccccgaggtggccaaggacgatctcgcggtcctgcgcaccgctgtcgcggcgcgtcgcgacgaagcaacgcaaggtcgcaagggctcgaattccaacggcagcctgcccccctcgacctccgcgcgcgggtaacctaaggcgtcatggagttccctgacgacctgcgctacaccgcagaccacgaatggcttcgcacgatggacgacgagaccacccaggtcggcgtgaccgactacgcccaagacgcgctcggcgacgtcgtctacgtcggcctgcccgaggtcggacgatccgtgcgcgcaggagaaccgatcgcggaggtcgagtccacgaagtcggtctcggacgtcttcagcccgctcagtggcgacgtcgtcgcggtgaacgaggcgctgcgcgaggcgcctgagctcatcaaccgtgacccctacggcgaaggctggatcgtgacgatccgtcccacggggtcgacggacgagaccgctggcctcatggacgcagcgagctatcgcgacctcgtgcacaaggcgtgagcgaaggggatgtggtgagcgaggggggtgcctcctgtcccgtgtgtggcgcgccactaccggcagggtcacacttctgtccacgatgtggtgccgccatcaccgatgacgatcgaggtgacgtcaccgggacactggcgatcgacgcgatcgagcatctcgccgaggaggcgccgtcgggtccgaccacgacgacgcccgtgctgctgcttcgatcgggcccgcaggccggttcgtggttcgcactcgacagggacgtcgtgacggtgggacgccatcccgattccgatgtgttcctcaacgacgtcaccgtctctcgacgccacgccgaaattcgtcgcgagggtgacgcctacgtcctctacgacgccggatccctgaacgggacctacgtcaatcacgaacggcacgagcgtgcgccactgcatcatggtgccgaaattcagatcggtcgctttcgcttcaccttcttcgtaccggagaccgcgtgaactcctctcaacacctccgcatcgttcccgaacccgaatactcgatcaaggacgtcctcgcgctcttgcaagaggagttcccagaggtcacgatctccaagatccggttcctcgagagccagggcctcatcagtccggaacgcacgccatcgggctaccgacgcttctacgatcacgacatcgcccggctgcgccatgtcctgcggctccagaagtccacctacatgccgctgaagaagatcaaggagcacctcgacgccggcacccaaccgtccgacctcttctccgaggacgccgtcgccggccaaggcaacgccgagacgagcgccgtcacgccgaacgagtcggagcccgaggccggttcgagcgcagaggcatcacgatccgacgcccctggcctcctcgacgagcacgacgccctcgctcgtgcgggtgcgaacgcctcgacgcttcgcgcggccctggatcatgggatgatcgtcggcatcacgaagggccgtgagcgctacctcacgctcgaagaggtcgagatccttgcactgctcgccagcctcgagcgccatgggctcgaaccccgtcacctccgcttcgttcgctcgttcgccgaacgcgaagtcggcctcatcgagcaggtgctcgcaccggtgctctcgatgagccatcgtcaccccgagcgcgcgcgcaccgcgatcgccgagctcgccgagctcctcggtgccctgaccaccgcgctcacgacccgcgacctcgagcggctcgatccgcatgcgcggcgaacactctgagtccagctcgagaccttggcgagcgtccgcgcggcgctgagttcggcgctcgggcccccgcctgaagcacgcgctcactgctcccgacgctcgcctccgtccgcgttcgggtcacgcgccgcgccgtactcctcaccatcgacgacgtcaccgcctcccctccacgcgcggaaggccagggccagcgccgatccgaagacgatctcgccgatgcccacggcgaccccgaaggcgacacggacgagaccggcaagccctgcgaccacgacgccaaccgcgaccatgatgccgattcgacgcatcgcactactcctaccgttaccgttgctactcgcgccgatcagggtcgcgacgtgcggcccttgccacacggtgtcctctgcctccccgatcgcctcagtccgaaaagtcctccggccgtaggtgttcgatgaagtcgcggaactctccgaggagttcgtcctcgtcccccgaggacgtaggctcggcatcgtccaacactgcaccctcggcgtccatcaccgcctcatccacgaagatcgggctcgacgttcggagcgccagtgcgaccgcgtccgacggacgcgccgagatctcgcgctcgatcccgccttgggcgagcaccacggaggcgtagtaggttcccgcccgcagctcggtcacctcggcccggacgacctcagcgtcgagctcttcgatgacgagacgcagcagatcgtgcgtgagcggccgcggcgggtccacctgcgacagggcaaggtgaatcgcgttcgcctcgggaacaccgatgaagatcggcacgacccgatgcgggtcgcgtcgctcctggaggagcaggactggtgcgttggaccgaaggtcgactcgaacgccagcgacttcgacttccaccattgattccatgctaccaagcggccagcatggtcgccgaggcgcggccagcgcgaggcggcaggattacccgagacggttcagcgcggacagaccgaccgcactggccgccgactcgaggtgctgcgtgatccaggcgaagtcgttggccaccatcactacgccgaacacggcgaggacgcccgccgccaccagcgtcacggtccgcaggtgcttgcgcagcgcccgtgtcgcggtcaccgcgcgcgagaacgcgagtccgaacaggagaaacggcacgcccagcccgagcgagtaggccccgagcaacagcgctccctgcaggagctggccctgggtcgccgccacggcgaacaccgacgcaaggatggggccgatgcacggtgtccaaccgaacgcgaacgccatcccggcgaccggcgccgcaaagcgaccgaatcgctcgagcctcggatgccaacgcttctcggcgaacaggatcgggaatcgcccgaggaccgagagcacgaggagtacggccatggcgaggagcacgacgccgctcgcccgctcgagcaacgcatgatgacggacgagggtctgtccgagcgcggaagcggtcaagcccatggcgatgaagaccacggcgaacccgaggacgaactgggcggtgcgccccgccacccgccgggcgaccgccacccctcccgcttcgagctcgcgcgtcggtgccccggagacgaccgagagataggcgggcaccaacggcaggacgcacggtgaggcgaacgacagcacgccaccgccgaacgcgaccacgtagccgactccgagtgccacgtcatgcagtctaccgatcgccggctcgtggtggcggatcgcatatactttgctaaacacaactattttccgggaatcaccgatagcccggtgaggttgtcaacatgcaccgacaatgtgctcgtagccatcatctgaccaaggagcttgatctcagcatgacgcaaggttcgcaccgacaccgctcaggacttgcgatcgccgtcatcgccggcgcacagctcatgatcgtgctcgatctcacgatcgtcaacgtggcgttgccgacgatccaacacgctctccacttctcgccgactggcctctcgtggatcgtgaacgcctatacgttggtcttcggcgggctcctgctcctcggcgggcgctccggcgacctcttcggccgacgtcgcatgttcatggtgggggttgccctcttcgcgatcgcgagcgtgttctccggactggcgacctcgcaggcctggctgatcaccggccgtgccctgcagggcatcggcgccgcgatcgcctcaccgaccgccctcgccctgatctctgcgaccttcaccgaggcacgtgagcgcggacgggccttcgcgatctattccgcggtgtcggcgggtggagcagcgatcgggctgctcgctggcggtctgcttacccaatacgcatcatggcagtgggtcttctacgtcaacgctccgatcgccgcgctcttgctcgttgccgcgccgcgggtgctcgcagagaccgaacgtcaccacggcagcgtggacgtgcctggagccctgacgggtaccggcggcctcgcgctcgtggtctacggcctcatccatgcctccaccacctcttggtccaatgtgacgacgattgcggtcctcgctggcggggtcgttgcgctcggcgcgttcatcgtcatcgaacgtgtccgacgtgagccactcatcgacttccagatcctcgccaagcgtgaacggggcggcgctgtcgcgatgatcctgttcgtcgcggcctcgatgttctccgtcttcttcttcgtgtcccagttcatgcaagacgtcgtcggctactcgccggtgcgaaccggtctcgcgttcttgccgatgacgctcggcatcatgatcacggcccagctcgtgtcccgcaacctgcaccgcgtcggcccgaagccgttcatggtcggtgggagcgtgctcatcgccgtcgccatgggcctgctgtcccagatgcgagcctcgtggggctatctcgacctcctcggcccgctcgtcatcctcgccatcggcgccgggagctccttcgtctctctcttccccaccgcgacccacggcgtcgaaccgcgtcgcgtcggcatggcctcggccctcgtgaccgtcggacagcaggtcggtggcacgctcggcttgtccatcctcgtcaccgtcaccgtggccgcggccaagcggcatgcggcagccctcgctccgcgcctcgccagcggccacctcacaccccaggcactcacgatcctcgccgaggtgcatggctgggcggccggcttcgcggtcgcgacaggattcggcgtgatcgggctgctcatcggtttgatcgtggtcccgcaccttggaccaactgcgaccgaaggagcggcggaagggtcggcggtcgccgcgtaggccggacgcaggcgaacacgccagcgctcttggcacagtcgcatcgcaccctctacgctggagggtgcgatgcctaccgttccagcgttctcgcccatcgggctgctgaccgagtggtcgctcggaccattcgcgatcgtcgtcgtgatcgccgccggcgctctgttcgcgtggtacgtcgatgcggcgatccgcgttcgcgccaagggtcgtagctggccaggtcaccgcatcgtcacgttcggtctcggcctcctctccatcgtctacgcgctggcaggaccgatctccgtgtgggtcatgcgctacttcccggcgcacatcgtccagcacctcgtcctgatgatcgtcgccccgtcgctgctcgcgatggccgcaccggtcacgctggcgctccagacggcacgtggcaccgcccgtcgactcgtcaccggcttcatccactcccgcttcctccacgtcatcacgttccctctcgtcgtcgtcatcgcgtactacatcgtcatgtggtggttctttacgacgagcgcgatcgggttcgccatgacgcacatgtgggtgatggacctgctcaacctactgttcttcgccggaggcgtgctcttttggtggccgctcgtcggcaaggaccccatcgtgcactggcgaatgggctggggtgcgaagctcgtgtcgctcgccttcggcatccccttcgagacgttcctcggcctcaccatcgccggttcacggacctcgctcgctcccatgtacagcctgaccgactggacgaccggcggcgacgtgctgtggggcttgagcgagatgctcacgaccctcgcgatcggcgtcatcatctggaactgggtcgcctccgaggagcgccagacgcgccgtatgtccaggtcccgcgaggcggtgccactctcgagccgccaagacggcctgccgaaggagtactactgggcgcgccaggtcatcgagcgcatgcctgcaggctcacccatgtacgaagaggcgcgctccgtgctcgagcggatcgaccgcgaacgccccccggagacggctcgctgacgactcgcagcggtgtgtgcgctgagcacgccctcgtcgcatcgccggggtctcgccagtctgagccgcagcggccgcgtgatcaggtcggtgcggaaaacgtgaggaacgccgagatccaccagtgttcgaagggcgagaacacgagctgcaagacactcggaaacaggaccgcaacgagcaccacgacggcgagcagccccattcggaagcggagaaagccataccaggctgatgccggcagcacacgctcgaggatggagccaccatcgaggggcgggagtgggatgagattgaacacgccgagcagcagattgacgaggccagcctcgacgaggagctggtcgacgaggctcgatccgatcgaggacgcctgcgcggcggacgccgtctgaatgtcgtgggcgatcactgcatgcgccacgatcccgagcgcgaccgccagcacgaggttggtggcggggccgacgaggccgacgatgagggcgccgttacgaggatggcgcaagcggcgaacgtcgatcggcacaggcttcgcccacccgatcggcggtaagccggcgatgatcaagatcacgggcacgagcacggaaccgaccggatcgaggtggcgcagagggttccagctgagacgaccgctgcgcttggcagtatcgtccccgagggcaagcgccgcccagccgtgcgagagttcgtgcagcacgacggaggggatcagcaccgcgagatagagcagcgatgtcagattgatgacgccacgccacagggcgagccccaccaaggctgcgccgaccacggcgagtagccatcgctcacgagtcatcagcggctcccggcccgagcacgcggatgcgcgcgttggtagacggcatccacgtgaccctccgacaccttggtgtagagctccgtggtggcgagggatgcgtgaccaaggatctcctggaccacgcgcaggtcggccccggcctcgaccatgtggaccgcgagcgaatggcgcaggacgtggggcgagacccgatcgccgagaccgacccgcgacgcacgttgcttcagcaccagccagaccccctggcgcgtgatgggtgcgccccggaggttgacgaagagcatccgatgcttgggagcgagctgcggtcgccatcgaaccacccactgctcgagcgcatcgcgcgcaggggccgagatcgggacgaggcgttcgcgtcctcgcttgcccactacaggtacccatcgaccctgggcgatggtgtcgagcgtgaagccacagagctcgctcacccgaacgcccgatccatagagcacctcgaggatcgcacggtcacgagcgccggcgacatctgcggtcccgacggactcgatgagccgctcgacctcgtcgcgagcgagcgcacgtggcagcgcgaccgccgttccaggcgcatggatcccctccatcggatcgtccgctctcgcaccgacgcgttgggcgtaacggaacagtccccgtagcgcactcgcggcgcgctgaacgccgcgcggggagcgctcccggccggcggcgtccacccaggagcgcaacagagccgggctcgcatcgaggaggcgcgaccctctcgcctccagccaggtcgcgaccgcttcgagatcgctgcgatacgcgatggcggtcaactcggaccgatcggccgcaacgacgaggagggtgaggtactcgtcgacgaccgcctcactcgccgggtccaacgatctcgaactcctccatggccacggtcgcctccctcgcgacctgccgaccgagtccatgggccctcgccatgagcagcgccacgatgctcttcgcatcctcgaggacgcctgaggccaccagtgcgtcgaggtcgtcgagacggagcgccaccagctccatcgcgcgctcctcgaccgattgaggagcccgctcgccccgagagaggcccgtcgctccgaccacccaggttcgctcatcggtgaacccgggcgagttgtagaagctcccgagggcctccaccctcgccgcgaggagcccgcactcctccgcgagctcgcgccgagcggtgtcgagcaccgactcgcccgcgacgtcgcgcttgcctgcggggagctcgagcacatcgcggccgagggccgcacggaactggcgctgcgcgacgacacggccgttcccgccgagtgcgacgacgacgaccgcgcccgggtggcgcacgacggtacgacgctcgctggcgccgccgtccgcctggagccggagctcggtgacctcgaagaagccataggtcgcgcgaaggtcctcgccgacgatctcgatcgtcacgcccgatccttctggtggcggagcgcggcctcgacgagacccgcaaagagtgggtgcggacggttcggccgcgagaggaactccgggtgcgcctgcgtcccgatccagaaaggatggtcggggaactcgacgaactccaccagcctcccgtcggggctccgcccgctcacgaccagaccggcctcttcgagccgatggacgtagcgctggttgacctcgaagcgatggcgatggcgttcgtagaccacctcggccccgtagaggtccgcgacccgcgtcccgggcgtgaggcgcgccgcgtaggtaccgagtcgcatcgtcccgccgaggtcgatcacctcccgctggtcgtccatgagatcgatcactggatagggcgtctccgggtcgaactcgcgcgagtgcgccccgggcaagcccgcgagggagcgggccacatccaccaccatcacctgcagaccgaggcagatcccgagacagggcatccctcgttgcctcgtccaggcagcggtcgcgatcttgccttccacaccccgaggcccaaatccgcccggaatcacgacgccatcgacgtcctcgaggagttcgtcggccatcatcggcgtgacctcctcggcggagacccaccgcacgatcacgcgtgcgtccgaggcaagacccccgtgacgcagcgcctccaccaccgagaggtaggcatccgggtgatcgacgtacttgccgatcacggcgatggcgacgtcgcgcgacggcgcagcggcacgacgcaccaaggctcgccactcgtcgaggtcgggctcaccggccttgaggtgcaagatctccgtcaggtattggtcgaggccctcttcctgcaagagcagcggcacctcatagaggttgtcggtatcgagcgccgcgaccacgccgcgagccggcacgtcgcagaacatcgagatcttctggcgcacgctctcggagagcaccctgtccgagcgggcgacgatcacgtcgggctggatgccacgcgagcgcagctcggtgaccgagtgctgcgtgggcttcgtcttctcttcgccgttgggcccgagatgcgggaccaacgtgacgtgcacgaaggcgacgtcttctcgagggacctcgttgcgcagctgccggagcgcctcgagaaagggcaggatctcgatgtcaccgaccgtgccaccgatctccgtgatcacgacgtccacgtcgtcgccctcgagcgcgcgaatccgcgcacggatctcgtccgtgatgtgcgggatgacctggaccgtcttgcccaagtagtcaccgcgacgttcgcggtcgatgacggtccggtagatcgacccggtcgtcacggacgaggcccgtcgcagcgagacatcgacgaagcgctcgtagtgaccgaggtcgaggtcggtctcggcgccgtcggcggtgacgaacacctcgccatgctcgaacgggttcatcgtgcccgggtcgacgttgatgtagggatcgagcttctgcaacgtgacggcgagcccccgcgccttgagtagacgccccagtgaggcggcggtgatgcctttcccgagcgagctcgctacgccacccgtcacgaacacgtgcttggtcaccctgcctcctcgcgcggccgcctgcggggatcgcccttgagcagtctagagcatcactcccccgtcggcaggagccgacggtcccgactcgctcgatgcagattggagcagtgcccgtgcgtgctcgagggcgacgtcagcgtcggggtggcccgacagcagccgcgcgatctcgcgcacgcgcgcatcgtcgcggaccggttcgacccgcgtcctcgtgcggtcgtcgacgagctccttgtgcaccacgaagtgagtggttgcggctgcggcgatggaggcggtgtgcgtcaccacgatgacttgacgccgcgtcgcgagtcgttggaggcgcgccgccactccgagcgccgcacggccgccgagtccggtgtcgatctcgtcgagcacgatcgattctcgaccctccccgagcagttccgccatcgccagcacgatgcgcgagagctcgccacccgacgctccgcggcccagcggcgtcggctcgaggtcgggtgaggccgcgaaccagaaggccggtaccccttctgccccttcgaggcggatctcgaagcgagctcgctcgagccccagcgctccgagggcctccgtgacgtggcgacgcaggacctctgcggctgcgtctcgttcggcgcgcagcgcgctcgcggcctgctcgaggtggcgctctgcctcgaggcgttctgcctcgagctcttccatcagggcctcgctgccctcgatcagcgcgagcgctcggcgtcgctcctcacgcgcctcgatcacggcctcgagggtgggtccatagcggcgcttgaggtgggacagctgggcaagccgtgcctgggcggcctcgagcgcagccggatcggactcgagacgctcgaactgatcgcgcacctcctcagccacgtcggtcgcctcggcgaggaggctctccaggcgctccgccaaggccgggaacgcacgttgcaccgcgcgtgccgactgaccgaggcgatcggtgatgctgttcgtcccgaccaggtcgcgatggagggagaagagctctgcccgcagcgcatcggcgtctccgagccgatcgacgagctcggtgagctcgttgtcctcttcggggttggcgagctcggcgctctcgagttcggccagctcgaagccgaggcgctcgcgctcacgctcggcgtggtcatgatcgtcacgcgcgcgtcggagtgcggccgtcgcgtcggcgaggcgctccctcgcgcgatgccacgcgcggtcgtcgatgcccccgatgcgatcgaggatcgcacgctgttggtcgggttgggtcacgaacaccgcttggtgctgaccgacgacctggacggctcgcgcgacgaacgaagcgagctcgccaacggcgacgagctcgccatcaatgcgcgcacgggagcggccctcccgggtgacctcgcgctcgacgaccgcttcgtgaccgtcgacgtcgacgatggcgcggacgcgcgcccgctcgtcgctcgcacccacaaggtcgctgcgtgcccgctcgccgaggagaaggccgatcgcacccacgatgagggtcttgcccgcccctgtctctcccgtgagggcgacgagcccgccgggcagctcgagcgaggccgcctccacgacccccaagttgcgcacctcgagcaggctcagcatggcaggtcgagcacctcaaggccgaacttcgccttgagtacctcgtggaagggcggggccccgatctgggcgaggcgcacccgacgcgtcgccgcgtggacctcgaccgcttccccgggcacgagggacgaccacggaacaccatcgaccatgaccgaagccgtcgggccatcgagcagtcggatctcgacgggttcgtcgagtccgaggaccaaggaccgatcgaagagctgatgcggagcgatcggtgtgagcacgagcgcgtcgacgcgtggcgagagcacgggtcctcgcgcggagaacgcataggccgtcgagccggtgggcgtcgcgacgatgatcccatcggcggcgtagcgcagaaaggggcgacgatcgatagcgacgctcgcgcggatgaggtggcccgacgcctgacgctcgacgacgacttcgttgaagccgacggttcgctcgctcctcgaaccgacgcccgcctcgagcacgacccgctcctcgacgacgatcgacccatccacgagggctcggagcgcgggttcgagcgccgacggttcgacctcggcgagatagcccagttgaccgaggttcaccccgagcaccggcacgtcctctcgccacgccgccgccatcgcacgcagcatggtgccgtcacctcccatgctgacgaccgcatcgatcgccccacacgcgtgcgtcgggtcctcgagtatgcaggcactcccaccgagctcgctgagcaacgcccgagcctggcggaagagttcctgcgcacgcggctcctgcgggtggagcacgaacccaacgttcatccggctcagcctaaccaccaccgcttcgttcactcggggcacgcaaccacacgaactcctcgacgttgccctcggctccgggaaccgaactcggacaactcccgaggacaacgagccccatcgaacccatcgcgtcgcggactcgtccgagcgcctcgtcgcgctccggaccgagcgggatcacaccgcggtatcgactcgcgatctggcgccccacctcgaactggggtttgacgagcaccaccgcctctccgcccggcgcgagcagcgacgcaacctggtcgaggacgccgagcaccgagatgaacgacacgtccacgaccgccagcgtcggtgcttcggggaggggccacacgaacgcacggatgtcggtccgctcgtagacctcgacgcgcgggtcatgccggagcgactcggcgagctgtcctcgtccgacgtcgacacacacgacgcactcggcaccgcgctcgagcagcaccatcgtgaacccacctgtcgaggcacccacgtcgaggcagatccgccctgacgggtcgatgtcgaaggtgtcgagcgcaccctcgagcttggccgcgccgcgcggacgccacctcgaggccacgaccgagagcacgtcgctgggcgcaacgaggcgagccgccgacagagccggggcccgattgacgagcacacgcccctctgcgatcagacgcgccgcgtgcgaacgggagcgagcgagcccgccagcgacgagcgctcgatccaatcggacacgcctcaccgctccgagagcctatcgctgaggttctagcatcctcatcgtggcagccatcgatgcgctcgagacgcgcctgctcgagtatctgagcgcgccggctcgctcgtcacccgccctcgcacgggcactacggatctgtgaagatggcgctccgatcgcctacgccgcaaccttcgcctgggtcgcgtggcgcagcgcggatgatccgcccgttcgcagcgccctggtgcggaccacgcttgcgggctcggtcgcggtgctcggcgcaggggtcgtcgcacgcgcgcttccgcgctcacggcccagcctcaccctctgggcatcgcgcaggtcggcgagcgatagtcactcgttcccatccgaccatgccgcgggggcgagcgcgttcgcccttgcctcctctgggctccctcggggtgcgcgacgcgcactcgtcgccctctcggcaacgacgatcgtgagccgggtcctcctcgctcgccattggccgagcgacgtgctcgcggcactcgcgatcggcgccgccgcgtccaccgtcgccggggccctgccctcgccgatggtgaataccctcggcgagatcaccgtccggtggctcggcctgtccgctcgagcacgacggacgcccacagcatcccgaggcaggcgacaagagcaccgaccgcgtcgatgacccacgcgccgtggaagccgaccgcaccgacgagcgccccgaacccgagcggtccgacgacgctgccggcaaacgcgctggcttggacaatggccgtcgcctgtccgggatgttcaggccaccgttcgctcaccgcgaagttcaccagcccgttccagccccaaccgccggcgtagccgagcaggagccctccgagcaacagcgcacgcacaccggtcgcgagcgcggcatagcccaccacgccgacagcgagcaagacggcgaccgcccggatcggccgctgcagacgtcggtcggcgagtgcgcccatgcccaccctcgtggcgaggccggcagcgctgccggctgctgccgcataccccgcgatggcagcctggacgtggtcgtgaacgagcgatgccacgccgaacgcaccgagtgcattcgccgtccctgcaccgagcgccatcgcggcggcgacgatcagtagcgaccgcggggtgacgaagcgcgtccgcgcctcagccccctgagatccgtcgtaggaggcaaaacccttggctccgagcgcgatcgcaacagccaggatgctcgtcgcggcaaaggccgtgcgccagctcgaccggagcgccaccagcggcagtgccagtccagcgagcaaggttgcggtaggaatggccgcctgcttgatcccgaatgcccagccacgcctcccggggcgcacgacgcgcgcgagtacctcgttcacaccgggttgcaagatcccgttcgcggcccctgcgaccacgagtgcggctgcgagcaggatcggaccacgcaccgcgaaggcgatcacggcacttgccaccgcggatgcgccagcgcctgctcgcaccagccggaaggccgccgctcgatgcaagatccgcgccgccagggccgcccccacaatcccggcaacgaagaagctcgcgacgacggctccttcaaggctcggggtgaggtcgatggcgtggcgcagcaccggttcgagaccaccgatgaggaacactggcagcgtcgtcgccgtcgtggccgcgatcgagaacggcaagacgaggcccgttcggggcacaccagaactcatgagacgttcaggatttcctgagtgccccgtgagactcgaaagcatacctatgcacaccgccaccttacccgcaggccacctgcatacctatacctcgacttgcacacgacatccgaccgtgacgtgcgcgtcacgcagacgacgatgattgcgttccatacacgagaggaatagcctacgatacgcaatggccaaagagcagatcgctcctggcctgcctggccgacgccaccgaggctcgccagcatgacacgagtgtgggaggaagtggggaacccatgaagaagatcacagcacgccaccgcctcatcgcgggacttggcaccaccgctgccgcagccatgctgctcgcggcgtgtggctcctcgtcgagctcgacctcgtcctcaagcacgaccaaggtctcgggcggtacggcctacttcgccgaggccgccggcgcaaacccgaactacatcttccccttgaccgggggcccgtacttcagcgtcgacaacctcgcccagttccagatcctgatgtaccgaccgctctacttcttcggggtcggctcgacgccagagatcaactaccagctctccatcggcaacgcgcccgtctactccaacaacgacaccaccgtcacgatcaccctgaagcactacatgtggtcagacggcgagccggtgacctcgcgcgacgtcatcttctggatgaacctgctcaaggcgaacaaggccaactgggccgcctacgtgcctggcgccttccctgacaacgtcgcgtcgtactcggctccgaatgcatcgaccgtcgtcttccacctcaccggcaaggtcaacccgacgtggttcacctacaacgaactgagccagatcacgccgctccccatcgcctgggaccgcacctcgctcagccagccggcacccagcccgtcggccgccaacttgcccgatacgacgacctcgggggccaaggcggtctacaccttcttgaactctcaggccacgaacgccaacgcctgggcctcgagcccgatctggtcggtggtggacggcccgtggaagctgaagagctcgtcgacgaccgggcgcatggtgttcgtgccgaacccgtcctacaccgggccggtcaagccgtcgctgtcggagttcgtggagctgcccttcacctcagacaccgctgagttcaacacgctgcgcgccggcaacggggcgatcacctatggttacgtgccgacggtggacctcagccaggtgccttacctgaagagcatcggctatcgcatcgagccctggatcgacttcggcttcaactacttcgtcgagaacttcaacaacccgacctacggaccgctgttcaagcagacgtacttccgtcaggccttccagcacctcgtcgaccagccgcagtggatctcgaccttcctgaagggctacggcgtaccgagctactcgccggtgccgctcgcgccggcgaatcccttcgcggacgccacctcgaagaccaacccgttcccctactcgatctcggcagcgaagtcgctcctcaccagccacggctggaagatggtgaacggcgtcatgacgtgcgagagcccgggcacggccgccaccgactgcggtgcaggcatcgcgaagggcttcacgctcacgctgaacctgcagtacgcctcgggtaccacgttcatcacccaggagatggacgcgctccagtcggcagcagcgagcgcgggcatcaagatcaacctctcgcaggcacccttcaacacggtcatccacaacgccactcagtgctccggttcgagctgcacctggcagatggagaactggggtggcggctgggagtactccccggacaactacccgaccggcggtgagatcttcggcaccggtgctgggtcgaacttcggcaactggaacgatccgaccaccaactcgctgatcgccgagacccacacctcgtcgaatgcgcaggcggcgctcgatgcctaccaggactacatggccaaggtcctgccggtggtctatcagcccgccgccgattacgccatctccgcgatctcgaacaagctccagggggtcactcaaaacccgtacctgaacttgacgcccgagacgtggtacttcgtcaagtagcgatcctcagggctccgagccccgcttagcgggggctcggagcccattcgcctgacggaccacgcacgatgggggctccgcaatcgaggccgagcaggcccggcgcccccgcgaacgatccgacatggcccgctcctacgatcgatcgccagtactagttccacgaggagtccatgaccggctacatcatccgcaggctcgtccagtctgtcatcgtcgccatcggcgttttgctcatcatgttcatcctgcagagcctcctgcctgatcccgcgcgagccatcctcggggtcaaggcgacgccggtacagatcgcggccttcaacagggccaacgacctcaacaagcccttctacgtgcagttcgcgcactacctcgtcgatgtcgtgtggcatcacaacctcggcaccgcctatcagctcaacgagtccgtcggctccatcatcgctcgcgacgccccgaagtcactcgtgctcgtcggcgttgccctcgccatcgccgtgatcatcgcggtaccgatcggcgtctaccaggcggtccgtcgcaacacggtcggcgaccaggcggtcaccgcggtgtccttcctcctctactcccttcccaccttcttcctcggccagctgctcattctcttcctcgccgaagacttccacctcttccctgccgaggcgccccaaggggtcacgctgggccagatcctgtccgacccgattgcactcgtcctcccgatcgccaacctcgtgctcgtgaactacgccggctactcccgcttcatgcgttcctccgcgatcgaagccctcgcccaggacttcatccgcacagcgcgagccaagggtcttcccgagcgggtcgtcctcttccgccacatgctccgcaacgccctcatcccggtcgtgacgctgatcggcctttcgatcccggcgatcttcacggccggcctcatcaccgaggctctcttcaacttcccagggatcggatcggactacgtccaagcactcgtgagtcaggactatccgctcgcgctcggcatcacgttgctcgtcgcggtgctcaccgtgctcggtaacctggttgccgacattctctatgccgtcctcgatccacgagtccgttatcgctgagcacggacctaggaacggagcccaactcatgtccatcaccgacgacctcaaccccgatctcgaggctgacctcctcgctcccctccccaccgggctcgctggcgcgtcccccgaaggccccgaaggcggtgacgtctcgggtgcaggttccgcgtggcgcctcacgctccgagctttcttcgacaaccgcctttcctatgccggtcttgccatcctcatcgtgctggtactgttctccttcgtcggacccctcgtctatcactccgacctctacacagccacctacaacatcaaccttccgcccggtcccggtcaccccctcggaaccgattcgagcggacgcgacgtcctcgggcgcctcatggtcggtggccaagcctcgctcatcatcggcgtactctcggccgtcatctcgaccgtcatcggggtgatctggggtgcagtctcaggcttcttcggtggcctcatcgacaccttcttgatgcgcattgtcgacgtccttctcgccgtcccgacgatcttcatccttctgtacctcgccagtatcttccggcccacggtcctgctgctgtccatcaccatcgcgatcttgtcctggctcggcgctgccaggctcgtgcgaggggagaccttgagcctgcgctcgcgcgagttcgtgcgcgcggtccaggtcatgggcggctcacgctggcgcatcattcgccgccacatcatcccgaacaccatcagcgtcgtcgtcgtccaagccaccttccaagtcgccaacgccatcctcctgatggccaccctcggcttcttgggtttcgggctcgagcctccggcagccgactgggggtccatgctctcccaaggcgtcaactacatctacgacggttactggtggctgatctggccggccggcatccttattgtgctcgccgtcctctcgttcaacttcatcggcgatgcgctccgagacgccgtcgaggtccgcctccagcgccgctagggcgacctggctactgccgagcacgggacgatcattaccggtgtgtgacgccatcgcgtcccagacgaccatcgccattgcgttgcgatagcctctccctgagtcacgcttgaagcgagtcttcgtgggtcggagctcgagtccgcgccctcggtgcccatgaagtcgccttgtcgcgtcacaatcgcaaggaggtccccgtgcgccacatccggccgtcgcgacggcgtctcctcctccctcttcttgtgggtgcaaccggattcgccctcgctgcgtgtggaacgtccggtgcggccgagccgtcgagcgcctcaccacacggagtcgtgacgttcgcggaacaggtcggggctgctcccaactacatcttcccgttcaccgcgagccagtacttcacggtcgacaacacgtcccagttccagttcctcatgtaccggccgctgtacttcttcggcgtcgccggtcgaccggtcatcaacgctgagctctccctcgcggctcttccggtctactccaacaacgacaccaccgtcacgatcaccctgaagcactacatgtggtcagacggcgagccggtgacctcgcgcgacgtcatcttctggatgaacctgctcaaggcgaacaaggccaactgggccgcctacgtgcctggcgccttccctgacaacgtcgcgtcgtactcggctccgaatgcatcgaccgtcgtcttccacctcaccggcaaggtcaacccgacgtggttcacctacaacgaactgagccagatcacgccgctccccatcgcctgggaccgcacctcgctcagccagccggcacccagcccgtcggccgccaacttgcccgatacgacgacctcgggggccaaggcggtctacaccttcttgaactctcaggccacgaacgccaacgcctgggcctcgagcccgatctggtcggtggtggacggcccgtggaagctgaagagctcgtcgacgaccgggcgcatggtgttcgtgccgaacccgtcctacaccgggccggtcaagccgtcgctgtcggagttcgtggagctgcccttcacctcagacaccgctgagttcaacacgctgcgcgccggcaacggggcgatcacctacggttacgtgccgagcacagccctcagtcaactgggcgtggtgcgctcgatcggctaccgcatcgagccttgggtggagttcggcttcaactacttcgtcgagaacttcaacaacccgacctacggaccactgttcaagcagacctacttccgtcaagccttccagcatctcgtcgaccagccgcagtggatctcgaccttcctgaagggctacggcgtgccgagctactcgccggtgccgctcgcgccagcgaatccgtatgccgacgcagcatcgagacacaacctctacccttattcgatctcggcagcgaagtcgctcctcaccagccacgggtggacgatggtgaacggcgtcatgacgtgcgagcgcccgggcacggccgccaccgactgcggtgcaggcatcgcgaagggcttcacgctcacgctgagcctgcagtacgcctcgggtaccacgtccatcacccaggagatggacgcactccagtcggcagcagccagcgcgggtatcaagatcaacctctcccaggcgccgttcaatacggtgttcgccaacgccgccccgtgctcaggttcgagctgtacctggcagatcgagaactggggcgcgggctgggagtactcgccggacgactacccgaccggtggtgagctctacacaaccggagccggctccaacgtcgagggctggaacgatccgacgacgaacaggctcatcgccgcaactcacacctcgtcgaatccgcaggcagcgctcgatgcctaccagaactacatggcgagggtcctccccgtcgtctaccagcctctcgccgactaccaggtatcggcgatcgcgaacgaccttcacggcgtgagccagaatgccttcttgaacctgacgcccgaggcgtggcgccttggctgagctgggcgacgctgctcgcggacccctctcgccaaggacccgctgagcgcaatcctccagagccccgcgggtggccggatagcctggaggccactgtgacccaaccagaccctacgccagccatgccccgagcccagcgacgtcgagtatcgaagcgacttcggcgccgacgccgcctcgtcatctccctcgccaccgttctcgcgctcatcgtgctgatcggcgcgggcagttacctctacatccgctatcgcttcggccagatcggacacgtgtcggtcggcgggctcacggcgcagagctccggtcccgagaacatcctgctcgtcgggaacaattcacggtgcacgttgacgaagtactcatcgttctactcgaagggctcacagcacttcggcacctgcagcgaggttggtggtggtcgcagtgacgtgacgatggtcctacacgtcgatccagcgacgcaccgcgcctacctgctgtccatcccgcgagatctctggctgcccatgccgaacggcaacggactcgaactccgtgtcgacgatgcgctcaactccgccgagcgcccctatctccacctgcccttcggaccgaccttgctcgtcaagacgatcgagcaagacctcggcattcccatcaaccactacgtggagttgaacttctacaccttcgagcaagtcgtcaacacgctcggcggcgtcacactcgacttcccgaccaagctcgtcgaccactactccggcctcaacatcacgacgacgggctgccagcacctcaccggcacgcaagccctcgcgctcgttcgagcacgacacctgtactactacaacccctccaccgggacctgggactacgacggcacgggtgacctcggacgcatcgtgcgaacccacatcttccttcgagccctggccagtcaggtgaagagctcggcactctcgaacccgatcacggccaacgcgctcctcggctccctgctgccggcgctcaaggtcgacccgtcgttctccctctcggacatggtgagcctcgcgcttgccttccgacacgtcaaccctggctcgatcccgagcgcgacgttgcccgtgatcatcccctcccagagcacgttcaccgaccctgcgaacccgtccaactatcaggcgccgggctccatcgtcatgccgtgggcccagagcgacctatcggtcattcgccagttcctcggctctgaggcccccaacctcaacgccattcgtccagcctccgtcacggtcgcggtacgcgacgcaagtggtgttggcaacggtagccagctcgtcgctggactctcccagcttgggtttccaacgaccaacctcggtaccgcaacctacgccggcaccgactccgagaccgtcgtcgcctacaagcccggcatgctcgcccaaggcgagcgcgtgctcgccagcctgtctggccaggcagtccttgccgagggctcggcaaatcagcccgccgacgtggtcatcaccgctggatcgacgatcgccaccaccgcaacctcggcccagaccgcagccctgacgacaacctcggcaccgaccgccacgctcaccgccacctcgacgaccacaccaccggtgggaacgctcgtgacctcgacgcagagcctccagcaactcgcctcgtcgaacctgtggcaggccaacgcgagtgggtccgagttctggtgggatccacgtctgtgccccgcccacgcctagtctcgcaggggcgcgcctagtctcacagcgagatgcccgagaccccctcactccacatcgtcgaagtcgctccccgcgacgggctccaaaacgaggcgaccccggtcgtcacccgagacaagctcgaactcatcgaggcatgcgtcgccgccggtgtcgaccgtatcgaggtcgcaagcttcgcacatccctccctcgtaccgcagatggccgacgccgaagcggtgatcgagcagctctcagaggctgccctcgcccgcgcgatcgcgctcgtcctgaaccaacgcggtctcgagcgtgcactgcgtacccgcattcgagagatcaacgtggtcgtcgctgcctccgaaggcttcgccagggccaaccagcgcgccacgcgcaccgagctccttgcgacagcacgcaacgtcctcgccgatgctcgcgccgccgatctgcgtcgttccctcaccatctccgtcgcgttcggatgtcccttcgatggggaggtcgatccccacgaggtcgtacgcatcgtcgagacgattcgagaggccgacccagcgtgcgagatcgccctcggtgacacgatcggcgccgccgcgccgggagacgttgctcgaatgctcgagctgctcgcggacctcgtcgcaccgaacgagctgcgcctgcatttccacaacacccgcaacgctgggatcgccaacgcctgggaggccatgcgcctcggagtccggaccttcgatgcctccatgggaggcatcggcggttgccccttcgcgccacgcgcaaccgggaacatcgccaccgaggacctcgtgtggatggcgacgcgctctggctaccgaaccaacgtcgacctggagcgcgccatcaccatcgccccgctgacgacgcgcctgctcggccacgaggttgcgtcgatggtggcccgagccggcacattccccgccggcacctcctcgcagccgaacccgtccctctagcgcggcgctgctgcctcgcgaggtcgcaccgacagggggaagtggcacgccgcgtggtggacgcctccgaagtcgcgcatcgggggctcctcggtgcggcagatgtcctgcgcataggcgcagcgcgtgtggaaccgacacccaggtggaggggtcatcgccgacgggagttccccacgcaccagcgagcgctccttcgtacgctcgacctccggatccggctcgggaacggcctcgagcagcatgtgcgtataagggtgcttcgcgctctcgaagatgtcgtcgcccgagccaacctcgaccagcttgccgagatacatcacgccgatccgatcagccagatagcgcaccaccgacaggtcgtgcgagatcacgatgtaggtcaggttgtgctgagcctgcagatccttcatcaggttcagcacctgcgatcggatcgacacgtcgagcgctgacaccggctcgtccgcgacgatcagtcgcggcgacaacgcgagcgcccgcgcaaggccgatgcgctggcgctggcctccggagaactcatggggatagcgctccatggccgcaggggccagaccgacctcctggagcaggctcgcgatccgctcaacacgctcggccttggtgccgatcttgtggatgtcgaggggttcttcgaggatctccttgacgcgcatccgcggatcgagcgatgcgaagggatcttggaacatgagctgcagctcgcgccgcacctcgcgtacgtaaccacgctcgttgacgatggagcggcctgcgaaccggatgtcgcccgccgcgggctgctcgagccccacgaccatctgaccggtcgtggacttcccacacccggactcgccgacgagcccaaaggtctctccttcgtagacggtgaacgacacgtcgctcaccgccttcaccgtgccgatcttgcgctgcaccaccgcgcccttggtgacggggtactccttcgacacgtggtcgaactcgagcagcaccggccggtccgtgacggtgcgctgtccggtgcgacgctccaggctgatcgggacacgctccggtgctccaaccggatagaagcaggcaaacggatggagatagccctccggggtcgtgtacggcggcttctcgacgcggcagcgctcctgtgcgtagtgacaccgcggcgcgaaacggcatcccacgagatcgcccgtgaggtcgggcgggattcccgggatcgagtacaggcgctcgggtgcatcgcccgtcagcggtggaatggatgcgaggagcgcctcggtgtagggatggtaggtggaggcgaacagctcggcggcgtcagcatgctcgacgatctctccggcgtacatgacgatgacgtcgtcggcgcgacctgcgatcacgcccatgtcgtgcgtgataaggagcatcgccatgccgagcttcgccttgaggtcctcgagcagttcgaggatctgggcctggatggtgacgtccaaggcggtcgtcggctcgtcgaggatcacgagcttcggatcacagctcagcgcgatggcgatcatcaccctctggcgcagtccgcccgacagctggtgagggtaggattcgagccgctcgcgcggattgggcataccgacgagcgagaggacctcgagcgctcgctcgatggccttgtccttcgagtagccaaggtgccgacgaacgacgtcagtgatctggtcaccgatggtcatgcaggggttcaacgacgtcatcgggtcctggaacacgaccccgatcttgccgccccgcacgtcctggagctccctccgcgacagcccggcgaggttgacgccgtcgaagaggatctcgcccccggcgatgtagcctccctggggcagcaagccgaggatcgacatccccatcatcgtcttgcccgacccggactcgccaacgatgccgagcgtcttgccctgctcgagcgagaagctcacaccatcgaccgcacgcacctcgcccttgcggagcctgatgcgcgtcctcaggtcacgaacctcgaggagtgccatcgcgttcctccatgctccccacgccacctacacggtggctgcatagagcgccatgctacccgcgtcggcgcgggtccggtggcgcagcagcccgtgaatcgaggtgctagcatttcagctccgcggggtgtccccgcagagcttgtcggagtggcggaataggtagacgcgctaggttgagggcctagtgaccgcaaggtcgtgggggttcaagtcccccctccgacaccaagtcccccaccgacgcagctgagatctcgcgccggtcgatcgtgcaacgcgtggcgccctcgcacggaccaaggtgggcctcgatgcccagcacctgacgagacccagcgaaacgccaggtcaccacccctgagcggctccaggaccgccacgagttgctcgacgctcgcctagctcgcacgcggcgagcccttctctcggcgtcgctcgactcttgtccgcatggaggctcgccaccgaaggtgggccatcgctctcacccgacgtcgagcgcgcctctccagacaatcgccgaggtctcggcaaccctggagcgcctggacatcgagccctcgaccgctcgccgcatgcgctatctcgacacctccgcgcgtctccgccagctcggggcgcgggccgcccttcggatacccagccgctcggcgcgaagtgcccccacggaaggggaccttggtaccagactgaggcccgtctcgccgagtacggttggccacggaggtggagacatgctgctctcaacccacgccgcgcaggtggtcgccgagactcgacccacgccgaggctcgtgctctgggagacgactcaggcgtgtccgttggcctgcgtgcactgtcgcgccaacgccatcagcacgcccgatcccgacgagctcacgaccgccgaggggttcgccctcatcgacgatctcgcagctgttgccggcccacgtccggtcatcgtcttcaccggcggcgatcccctgagccgacccgatctcctcgacctgatcgcccacgccgcagctcgaggtctccacgtcgccgtctcgcccgccgtgagcgagcgcatcacgcctgccacgctgaccgcactctacgacgccggggcgcgcgcgatctcgatctccctcgacggactcggcaggaaccacgacgcaactcgccgcgttcccggtcacgcgctgcgcaccctcgaagcgctcaccatggcacgctcggtcggtcttcgtgtgcaggtcaataccacggtcatgcgcaccaccgtcaatgacctccccgcggtcgccgaggccatgctcgcgcgcaacatcacaacctgggaggtcttcttcctcgtgccgaccggccgcgcgagcaccgagctcgccctcaccgcccacgagcacgaggacgtcgcgcgcttcctctacgaaaccaccggctacggcttcatcgtccgcacggtcgaaggaccgttctaccgccgtgtcgccgacgccattgcaaccagcaacgacgcagccctcgcccccatcggcgagctcggcgagcggctgatcgccgagctccatcgccgcctcggcgatcctggccctcgtcgccgtccgtcaccgcacccggtgcgcgacggtgatggcgtcatcttcgtctcacgtaccggcgaggtctacgcctcaggctttctccccgttcgactcggatccgtccgcgagcgcagcctcctcgacatctacgcctcggacccgttgctcgacgccatccgccaggccgcactccccggccgctgtggccagtgcgactgggccaaggcctgcggcggctcccgtgctcgcgcctgggcgatcaccggcgatccgctcgccgacgaccccgcgtgcgcgctcgtgagcgcctgaggccccgaggcaggtcggtaccagtccggagccagcggctcgcgactgcccgtgggctcgcgcacgcctcagtcgacccgcaggccgccgctcggcgcgtcacaaaaccgatcgtgcacccagggcgagcgcagctctcaccggccccaccaccgaacagaactgcagcttccggctcgggctacgcggactgcgtggatccctcaagtccgcgctctcgccgccacgccgccgcgacggctgcgatggcctcgagcgcgtcgtagtgctggactgcgtcggcagtcgcgaccgcgccgagcggctccccgaggaacagacggcgcaccggcacctccagcttcttgccgttcaacgtcttcgggatcgccggcacagggacgatgcgatcgggcacgtgtcggggcgacagctcccgccgcagcgtggcacgcagccgatcgtcgagtccgtcgacgtctccggcgtgcacgaacacgatcagttccccgggtgtgtcgagcgatgaggtgtcgacgacgagcgcctcgacgacaccgtcgacaccttccgcgacgcgatagaactccgccgtccccatgcggaccccgccccggttcagcgtcgcgtcggagcgaccatggataatggccgaccgatcgtcgaagaaggtcacccagtcaccgtggcgccagatccccgggtagcgatcgaagtaggccgcacgcagccgctcgccgtcgtcgtcgccccagaacgcaaccggcatcgagggcaagggctggcgaatgacgagttcgcccatgaccccgatcacctcacgtccctcgtcgtcgaaggccgccgcatccaccccgagcgcgggtgcgctgatacgtccttcgagcgtcgggctcaccggcgacgaaccgaggaacgcggtgcacacgtccgtgccccccgatcccgacacgagctgcacgttccccggcacgtgctcgtagacccaacgaaaccccgcagcggtgagtggtgcgccggtcgaggccacgacccgcaaggagtcgagcgtggcttcgtcgcgaggtcgaacaccggcgacctcgcaagcacgcagatagggcgccgacacaccgaagtacgtgatgcggacctcgtcgacgagccgccagagacggccaggatccggatgctgcggagccccgtcgtaaaggacgatcgtgctccccacgagcagaccgcccatgaggtagttccacatcatccacccggtcgtcgtgaaccagaagaaccgagaaccctcgccgatgccggagttcaacgcgagcaccttcttgtgctcgaggacgatgccaccgtgggcctgcacgatcgccttcgggataccggtcgtgccggacgagtagaggatccacagagggtcgttgaagccaacgacgaccggggcgacggggtcattggcttcgagcgcatcgaaggccacgaccggcacctctgtcgctggtggctccccgtcgcagagcacgacggtggtcaccgacggcagcgactcgagcacctcctcgacgacggcccgtcgatcgagctggcgtccctgccacagtgacgacgtcacgcagacgaggatcgtcggttcgacctgacggaaccgatccacgatcgcccgcgggccaaagtccggagagcagcatgtccagaccgcacccaccgtggctgtggcgtgcagggcgatcgccgcctccagtcggttcggcaggatcgccgcgacgcgatcgcccaccccgacaccgtgagcgacgagccagcttgcgacgcgatcgacctcggcccagaacgaggaggctcgaagcgtccgtacctcgccgtcatcgcgaacctcgacgatctcggcagggtcgacgaagcgagcacgcgcctccgcgctgtagttgagccgtccctccggaaagaatcgtgcgctcggcatggcaccaaccagatcgaccgagccaagatcaccctcgagaccgcacacggcggcgacgtcgcgccagaacgccccgagatcggccaggctggccgtgtgcagagcgccgtaggtcgcaagcggcgatccgtggcgagcctccaggcgtgcccgcacggcaccgatcggaccatcccatgcgtcggccggcggcgaccacagcactcgtgcctcatcggccatcgcctacctccccggcctcctcgagggccgccgccgcccgctcgagcgctcgttgcgctctggccagcgctcgttgtcgagcccgttcctccgcagggtcctcgacgtcgagcaagcgcgcgacgaccagctcgtccaagcggtcggcgacggcgcgcagcgcctcgagcacctccccgacaccctcgtccacgtctccctcccgatcgctcgcagactaggtgacgacgatgagctgcccctcggtgaaacgctggcggagcaccttcttgtcgaacttgccgaccgaggtcttcggaatctcgtccacgaacgcgaaccgttccggcagccaccacttcgcaactcggctcgcgaggaacgctcgcagctcgtcggtcgtcaccgtcgcgccctcgcgcagcaccacgagcgcgagcgggcgctccacccacttctcgtcggggatgccgataacggcggcctcggcgacggcaggatgcgccatgagctggttctcgagctcgatggagctgatccactccccgcccgacttgatgacgtccttggtgcgatcggagatgcgcaggtagccctcggggtcgatggttcccatgtcccccgtgcgcagccatccgtcgtggaagcgctccgcatcgtcgaggtgatagtaaccagccgtgatccacgggccacgcacctcgatctcgccgagcgcgaccccgtcacgcgggagagcggtaccgtcctcgccgaccacacgaagttccacgccgggcacgggtttgcccgcggtcgcgaagtagtccgccaagcgatcgcggggcgtccccgcgggcggcaaggcgagcgtgcagatcggcgaggtctcggtcataccccatccagagatgagcgccacgccgtaacgctccaggtaggcctcgatgagcgcccgcggcgtcgcggatcctccagaggtgatcgatcgaaagctcgacagatctgccggatggtcctcgaggtagcgcaacaactcgttccagatcgtgggcacgccggaggccatcgtcgggcggaaccgctcgatcatctcgacgagcggcgcgggctggaggaagcgcgtcggcatgaccatgtccgcgccactgacccagcacgtgtagggtgcgccccacgccgccgcgtggaacatcggcacgatgatgatcgcggtgtccgcggccgggtggaggaggtccatggcgcgccgtccgtagagcggtcgtgacatctccgcatggaggtagatggaccggtgcgagtagacgacgcccttcggattgccggtggtgcccgaggtgtagcacatcatcgcggcggcggtctcgtcgagctccggccacggatagggatcgggcggctgggcctcgagcaacgcctcgtagtcgtggacggcgaggtcggggcgagcccgcttgatggcctcgagcacccccggatcgagcacaggtccgacgatcacgagatggcgaacgctggtggcctccgggagcaccgcctggagcatgccgagcacgaggttgtccgcgatgatcacgaggtcctcggcgtcggccaccacgaagcgcagctgatcggggaagagacgcaggttgagcgtgtggacgacggcccccatggacgggaccgcgaagtaggcctcgaggtgcgggtgatggttgaacgagaacgtcgcgacacgatcgccgacacccaccccgagaccggcgagggcgtgcgcgagacggtgcgtacgggccgcgacctcgccgaacgtgaacgatgccacccagccagggccgaggtaggtgtggacgtgcgcatcagggaactcggtcgcgccgtactcgaacatctgacgtacgccgagcgtcccatgctgcatggtcgagttcaccagcacctcctttgtcaccgaccatgctgccacaacccctcgaccatcgccacgcaacgcagggaccttcgtcccttggcgccgcgaacacgctcgctagactcccacgcgatggatcgagtggtggtggtcggcgccgggatcgccggcatgacgatcgccgtcgagcttgcgcgccgtggcgctcgggtccaggtgatcgccgatccctcgcgatcgccgacgacgcccgtcgcagcgggcatgctcgccccggccgccgagaccgacttcggcgaggacctgctcgtacggctcgagcaggacgcgcgcaccgcgtgggaagctcttgccgcaacgttggagcgcaacggcgacaccgacgtgctcttcgaggtccgtgggtccctggtcgcggcccagaccccaggtgacctcgatcaccttcggcgcatggtcgatctccagcgtcgcttcggcatgaccgcatccctcctcggcgcgcgtgacttggtcgacctcgagcctgcgctctcgagccacctcgctgggggcgcgctgctccccgacgacgcccaagtcgacaaccgccgagcgctcgcggcctacgacacctgggcagccaagctcggtatcgagcgcatcgaagccgcggttcgtgcggtgcatcccgacgccgtcgagcttgccgacacctcacgcctccaagccgacacggtcgtcgttgcagccggatcgtggctccgcgacctcgtcgaggtcgcactccagccggttcgcggcgtcaccattcggggcacgctccccgttggcctcgccccccgtcactgtctccgaggagagctccgcggccgcagggtttacatcgtcccacgcgcgtcacacgagatcgtcatcggggccacatcggacgaagcgcccctcaccgaccgcgacccccgagctcgcgatctgctcgatctcctcgacgacgcgcgcacgctcgcaccggccatgggcgagctcgcggtcaccgacgtgtcggtcggctttcgccccgcgacgcccgacaacctcccgatcgtggggcgcggagacgacggcgtctgggtccacggcggccactaccgtcacggcatcctcctcgcgccgttcacggcgactctgcttgcggacgccatcgtcggcgatggtgtcgatccgaggctcgcagccctctccccgactcggctcaggtcgcgcgcatgaccaccctcgtcatcaacggttccactcgaacggtcgaggcgaccaccctcgcagaactcgctcgcgagctcgagctcccgagccgtggcgtcgccatcgcacgcaacgaggagatcgcgccgcgcagcacctgggatgcggtcgcccttcgtgacggcgaccgcatcgaactcgtcaccgccgtacaaggaggagcgtcgtgacggtcaccatcggacggctcacgctcgcctcgcccctcatcctcggcaccggtggcgcacgtcgcctcgacgatatcgaggccgcagtcgtcgcatcaggcgccagcgtggccaccgtcgcgatccgccgctaccagccgggggcgagctcggtctacgacgtgctcgcccgccatcacgtcaccccactccccaacaccgccggggcgcactcggcgcacgaggccatcgtgctcgccgagctcgcacgcgaagccctgggtgtcgactgggtcaagctcgaagtcgtgatcgacgaccggaccttgctccccgacccgttggagctggtacgagccacggaggcgctgagcacgcggggcttcgacgtgctggcctacacgaacgacgacccggccacggcacgactcgtcgaacgcgccggcgcggtcgcggtcatgccgctcgcgagtccgatcggatccggtcttggcatccagaaccctcgcaacctcgaggccatcgtggccgacgctggtgtccccgtcgtcgtcgacgccggcatcggggctccctccgacgccgcgctcgcgctcgagctgggcgccgatgctgtcctcgtagcctcggcgatcatgcgcgccgaggaccctgcggtgatggcacgagccatcgcgctcgcagtcgaagcgggcgcactcgccaggcgggccggacgcataccggctcaacccctcgcggtcgcgtcctcgcccgtcgagggcctgcccaacgtctcgctctagagcgcgtcggccacgttcgcacaaaggagaccgtgatgacccctacccccgccgtggcactcaccatcgctggctccgactctggcggcggagccgggatccaagccgacctcgtgacctttgccgcgttcgaggtccacgggacgagcgccattaccgccgtcaccgcacagaacaccgtcggcgtctccgcggtcgtcaccatcgaccccgacgtcatcgaggcgcaagtccgatccgtgaccgacgacttcatggtgcgtgcaacgaagaccggcatgctcgccaccgcgccgatcgtcgagcgcgtcgccgcgctcgctgcctccggtatcctcggtcctctcgtcgtcgaccccgtgatggtctcgacgaccggcgcgaccctgctcgatgctgacgccgtgcaggctgtgcgtgacgccctcctcccgagtgccgcgctcgtcacacccaaccgtgccgaagcggaactgctcacgggcatagccatcacgagcatcgaggcccagcgtgctgctgcgcagcggctggtcgaactcggcgctcgcgccgcgctcgtcaagggcggccacctcgacggacccgatgcgatcgacatcttgttcgacggccgcaacgtcgtggaactgcgcgcaccacgagtatggacgcgcaacgaccacggcaccggctgcacgctctcggctgcgatctgcgcgtgcctcgcgcgcgggctcacgctcccccgcgccgtcgaggaggcgaaggcctacgtgactcgcggtctcgccgacggcgccgactggggcctcggaactggacgcgggcctttcagccatttcgccaagggccgcccagcggtcgtggcctgagaccactcacccgtaccactcacgccacggagctcgcaatcgactacgataacggagcattgctgccgctcaccgtgagaggtcgcgctcagtcatcaggagcgtccatggaacccaacgtcgccacctctggggcaccgcacgagcggaccgcaaccgcggtggtgcgtcggagcatcgccggcccgcctgatcgcgaactcgttgcggcgctggcggcgctcgcagacgcgatcgaggccatcgactcttccaccaacccggcgctcgtcgacgccgcgacccgcatcggtgctcgcctcgactacctcggtcatcggccgagcaccctcgtggccctcctcgccgcactggcggagagccttggtcgtcacaccacggccgacaccgcggtgatgcgagccctcgcgatcgcgacggatgccctcttcgcacgccgggagcgcgaactcgttcgtctctccatgctcgcaacccgcgatcccctgacggggctcccgaatcgtcgagcgttcgcagacgccctccagcgatcgtgggcacgcgcgaagcgtacgggtgagcgcgtcaccgtcatcgccctcgacctcgacgacttcaagcacgtcaacgacacgtacggacaccgccgtggggatgaggtcatggccgagttggcccaccgcctcgccaaggccgtccgcgccaccgacgtggtcgctcgcaccggcggggacgagttcggcctcgtcctcgaccccacgggtgaggaggccgcggtcgaaccggtgctggcacgcctcgagcgcgagctccagcgcccactcgcaaccctcgacggtggccgtctcctcgcctcggcgggcatcgcctcgagcgatgctctcaccatggaggccgatgcgctcctcgacgctgccgaccaggccctctacgtcgccaagcatgctcgcccggtcgagaacgaggtgctgcgcatctcctactggcaacgaacgggcacacccacgacagggcacaggctcgcccccccacacccctccgaaggcatctcggtcgtgtatcaacccatcatcgatctcgccacagggcggaccgttcgcgccgaagcgctcgcccggaccgacgcctcgtcggccgtgcactccgtggagtcgctgctccaggccgcgacgcgagccgagcacgcacgcttgcatcgccacatcgtggcactcgtcctcggtgacctcgccgccctgggacccgatgcacgggtcagcgtcaacgtggacgcgggcgtcctcgacgatcaggtgctcacgaccacgctgctccacggactcgaccagctcgcacctgggcaactgcgcatcgagatcaccgagcgcgacatcttgctcactgctcatggagacgtcgttcggcgcctccgcgagcacggtgcgaccatctcgctcgacgacttcgggaccggctttgcgagtctgtcgcgcctgctcaccatccccgtggacgagatcaagctcgaccgcagcgtcgccgctgatcggcagatgggatcggtggcgagcgccgtgctcgcgatcgcggtggcactcggacgcgctctcgacatcgacctcgtcgtcgagggtgccgacagcatcgagcgtgccgcgcagttccgcgcgatcggcgtgccgctcgcgcagggattcgcgatcggcgagccgaccgcgtcgctccgccaggcactcgacaccaccatcgatctcgacacgctcgatcgatccctcgtctcgcgggacgtcgccgatgcgcgggcgagcatgtgggagcaggcgatcgcatgcttgctcaccgccgagcccgatggcgacctcaccacctgtgtcatcgccgccgacctcgacgagcccagacggcgagcacacctggagcaccaccgcatcatcgcagagatcctgggccgcgcgggcgtcatcgacctgcgccgcggtgccgaacgcgtcccatcgccatcgtcagcgcggcgaggaccctcgtagcaccctaggagtgtgcgcgaggacggctgacgctctcgccgaccgtcgccgcccggttccgcagcgcctcagctcgtggtgggggtcgcgcgccgagcgagcgcgacggtcctcggagccacgaacccgatcacagcctcaccagcctcgctgaccgcaagcagcgcccgtgcaagatcggagcgcacctcgaccgtctcggttgcgacgacgtctgccaccacgcgcgaggcccccacccacgcttcgtcaaggtcggcgcgaagccgcgccggcgcctcgaggtcggcgaccaagcgctcgagctctgcgcgaaacaccgaggcggccgacgtgagtgcatcgcgattgggcaccaccatctctgcgacacgagccccatcgctccgcgctacgcgggttgcgtcccggagcgaccccgaaccgagccaccaggctgctgggtgtccgctgtcagcgaccagcacgcgacccatcgcagcggcgaggaggtggggcagatgagacaccacggccagcgtctcgtcgtgcgccgtggcatcgagtgcgaccaccgcacccgcgcccgcgtcgccgaagacgaactcgagcgcggtcgcgacatcgtcgtcggactcgctcccatgaaggacgaaggcccacgacgcaccgtcccagatcgatggatccgccgatgcggcgccatggccctctcgtccggccatgggatggacgctgagatggcgtaggccagccggtgcagcgtcgacgacggggcgcttcaccgaggcgacgtcgagcaccagacctcgcgccccccgctctccgagcgcgcagagcacatccccgaccaccggtgtcggcgtcgcgacgaccacgatctcggctgccgagacggcgtcccagccgaccgtcgccgaggtgcgttcgcgaacccaagcgaccgcctcgggatcctcgtcgatcaccgcgagtgggccacggcgaccgagccggagggcgagggaggcaccgatgtggccgagccccacgatcccaacgctcggacgcccgaactcagccatcgtgcgcgagaccatcggacggcggtgtcggcctcggcacgacgacctctggtccctgccagcggggataggaaccgagcagccgcacacgatggccgagccgggccagttcgccaagcgcatgctcgagcccagggtcagccgcatgaccccgtgtcccgatcaggaagtagtgctcgtcgccaagcccgaggggtcgcgagacgatcgaggtcagattcacgcccgctgcggcgagcacgctcgtgatctcggcgagcacaccgacgacatcggcgcgtggcacgacgacgagacgcgagcgatcgtcgccagtgggcgccgggagttcgtggccgatcagcacgtaacgggtgcgaacctccggaatgctcgtcacggagtcctcgagcgcgatcagctcagcctggtagccaacctccggcggggccagcgcaacaagcccaggacctgcgagcgcgacctcctgacaggcgtgacgcgtcgagagcgcctcgcgcacctccgccccggtcgcagcgatccacccagccgccaacgcaaggatggcaggatgggagatgacgacgtgggccgacgcccccgcgtcagcaccgaaggcccagatgggctcggccagcaccgcctcgccgaccacgagcacgcgtgcatcgacgagccgatcgagggtcgcggcgagttcgccctcgaggacggtctcgaccggtacgacgccaagcagtcccggggtcgcctcgacggtcgagacgacctcgtcgagcgagatcatcgggagagggtcggcgtccgcgagtccgaagagcccgagcgaacgatggctcgagctcccgagcggctcggcaaacgccaccatgcggcctgggcccatccaacctccttggttggttcagcctacctggcaccacggcgccaccttggttaggcgaccgcttcgtcctggggggcaccatggcgccgcacgagcgcgagcagtccttcgaccagttcggcgacgagcgccgacgcggtcggatcgaccaagcgccccgacgcatcgaagcgccgttcggcctcgttgatgaagacctccgggcgcgcgagcacgaccgagttggttccgtggaggacctgacgcaggtgcgcctgcgcgcgaaccgtgccgaagaggcctggagcgacaccgaggacggcaaccggctttccgatcagcgcaccccgaccgaacgggcgcgacaaccagtcgatcgcattcttgatcaccggcgtgtaggagtggttgtactcgggggtcgcgatgatgactccatcagcctctccgaccgcggcgcgaagccgtgccgcgctggcgggcaggtcacgttcgagttcctcggcgtagaacggcacctgatcgagacgatcgaacacctcgtaggccacgccctccggcaacacgtcacggatggattcgagggccctggtgttccacgatccccgacgaaagcttcccgacaacccaacgagctgcatcactgcctcccctcatatggtggtcgccgccgatcgagcacgcctgcaccggcgctctcagcacgagctcaccgcgattgcttgcacgtgcaatcagtctagccgcagatgctcgctacgctctccccatggcacgcaccgtccgcctcgagggatccgtcgctgaagtcgtccgaacctgcctggtctacttcgtcgcgaccgcgccgagcgaccctcgcggccacgtgaactgctcgccgcgagcgaacgacggcacgttgatcctcgacggccccgatcggcttcgcatcgtcgacctcgtcggttccggggcggagacgatcgcacacctgcgcgacaacggccgcatcacggtgatgatcgcctcgttcgacaagcgacccctcgtcgtccgcatctacgggcgggggcgggcccgctcaccgctcgacttccccgagctcgcctccacgctggtcggcgtgcgtgctgtgctcgacatcgcgatcgaggaggtgcggacctcctgcggctacggcgtgccgatcgccgaggggctgcggccccgcccgcaacttggcacctggctcgaagcgaagggtcccgagggcctcgccgactacgtcgcccgccacaatcgctggagcctcgacggcctcgcgagcatcgacggcacctggccgagtgaggcaccgagctcgtagcccccgagcaagccgctcgcccgcgcagccatcaccgtcgctcgatcgagcatccacccagacccatgacccggaccatcgagcgcgaccagcccgttcaaccaggctccgaccccagctgccagtgaaggccggtgcgcgagcaccctggcaccagccgcgaccgcccgatctgcgagccgaggattccagagggcagctcgatggaggagtgctgcgccagcgaggaacggcgccatctgggcctcggcccaacgaccgtaggccggtcctcctcccagcggtccccttgcaccgagagccgcggctgcctgggccccagaagcgagcgccgcccagatcccttcgccttggagtgggttcacgaaacccgcggcgtcacccaccaagagcacacgaccgcgccacggcgccaccccgatcccacccatccgcaaccagccaccgagcacaggagcgtcggccacatcgacgagtccgatccgaccgaggtagtcatcgagcaaggggcgcagccctcgcaggcgtgctcgctctcccccaaccgcgatgcccacgcctacgttcgcgatgccatcggcacctcgaaaggcccatccgtagctcgcgaacccactcgcctgcgcaagcaggtcgactcggtcggcatcgagcgtcgacgacgcaacgtagcgacgcagtgcaaagccccacagcgcccgtgtcggtgacgccgcccccaccgaccgcgcgactgtcgacagcgccccgtcggcaccgacgacggcgtcggcgtcgagcacgccgtcgtcgaggtggacccgcacaccgtcagctccttggacgagaccacgaacccggccgacgatggcacgggcccctgccgcgacggccgcgtcccgcagccatgcatcgaagagccgcctcgtcaccatccgaccctcgccggggtgcgcgagacctggggatgccggcaagtgcaggcgcgcaccctcgacccagacgtccaggtcgccgatccggggccactcgggctctggcgtgagccctacggcggccaaggtcgcgagcgcctgaggaccgaccacgtcaccacatgccttgtcacgagggaaggtgctgcgatccacgagcgtcacacgccagccggcgagcgcgagctgtcgcgcggcgatcgaccccgcaggaccggcaccgacgacgacgcacgacgggagaggactcatgggtccaggctacgagggccccctacgagaacgacacttggagcagtcgaacctggaggcgagccccaccgggaccgggcgtgggatctttgatcccgacctcccagtaggacccatcggacccggccttcgacgcgatgatcgtggtcgccgtcgacgacgcgctcgccgactcgacgtgccatccctcgtcgggcagtgccgcgacgaagaagttgcgaatctcggatggcgtcaacgccgaacgcaaccagacccacgcgtcgaactcggtcccgtagggattggcattatgacggcccgtgatcgttgcgtcggcggggatcaagatggtgcgctcgatgttggcggggatcacgttgccaggatcgagcccttgccacgccccgagtgacgtcgtcgctgagtatggaatcggcgaggaggcctcctctccgccaccagacggaatcgccgcgagcgagccgatcgccgcgacgaggatcgcagcgataccgacgccccagccgagaaccttcttcgaacgaggtgcgagcgccatggtgttaccagtctcgcacgagcgcgcgccgaagcggtagttcgagggcgccgacacagtaacctgatctgtcgcggcggcgtggccgagaggtgaggcagaggcctgcaaagccttgtacagcggttcgagtccgctcgccgcctccacaatcgggcgtggggcagatcgcggcacgcatgtcggatcatacgcgatcgccatggtcgccccacgctccacgaggcgtcgcaggtgcgagaggacgcattggtcacgctctctccggtcggacctgcggcccgcgtcaccggtcgccatcgatccgcgcgagtccgacgcacgatgacaacgccagcgccgcaacgtggctcaccgacgaccgaccacgacgtgtcagggcaaacgccccgccacgcccacgaccttcgtccatcgttgcgacgcaaccacgctgtacacttgagtgggtgatcgagatcgcgtcgacaatgagcgatcccgacgcctcgtgaaggaggtcgacgtgcaggatcgcatcttccaggttcggggcatgacgtgcgaccactgcgtacgcgccgtgcgaagcgaagtcgctggcgtcgccggcgtcgtcgacgtcgacgtcgatcttgccaccggcatcctccgcgtccgaagtgacgcgcccatcgacccagatgccgtactcgcggcggtcagggaggctggctacgacggtgtcgccacagactgacgccccttccgggcctcacgaggaggtcgctctgcgggtcagcggtatgacctgcacctcatgcgcgctgcgcatcgagcgctcgctcgacaaactgcccaccgtcgacgcggacgtgaacttcgcaaccggcaaggccgaggtccgcttcgatcccgccgtcgtcgatctcgccgaaatccttcgtgccgtgcgtcgcagcggctacgacgccaccgtcgccctctcgagcgacgcctcgcctcgcttccactggtgggcgatcgccctcgcggcgctcgtggcagccggagccatggtcgcgccgccgacacagctcgcacgcgatgtcgagttggtggcgaccctcgtcgtcctcgcaacggcaggtcgcccgttcttcgtcgcggcctggaacgccgctcgacaccgcagcgtcacgatggacaccctggttgcgctcggcgctggcgtcgcaatgacggcgagcgccatcgtcaccgtcgcgggcctccagcacgagccgacctacttcgacgctgcagccatgatcgtcgccttcatcgggatcggcaagctgctcgaggaacgttggacgcgtcgcgcgcgagcaggtctcgacgctctcgaagagctcagccgtcgaaccctcgcgcgcatcgacgacgacgggagcctgcacgaagttcccctcggcgagctcgaggcacacgaccgggtgctcgttcgcccgggcgacatcgtcccggcagacgcgcgagtcctcgacggggatgcggccgtcgatggcgctcttcgcaccggacgtcgcgatctgcggcgcgtcggccccggtgacgaggtcctcggcggtgacgcggtcgtcggctcgtcactcacgatcgaactcgatgcacctgcccgactcggcctcgtggtcgagctggctcgtctcgtcgaggtggctcagcaccgccgggcacgtctcgcgacgctcgccgatcgcgtctcggcccgcttcgtcccggccgtgattgcggtcgccgtggtcgtcgcgttcgttcgtctcgccatcggcgcaccggtcgccatcgcactgagtagcgccatcgccgtggtcgtcgtcgcctgtccgtgcgccatgggtctcgcgaccccgatcgccttcctcgtcgcgagcacgcgcgcggccgcgcgaggaatcgtgctcgaacaccccgatgccctcgagcatgccacctccatcgatacggtcgtgctggaccgaaccggcacgatcaccgaggccgatctcgttgcccactggcccgagcgcgtcgctctgtccgagcgacgcctcgtcgcggcactcgctgcgcgctcacgccatccggtctctcgagcactcagtcgagtcgagggcgacccggcgaacgccagcggcgacggcaacgaccccgagccggtggtcgagcacgttgtggagacgccaggcgtcggtgtcacgggacgggtcgatggacacgagatcgccatcggctctcccgcctctgtcggtgcgaccggcgtggaccctgccgcgagcgagcgagcagtgttcgtccgcatcgacgaccaatcgcctatcgtcatcgaactcgccgaacgcacgcgcgagggcaccgcagcaacggtggcggcactgcaccgccttggcgcgagggtcatcctcgccaccggtgacagccgcccaaccctcgcggacgaggcgcgtgagttcggcattgacgacgtcgccatcggcctcgatcccacggccaaggtcgcgctcgtcacgaagctgcgcgctgacggtcaccacgtggccatggtcggcgatggcaccaacgacgccgccgccctcgcaaccagcgatctcggcatcgcactcggtggtggcacgcatctcgctcaggccaacgcggacgccgtcctcctcggcgacgatatcgccatggtgccgaccgtgctcgatctcgcgcggcgcaccgtacggacgattcgccagaacctcggatgggcactcggctacaacgtcatcgccatcccggccgccgctgcgggtctgctgtcgccgatggtcgccgccgcgctgatggcgatgagttccctcgtggtggtgggcaatgccttgcgtctcgacgtacgcgagtcggcgggcgcatcgggaacgactgaggtccgctagagtggggccccatcgggccgttggcgcagctggtagcgcacttgcatgacgcgcaaggggtcagaggttcgagtcctctacggcccaccatatcgccgttttcgaacgcatggtcaagagcaggtcgaaggctcctgtgcaggtagcttcgacgtcgtgtccatcgtgcacgtggagctcgtccaagatgctcacgtcccaccgatggtgtacattcactcactggcactccctggccgccctcggcctactaccgcaggctcctcctcggcaagcggctcaagcacgggaggagtgctcgtgggccgaagcgtctgcgaggtctccttcgtgtcgtcgtggccctcctgtgtggcaccgagctctgccatggactcctgcaacaggtcgtgccactcggcaacggcccacccctcgtgctggccgagcacgacagcggtgacaggcggaggatgacggcgtcgtttccgaagaccccgacgacgtggtgcgccgcttgatctcgtggttcaaccgctctgagcgggttcgtcgaccagatcgttcgccagtggcgctctgggaagtgcgtgaaggtgtgagacctcctccttggcctcggcgagcgtggtagcgaccacggggagcgtgggggcaagggagtcgatgacctggtcgcactgggtacgtagcgctgccgggtacggctcgagcgacgatcgtacggatcgtgaggccaggaccatctccttgagctccccttcttcgatgcgagcgagcacgtcgcgcacgttgcacgcagtagctgtgccagctcgccccgacgacgcacctcgcgatggcttggtgaacccccgctctggcatcggagatgacgaggcgcacaccactgagacctcaagatccctgagctccctcgagaacctctcggtctgcccatccccgacgcacgaccccaaggacctcgtgcgtctcacgtggcatgcacgcccgtcgtgaccacgacggcacgggagatgacctggtgggcaaggcggccgttcgcgtcggtggcatcggcgacgagggagcagaaggcagagatggtccagcctgcggctacgaaaccccgccagctcctcgtctgaggttgcgatgatgcgagagacctcgctctctgtgacccccgttccaccgagggccgcgaccaggtcatcgactttgcggtgctgacgccctgagacgtaggcctccagaacctcgcacgtagagagcacgatcgacgcaggcggcgacgctcgcagatgctcgggacacgctcccctggcggagctgtgatggaagttctgacacgacgtctcctccggtgcccgggttcgcatgcgggcgcggaacgaagacggtctgccatatgggttaccactacctgtgggggtggactcggtctttcccgcgaacccggtggcaacgccgatgtcgatcccacgctcccttggcaccgggccgtcgaaccgagacctgaggcaagggcgccgcgaccttcggcgcgactaccgaccggtagacgcggatggcggcgtgctcaccctcggagaagccctgctccagggtgcgggccggggtcatgatccccgacgcgacggagcacgagtcggacgtccggaaccgtcgatttccccgagacccagccacgcgacgcgaacccacacgtcagtgaggttcgaacacgagtgactacggctcaccaggagaagtgtaccgaatgtggtacacgtcccgcatgagcaagatcgtccccattcgcgagcttcgcagtgagctcagccaggtcatcgaccaggttgccgacctgcgcgagcatgtcatcgtcactcgccatggtcggcccgcggccgttctcgtcccagtggatgagtacgaggccctggaggagacggctgagatcctctcggacaccgagacgatggccgcgatcgacgaggggcgacgtgaagtagagcgtggggagaccctgacgctcgacgagctccgccaagaactgcagtcgcgccgtagaggatgagtcgggtcgagctcgcccggcgcgcccgcaaggagatcatcgacctcgactggccactgtccgacgcagtggtcgaggctctcgggctgctcaagcgcgagcccgaggcaggtcgcctccttcggggacggcttcggggactgtggtcacttcgagtcggtacgtatcggatcatctaccagctcgacaatgatgagcgcgtcgtgcgcgtgctcgctgtccgccaccggtctatcgcttccacgaccgatccgcgctgacagtcagttcctggggagcgacccgatccgttctcggagatcgtcgaagttcgaatgcgagtgcctacggcccaccgcatgtcgacgtcgtcgtcaaacgtcgacacagactcgtcatggagatccaaggactctcgggagcccgcgtctcatctcgccgctttgcacgtgaacccgtcgaacgcgaccgccccttgcagcctgctcgaatgatcgcacccgagacgagccgcgatcgcgcagcaagtcgcggagcgttgaggccgcagctgtccgccttcgcttcgccagacagtgctatcgaccctcgtcgtgggaagtacccccgctgcccggttgcggagcgatcctggcgtagacgctcctgggcacctcggtcatgtcccgcacctgttcggcgttcacgccagaggcgattggcgcctccagcccgaccgcgcgacggccgatcacagcagcacggccggtgagccgtggcacgtggcgatctgatcgccatcagatgagacgcgcgcatcgagcccgagccatgctcggccgggttcacggccccaccactctctgccagtccgtcggccgggccaggacgccaccgtctcccatcccggcatcgaagccctacgtacgagacacggcatgcgctccagcttctgcgccactgcgaggccagcgactcatcggatcacacagccgctggcccgcccaaggtctcgacggtaggctcgtcccatggcctcgagtacgtacctccatggccaccacgagagcgtgctggccgcccatcgacggcgaaccgccgagaactcgtgcgcgtacctcctcgaccatctccaccgcggtgccacggtcctcgacgtgggatgcggcccgggcaccatcaccgtcgacctcgcacggatcgtggcaccaggcacggtcgtcgcgctcgacgccgagatcggcatgctccaagcaacggcggcgctcgccgcagagcgtcagctggacaacgtgaccgtggtcctcgctgacgcgatggccttgccctggcccgacgccaccttcgacatcgtccatctccaccaagtgctccagcacgtccccgatccacgcgcgctcctgcgagagtgtcgacgcgtgtgccgaccaggaggcatcgtcgcggcccgagacgccgactacgcgggcttcctctggagtccgctcgatccggacctcgaccggtggcagacgctctacgagcaggtagcccgtgccttggggggcgagccggacgccgggcgttacctgctcgaatgggccagcgacgcgggctttcgcgaggtcatcgcatcggcaagcacatgggtgttcgcaacctccgccgaacgggcctggtggggagagtcctgggcgagacgggccctgcagtcgggttttgcgacgacggctctcgccacgcaactcgcccatcgcgacgagctcgacgccatcagccgggcctggttgcgctgggcacacgcgcccactgggtggctcctcgtgcctcacggcgaaatcctcgcgcggcggtgagctcgacgatgagctcgacgcggtgtgcgacgaacgcccttggcggcatcgcgtcgaccggcccccgagaggaagtccacccgtaccctcggcctgacgtcctcgcgtgagcgctcgcaagtcctgtggggaaccacacgagcgcgtcgagagtccgagccctggccgaggccgtgcggctgcgctgttcgcaagtatgtacgccgatcagatcactgcggcgtacgtccctccgcgggcctggctgcgaccacgtcgtagtctccgcgaatgacgaagaacgagccgcggatggtgcctgccaaccgcgaacgctgcctcgcaaacttgaagcgctcctcgagctcgcccggaacgggaactccgtcggccagtttgaagccgaccgcgcgcttgccacctggcgcgagcgtgtagaggacgttgacggccacgccgttgtcgtagaacacgtgcgtccagtcgatgccgtccacgacgaagtgagcgacctccaagggcgtcgcctggatctcgagatcgcgctcgtgccgcaggaggcgtgccacccactcgacgatctctggcgcttcgtcggccgactcgacctcgaacgcgtgaccgtagtgggtcgagaagtaacgcgcctcgttcgcccgcaagccagcaagcgcctccgcatacggcgacgcctcgagtccgtccgtactcacagcgtgaaagtcgacgatccgacccattgcgacctccgtcctcatcgaggctgtccgaccgccgttcgaccgggagcagccagcaagcgccatcgactccgcgtgccactcgagacgaccatcgacgagggagctgcatcggcgcctcccggcgccggagccttgccccgacttcgcctcaccggcgacgagcgctcgcgcgcaccgagcagactactcccgaaccggcacacgggcctcggcgaggcgccatcgcctcgagaggcccggcgcatggacgactcgtgccctccgagagttgcacggctacacccatgctccggcaccttcgtaccgctgcggttccaccaccgctgccatgggccactcaggctgcacctcacgaggcgatcggcgtgcgagcaccagccggtccgagcgcactctcgtctgtgaccgagcgcgacgccgcgggtgctcgccagcaccgctcgcccgcgcaccaccggatcgcacagcgtcagatcgcaagaagcgcatcacgcgccaacgatcgtgccaccgaagccgtagccaaagccgctggagccgtagccgctgtagccgtagccaaagccgaatccgccgaaaccgggggcctggaacccgaatccgttaccggcaaacggggctgtcgcggcactccctgagcccaggccgctcgtcgcgtcgtactgggtggtgaccgtgacggaatcgctcgagggcgacaccgtcggagccgcgatggtcactccctgttggtcgaccatcgaaatggcctggagcgtcccgctcggcagctcagccaacggtgcaccgttcgcctcgacgtggcgcatcacggtcgtcgagacgggggcaaggttcatgatccctgcctggctggtgggtgcctcggtgatccactcggccgaggtctcgacacctgaggccgccgacggcgagagcgtcacgacggtatcgaccgccggcgacgatgaccctgccacggtgagttcgagtcgccaccggtcggtcccgacgggtgtgatcgccgccatgacggtggcgccggtgggaatcgtgattgtgtcgaccgcggcgttcggtagctgctcgaagaacgccaccgtctgggcctcgcccttgggcccaggctcagtgagcgtaccgacctggatcaactggtgtgaccgcatcccgcccagcccgacccactctccgatcgcgctgttcgcagagacgtcagcctgtgtgaacgacggggccgtccagctcgcccggacacttcgctccgcgcttccgagcgcggcgagccccgaccagttctcggacgcgctcgttgcgctcacgagcgaggtcgatgccgagccggacccgctcgatgtcgaacgcggcgagttcgtcgcgaccgaccctggggccgggttcgtgacgacggtggagctcgggtgggtatcgagcccacttgatgctccggccgcgtggcccgcccacgcgaacaccgcaaccgccatcgacacaccgagggctccggcggtcatgctcctccgtacgtttcgagcagttcgcatggtacgtgatctatgcacggtgtcctacctgaccaagaaacccgcctgagaagcttctgggctacgctggcacctcacagagcgctcagcgatcgcacggggcgccctcagtgtggatgtcgcgcgcgccccacccgtccggggtgagtctcgggcaacgtgagggccatcacgacgccccagacgacgaggagcgctgcacccgcatccacggcagcgcggagcccgagcgcttgggcgaccacacccaacacgagcggaccaaccgcgtagcccccgtcacgccagagccgatagaccccgagtgcaccgccccgccagcgcgggtccgcgcgatcgccgacgatggcgatcaggttcggataagcaagtgccatcccgacgcccgtcacgatcgccgcggctaccgcagtgaacggacgatgcgcgagagcctcgaaccccagcccagcgccgatgacgatgatcccaccgacgaccggccagcgccgaccgatcgtgtcggccagaagaccggtggggatctggagaagcccccagacccacagatagacacccacgatcaggccgatcaacgccaccgaatccccctcgtgtaggagcaacagcggcacgaaggctgccatgagcgaatcagcgaacttggtcagcatgcctgcaaccgagaccaccccgagcgcccgatcccgccagctcacgagccatgcaagatggagcagcgacgggccgggtcgcgccgactcacctacgctccccccatctgccgacgcctcgacgagagcatgccctctcgtctcgctcgcaggccacacgctcgccatgcctcctaccaccacgaccacgagcgcgaggatccacggcgccacactgcggccgccttcacccagcagcaatccagcaccaaggccgccaagcccgacaccgacgtagccagcagcctcgtcaattcccaccgcgagcgctcgacgagtcggtccgacgaggtcgatcttcgcggtcaccgccatggtccacgtcagagcctggttgataccgagcaccgcattcgccgcgagcacctcccaccacgcgtgcgccacgaggatgccaacggcatagggaacgccgaagagccaaccgatgcgcaggatggtccgccgcccatggtgatccgacagatgacctgcgacgaggttcccgatcgccttcgtgacgccgaacgggacgaggaagctcactgtcagcagcaccgaccgcacgccgaagacggccgacgcaagaggaggcagcgccactcgttccacgccgatggtcgcgccaaccatgacggtgatgaacgtgtacacgccaaactgccgccaattggccccgagcccgagtctcggagtagcagaaccgcccatgcgcctcattcctacattcaaaccaatgtaagaatgagactagccctcggccacctccgttgagcccgactcgaccgctcgaccgtccacgagccacccgaggaagccgtcctcgagccgtcgcgcctcgatcccacggtctcgcagccaccgcaccgcgatggatgcgtacgcacaccacggaccacggcagtagacgatcacctcggaaccgggtgcgagccgcgtcggcacctctcggagcgcgacgagtggggccggcacggctcctggcagatgcgccgcacgccactcctcctccggccgtacatccagcacgaccaacgacccgtcagccatgcgatcgatgacgtcggctgcacgcagacctgcgagctcctcaggtccgagatacgcagccgcgagcgcctcgacgtcgcgatcgagctgtgcgctcacacgtgtcagctgcaaccacagctcggcgacctcgcgtgaacgcaggcggtagtacacgcgtgcgccctcgcgccgagtcgcgacgagatgagcgatcgccaggcgacgcaggtggtgcgaggcactctgcacgctctggtgcgtctcgcgagcgacctcttccacactgcgctcgccctgggccagcaggtcgatgatctcaaggcgccgcccggatcccagcgccgtcgcaacctcggcggcccggtcgaagagcgcaaccttgacagcatggtcgctctcgagaggggcgtcgctcacgtcgctccaggtccgctcgtggcactgcgccactcgtaccccacgcccggcaccgaccgcaacgcgccctgggccgggccgagcttggcgcgtatgcgcgataccaccacccgcaggtgatgggggtcgtcatagccgggaccccagattgtctcgagcgccatgcgatgggtcaccacacgtccttcgtgctcaacaaggtagcgcacgagatcgaactcgcgtctcgacagcgacaccggaccacgctcgtcgtcgacgacgagacgccgcgcagcgtcgagcgtcagtcgatcactgatgcgctgcctggtcgcaacgacgtgacccgacccctcgaggcgccgctcgagtgcacgcagacgagcttggagctcgagaatgccgaagggcttcgtgacgtagtcatctgcaccgttgtcgagcgcagcgaccttgatgcgctcgtcatgggcggcggagagcacgagaacaccgccgcgatggaactcgcgaagccgcgcgacgagtgccaccccatccatgtccggaagaccgaggtcgacgaggatgacctccggcggatccgcaaccgctcgctggagaccttcgatgcctcgaagtgccgactggacctcgtagccggctgcgtgcagcccaatcgcgagcacgcgcgcaagggcagggtcgtcgtcgatgatcaggatcgaactcacaccaacctcggcaacacgacgcgcacactggtagcgtccggttcggattcgaactcgacgcgtccaccgtgcgcttcgacaaagctgcgtgcgatggcgagcccgaggcccgtgcgacccgagacgcccgaggcgtggaaccagtcgaacaagcctctcgggtcgacatcgccactcataggggcgtggtcgacgacctcaatgagcgcatcgccactttgctccagaactcgcacctccacgacatcgccgaggggtccgtgccgaaccgcgttgtccacgaggttccagacgacctcgcgcagcagggaggcgtccccgagtaccttcaccggcccgtcggcgagcacgcaaacctcagacccgaacccacgtacctcgaccgctcgaaccgcatcgtggaccacctccccaagttcgcacaccacccgccggacccgccgcacgcctgcctcgagtcgactcacgtccagcagatcttcgaccagcgtgctcgctcgccggcactgtgcgagcgccgtctcgaggagctcgtcgtggtcgctcggcgcgatagccgccccgaaggcagccaccgtgctcacggccgtttcgatgctcgcgagcggtgtcaagagatcgtgcgacaccgtccgaaggagtgacagacgccagccgtcgacctgctcgagcgtggcgaggcgtacttcggcctggcgaagccggtcgcgctcgagcgccgccgagagctggtgtgcgacgacctcgagcgcaccgacggtcgcctcgtcgaggcgtggaccccacacaaccagggttccctcgggcccacccaacgtgctcacgatggaaccgcgggcctcgaacccacgctcgcgcagcacgatcgagccccgacccgttgcatccgaggagaaggctcgttgcacacgagcagcgtgctcggcattcgaacccgaccagatcagctcccctgcgccatcggctcgaacgagagccgcgccacctggaccgttgacgcgagccagcgcctcgacggccgcacccacgaggccggccgcgttctgcgcaccgaggagacgctcaggaaggtcggcgagcgcgccgaggatgcgagcctgacggagcgcccgatcgcggcttcgccggaaccgctcatccagcgtgatcgcgattgcgcccaccaccacgtagataccgagggggatccaattgacgccgcgacccaccgcgagggttccatagggagggatgaagaacacgtcgtaggcgatgaacccggcggcgaccgcggcgacacccgcgaccgccccaccgatcgcgacgctcgccactaccgggaccaccagcaccaacgccaccgtcgctggcggcacgaccgcacgcaccggaacgagcgcgacgacacccagtgcgaccgtcacgacaccaacggccgcgcccggatagcgcagcatccggcggctcgtgctgaggagtgacatgcgtctacgatcctaccgatggatgcgatcgacacggaggacgccgaccagcttgtcgccacgcccgaagtcgaacccgtcggccgcttccgtatctacctcggtgccatgcctggcgtgggcaagacgtgcgccatgctcgacgaaggcttccgacggttccaccggggcgcggacgtcgtggttggctttgtggagacccacggccgtgactacaccgcctcgctcgttcgagacctccccgtccttgcccgacgacgtgggacctaccgcgggcgcccggcagaggagttcgatctcgaggccgccctcgcgcgcaaacccgaggtcatcctcgtcgacgagctcgctcacaccaacgtgcccggactcggcgcccacgccaaacgctacgaggatgtcgcgacgctcctcgaagccggtatctccgtcatcaccacactgaacgtccagcacatcgagagcgtcgccgccctcgtcgaggacctcctcggcgtgcccgttcgcgagcgcgtccccgatgcggtggttcgagccgccgatcagatcgagctcatcgattcctcgccacaagcgctcaggcgccgcctcctccatggccacgtctacccgcccgatcgcatcgagtgggcactcgagcactacttcaccacccgcaacctcaccgtgctccgagagctcgccctgcgcttcgtcgccgactcgcaggtcccgaccccaacactcgcggtcgcatcccgggctcgttggcaggcgatcctcgagaccaaggagcgctacctcgccggcgtcacgctctccgcggcgtcgccacgcgtgctgcgacgcgcagcccgcatggcgctccgcagccacgctgacctctatgcgctgttcgtacaccccgacgagtacgatcccacgcgcgatgcgcctcgcctcgacgcgctccgcacgctcgccgccgacctcggcgcgatcctcatcgaacgtgacggctccgacatcgcgacgctcctcgtcgacgaggcccgcgctcgccaagtcacccagatcgtggtcggcgcctcgaggcgccggcgcatcgacgagatcctccacggctccgtgctgaaccgactgctgcgactcgccggaccggtcgggatcgacgtccacgtcatcggcgttcgcgactacgacccgagtccggatgagttcaacggctgatcgccgccttgcgctcgagacgcgcgagcgccatgttgagcgcaaggacatccaccacccgctcaccaaggaacccgaactctggaccagtcgccgtcagagcaaccaagcggcgcagctcgctggccggaactccggtcgcgcggtgcaccatgggcacctgcgccagtgcactcgcgaccgagatctgcggatcgaccccgctgcccgaggtggtgacgagctcctccgtcggcaccaccccttctgcccgccagtacgcaacgagccgtcgcgtcgcactgaccaaggcggccgagcgcggaccgaggttcgtgccgccggtggccatgggatcgtcgccatcgggacgcccatggaaccagcgcgcaccccgccaggtctggccgacgagcgtcgagccgtcgggtgtcaatgacccctcggcctggcgaggaaagaccgtctgggcgatcgcgacctcgatgagcgggtacgcgagaccacacagcacgaggaagaccaccgcggcgcgcaccgagcgcaggagcgtccggatcatgagaacgccctcgtcgcggcgagcacaaggtcgatcagcttgatgccgatgaagggcacgatcacgcctccgatcccatagatgaacacgttgcgccgaatgatcgacctcgccgacgacggtcgaaagcgcacccctcgcagggccagcggaatgagcgccacgatgacgagcgcgttgaagatcacggcagacaggatcgcactctccggcgagtgtaggtgcatgatgttgaggaccgagagacccggataggccgtgacgaagagcgccggaatgatcgcgaagtacttggccagatcgttcgcgatcgagaaggtcgtcagcgcaccgcgggtgatgaggatctgcttgcccacctcgacgatgtcgatgagcttggtcgggctcgagtcgaggtcgatcatgttggcggcctccttcgcagccaccgtgccggagttcatcgcgacgcccacgtcggcttgtgccagggccggggcgtcgttggtcccgtcacccgtcatggcgacgagcttgccgtccgcctgttcctcgcggatgagctcaagtttgcgctcgggtgtggcctcggccaagaaatcatccacacccgcctcggccgcgatcgccgaggcggtgagcggattgtcacccgtgatcatcaccgtacggatacccatcgcgcgcagctgttcgaagcgctcacgaatcccggccttgaccacgtcgcgcaactcgatcagcccgagcacgcgatcgccagctgcgacggcgagcggcgttgctccctcgcgcgcgatcgacgccgacagctcatcgagttcgactgggatcacgccaccctgttgacggacccattccttgaccgcctcggtcgcacccttgcgtatcgagccctcgtcggtgtcgacgcccgacatgcgcgtggtcgccgtgaacggcacgaaccgcagcgacgccgggtcgacgggatcacgaagaccgtaggcgtccttggcgagcttgacgatggagcgaccctccggggtctcgtcggcgagtgacgccaggcgccctgcggcagcgacgtcgccatcggccacaccgccgatcccgatgaaccgtgacgccatgcgattgccaaaggtgatggttccggtcttgtcgagcagcagcgtcgagacatcgccagcggcctctacggcacgacccgacatcgcgagcacgttgcgctggaccatccggtccatgccagcgatcccgatcgccgacaggagagcgccgatggtggtcgggatcaagcacacgagcagcgccacgagatcgacgatcgggatgccgacgtgcgcatagtgggcatagggctcgaggacgaccacgaccggcacgaagatcaccgtgagggcgacgagcaagatcgagagcgctacctcgttgggcgttcgtcgtcgatcggcaccctcgacgagggcaatcatgcgatcgaggaagctctccccagcacccgcggtgacccgaacgacgatgcggtctgagagcacgcgtgtgccaccggtgacggacgatcggtcaccacccgcttctcgaatgacgggtgcagactcgccggtgatggccgactcatccaccgaggcgacaccctcggtgatctcgccatcggcagggatgacgtcaccagcctcgcagaccacgagttggcccgcgacgagctgcgtcgccggcacccgctcctcggttccgtcgtcacgcagacgacgagcttcggtctgcgtacgggtgcggcgcagggcgtctgcttgcgccttgccccgcccctccgccatcgcctcggcgaagttggcgaagagcacggtgaaggcgagccacaccgtcaccagccacgagaacagcgatggatgcacgatggaggcgatcgccgtcacgatggtgccgaggtagacgacgaacatgacgggattgcgcacttgcacacggggatcgagcttcgtcagcgacccccgcagggcgacgcgtagaatcgtgcggtcggtcagcgagcgcgaactggcgaccccacgtacgggcgtggcggatggacgagtgggtgcggtcatgcgaagaacctcccatgggcgacggcctcggcgatcggaccgagcgacagagctgggaagaagttgagggcaccgacgaggatgatgacgccgatcaacagccccgcgaacatcggcgtcgctgtgtcgaacgtgccggcggtggcaggcaccggttccttggcggcgaggcttccggcgagtgccaggaccggcaccatgacaccgaagcgacccagcagcatgacgatcccaccgacgatgttgtagaaatcggtgttcgacgagagcccggcgaacgccgatccgttgttgttgccttgggacagcatggcgtagaacacctccgagaagccgtgcggccccgcgttcaagatcgcggcgcgcgcgctcgggagcgcgatcgcaaccccggtagcaacgagcaccgtgatcggcatgaccaacacacccaccgaggcccagatgatctccgtgcgctgaatcttcttccccagatactccggtgtgcgcccgaccatgagccccgcaatgaacacggtgacgatcgcgaagatcaacatggtgtagagaccgctccccacccctccaggtgtgatgtccccgaaagccatgccggccatcatggcgaggccgccgatgggggtataggagtccatcgaggagttgaccgatcctgtcgacgtctgcgtcgagacgatgttgtagagcgtggagttgtcgatgccaaagcgcgactccttcccgacgaggttgccacggctggccagcgccccggcagcatgctggatcgcggggttcggctggtgttcggcaacgagcgcgaccgcgagggtcacgccaaagatgatccccatcgcagcgaggaccgcaaccccatcgcggacgctcgccaccatgcggccgaaggtgtaggtcagggccaccgggatggcgaggatgaggtagatcgagaggacattcgtgaggcccgtcggattctcgaaggggtcagcaccgttggcgttgaagtagccgccgccgttggtgccgagctgcttgatcacctcctgagaggcaaccgggccacgggggatgacctggtggaccccgttcagggcgtcgacgacgtgcacggggccacccagcgtctcgagagcaccctgccacacgaagaccaccgccatcaccagcgagatcggtagcaagatccacaacacgccgcggacggtatcgacccagaagttgccgatggtggcgcgcccccgccgagcgataccgcgcacgagcgcgatcgcgacggcgatcccgacggcagccgaaacgaagttctgcaccgcgagggccgccatctgcgagaagtacgacatcgtggtctcgccggcgtagttctgccagttcgtattggtcacgaacgagaccgcagtgttgaaggcgagagcaggcggcacgccaacgaggtgctgcgggtcgagtggcaagtgcgcttgggagacgatgatcaggtaggtgacgacgatcgagacaccggagaagacgaggagggagcgcgcatagcgttgccacgactgctcctcgctcgcgctcacgccgacgagcgcgagcacgggccgctcgagtcgaaccaagaggctgtagcggccctcgtacaccccggccatgtacgcgccgagcacgcgccaggtcaccgccaaggccacggcgagcacgatgagctcggtcgcgaacgtcatggacgacacaccacctgttgcatgagtccagcctcgcgccgcgacacgcggagccgacacacaaccggcgatctgtgacgctcctgagacgcgcgaccgcccctgccgtgacaccgccgtgacggcgtgatggtggccccgacctgtagccttgtccccatggttgatcgctcaccgcgaacccgactgcgtcgcttcggcatcgcttcggtcggcgcactgatggtcgagctcgccttcggcctcgcaaccaacgcactcgtgcacatccctgtgcacgacccctggggcggagcgcacccaggctgggtgctctacgtccacgccgcgatcggcttcgcgctcctcgtgaacggcgcgatggtcgtcaacaccgccatcgactccggcgtcccccacgccctcggtgccgcagtcgtcggcgtgctctcgatcatcgccgcaatcggcgccggcatcgccttcgtcaacaccggtgcccagcaccagatcctctctgtggcgatggcgctcgcgttcgtcgttgcgctcgcggcctacatcgccctctggcaagctgcccgacggacccgcgtcgcctagtcgctgacctccgacccgggcatcgggacgtccaaggcgcgcgggaggatcctcccaaggaccggcacctggacgacggcgagcccgacggcgagcccgagcacgccgaggatccaggtgaatagcggcgcgagcgcaatgacggttgcagcgagtggcgatgcgaggaccgcggtcgtcgaccagagcgaccctgagagcgcgttcgcccgagctcgctcctcgtcgctcgccaaggcgttgacgagggcgggcgcgaccggcgagtagagcgtctcgccgacggcaaacacacccatcgccacgatgagacagagcgctgcgaagccgcgatcggcgcgacctgccagcgcaaccgcagcgatcgcccagctcgctgcccatgcgatggtcgccgcgagcagctgtcgtgaacggcgccaccgcctcgtggcacgactgacggggacctggagcaccacgatgacgatcgtgttgaccgtcagcgcgaatccgagaatcgccggtcgtgcaccgacttgcacgacgacgaaggccccccaccccccatcgagttcggcatagcccgcaaggaggagcccgatctcgatgagcagaaaccaacgcagcgcgacgttgctccgcaacagggcaaggtagccccctcgctgacgcgcgtgcctcgagcctgtacggggcacccgcggcgcaatccgcaccgcgacgagcaccgccgccaccgcctcgacaccagcggcgatcaaccacaagacctggtagtgcacgagctggcctcgcccgagatacaggcccccgagcgccgacgcaaggccgataccagcgttggtggcgaggaagagccgcgcgaagacgtggtcgagcgtacgtcctgcgaccagcgagccgacgatggtctgaccggccacccagaacaccgcctgcgagaggtacgacaccaacacggcgacaaaggcgatccagtgacggtcggcgacggccatcgcaccgtagccgagcgcccccgcgccgatcgcgatcgtgagggccgatccgagccgcagtcgatgccccagcagaccgagcgccatcgacacggcgagtccacagatcgaaccggcggcgagcaacccaccgacctccaccagcggcacgcctcgggcaaggtgcaggtaggccacgatgtagggcatgccgagaccggagccggctgcggccagtccgttcacgacgtagagcgtgccaagcggcgcaccggcttctcgggagatcggcacgccacaaccctagggccgacgagccttggaccgaggctgtccatacgagcgaccgaagttgggtaccgactcgtccagctgcgaccagctcgcaataagatggcccccgtcacggttgacatcactgcacgctgaccaactctcgaccgccgaaggagcagccgcatggcgacatcgacacccccgacgcacggccgactcgcaccggtcttccatctcttcgacctcttcccgctctcggtctcgagcgtggggccggtcttctcggtcgccgcgaccggtggcgtcatggccgcctatgccgggtggtgggcccttcccgccatcgccctcctcgccacgccgttcgtggtggcgtccttcgtcttccgcctgctcaatcgccactttccgcacgcgggggcctcgtaccactggtccgcacgggtgctcggccgctccttctcccgctaccaagcctgggtcctcattctcgcgtacttcttgtcgatcccacccatcgcgatcccggcgggctcctataccctcgccctcatcgacccgggccacaccccttccaatctcgccctcatggccgtgaccctcggctggatcctctttgccgcgatcccgctccttgctggcgcacgcccgaccgctcagatcaccaaggtcttcatggtcatcgagatggtgtcgctggcactcatcggcatcgtcggggtcgcgcgctttggcgcgacccacgtcccgatccacttcggccggccaccgatcggtgggatgctcatcgtcgccgtcgtcgcggctacggtactcgacggctgggagatcgattcctacgcagccgaggagtcgcacaagccccgatccgaaccggggatcagcggcatcatcggcgcgttcctcgcgctcgtgttctacgcgatcctctatccgttggtctttgccgaaaccccgatgcgactgctcgcgtcgccgcgtgacgccgatccgatcgccctgtgggcacagcgggttctcccggccggcctccactggaccgtgctcattcccatcctcggctcgacggccggtggactgtggctgaccacttacatcttgacccgagccctctatgcgatgggccgcgaacgcctcgtcccgcaggcctttgcccgaaccagccgacggcgcgtccctcacgtcgccaccatcgtcgtgctggggctcgtcgtcgtggtcgtcgccgtgcagaccttcgtctcctcgctgtcgagcttcttcgccctcgtcctgtcggcggcaggattcttcctcctcgccgagttcctctccgacacggtcaccgcgatcgtcttcctcacacgtgcccatcggcgtcttggcatcgaggacgaccatcaccatccggtgctgctcgggctcgccatcgtgtcggcgctcatgatggccggattgctcgtcgccttcttcgtctatggtccgagcgcgatcggcagcgggatcgaccaggtcacggccgtgctcctcgggcttggcatcgtatttgtggtgcttacacggcgtcgaacgaccgcccccgtcgtcttcgtgccagagggcgcggacgactgaggtcacccgcggcgcacccgcaccgccttcctagggcaccacgacgagccggaccgacccgacgccctcgatgatcccctcccagtgacccggcacgagcggcaccatcggcgtcaaggtgccggcgagcacccactcaccgggctcgagggaaccaccgtggcgggctacggcaccggtcaaccacgcaaacgagcgccgcggatcgccgagcaccgcctcggacccgccccggaccacctccgtaccgtcgcgcgtggcgatcgcgaccaggcgatcgaacgggatgccgtcgcggctcgccacgcggtcgccgaggacccacaggccggctcccgcacgatcggcaatgaggcttctgccccgcaccggccaaccgacgatccgcgagtcgggaatctcgaaagcaaccgccagctcgtcgacgacgtcgtcgacttcgtcaggctcgagaatcccctggatgcgctcggccacacgcagggccacctcgacttcgagccgcggatcgacgagccgcgcgagcgacaggtcgctacctgacccgatgcggtcatgctcggcgagtggtccgaagatcggctcctcgagccccatgcgacgccgagccgcttcgtcagtgaggcccactttccaccccgaacgcacggccccatgggcgtcgcgccgtgcccacaggcgcgcttgcacctcgtaggcgtcctcgagcgacaacgttccgaggtctgactcctcgacttccgacgcctcgagcagctcggcgaccgcctcgaggcgatcgccacgagaccggacttgcgcacgctcacgctcgaccatggcacgagtgtaggtcgcctcgcgtgcagaggactcgagccgccggccctccttgggtggcccaatcgtcgaccaccggtcaggtcgcttgcgatctggacgtgctcgccgaacgtggggcttcgtcagctcgcagcaccggcacgtacgagctccgcgagcacgcggagcgcgtcgcggggaccgctctggcgaccgagtctgagcacccgacgcggcgacaggacgtaacggcccgacgggagcggctcgccaagcaagatcgaccgagccgcaacgctcgcaagcgcaccgccagcggcggctgtcgagccaagctgcacgaagcccccgagttcggtgccgacagcgttggccgatcggatcaatcggacgctcaggttccgaacaccgacgatgcgcaccagagctcgtcgctcctcggcccgtgggagcgagcccttgagcagtcggtcgagggtcttccgggacagccgcccgttgaacggcacggtcggcccgagatcgtaacgctcgacgtcgaggacggaacgttccccgaaatcgccgaccgtcatcagcgcgacctgagccgaggccgcccatcgccgaagtcgggcctttgcgaccacgtcatcgacctcctcgatgacgagatctggacgaaaggcctccagcatggcgtcggccgcctcgtcgtagccgccacgaagatgcacctgctcgatgtagggatcgacctcgctcacgaactgcgcgatgaggtcgagcttggccatgcccacgtgtcgcatcgagccgcgaatgcggttgagattcgtcagcgtcactcggtccatgtcgccgaggagcagcgcagcgccgatgccaacgcgtaccaactgttcgacgatgacgctcccgacgctcaggccgaagacggcgatacgcgcacgctcgagccgtcgttgctcgtgggcctcgatcaggtatcgattccgtgcactgcgcagtgcccgcagatcctcgacactcggatagcgcacgagctcacacgaccacgggaagtagaaccacgtgccgtagcaatccggatccccaccgacacctgcgcgcgctgtaatctctgcacgagactcggatcggcccctcgggttctcgaactcgtcgagctcctccagcaactcgccgaccgcatcgacggtcctgtggatgcagacctgctcgcgaaggtcggcgagccgacgacgatcctcctcatcgtccgcgacgaatcgggctggaggcgcccacggccgccgaccgttcacgccctcgccacacgtcgccatagtgatcagccccctcctcagcccgcacgagcacccgacgctcatgcaacctcggacgccgaggtggtgcaaccataccacggtgcactccgaccacgcaggtgcgtcgatcgatccagcagaccaagcgagcccacatggtcctggccggtccccctgaaacgaggccacccgctctgtgagaaccgcgacccgaatggacgagcgagaaggagtgtgtatgaagcgcaggaagcgccacaccccggagcagatcctccggaggctggccgagggggacgagatgctcaacacgggcgccacggtcgctgaagcgccccggatttcgtgcgcacccccgtaggtgggaccgattcggactcggccgccatagtcctcctgctcgacctcgactggcaaacgacgtcccagccgctgcatgagccttgcgcgtgtcgtagcagcgcacccggaccgaggtcacctcctcgcaatccgtgaggctcgccagaggcccgctcaaccatcgctacttggatccaccgctacaacactgtcgggctgtacccgagcctcgagtagcgactatcgatcgaggaggagctcttctgggcccgggaggagaaggccgtggcccacctgcagcccgtcgagcaagcggcgcgagtccaccgctgtcaaccttgagaggagagccaacgacagacagcgccccacggtctcgcaccgagcgcacgatcgacgaggagatccctctccagctcgtggacgcgcgtctcgcgtcggtcgtcgatctcgctcgccaccactcgtggtatccagggtcgtgcgtgtcgcgatggggaacgctctcgcgtcgacgccgacaccgcaccgcttcgacttgacatcaggtcgcacaagcgaagcgatgggacacgtatgccagcgacggccttgcgtgcggcggtcggcgttgcgtgcggcggtcggccttcgtcacacggtgcccccggcaggattcgaacctgcgcacatggtttaggaaaccactgctctctcccctgagctacgggggctgaaccggcacccactatggtagctgccgcccatcgctacgaccgagaccagcctgcacgggaatgcacgtccgaccgtcggccttggcatcggtggggagatggggaggttccatggaagacgtcgtcgctgaaccggtgatcgcgcgcctcgtacgactcacgccggccgtgcgtgcgcgcctccgcgcgatgctcccggcgagtgcggtcgacgacgtcatccaagacacgctcgcggcggccgtcgcacaccacgacgagctcgagggcacggacggacgcctgctgggttggttgctcgtcgttgctcgtcatcgcgccatcgactggctccgtcgccaccgcgggccactcgatattcgaaccctcctcgtcgacgacgccgacacaccggatccggcgagcgccgtcgtcgaccgcgtcgtcctcgaggccgcgctgtcgctcctccctcagcaccagcgcgacgtcgtcgtcgcggtctgcgtccatggcgccccgatcacacgagtcgccgacgacctcggcgtccccgcggggaccatccggtcgcgtctgcactatggacttgcggcacttcgatcgcacctggaggccaaccgtgccatcccatgacgatgggtgcacgctccgcgaggcgtacctgctccacgagctcacgcctgacgaggtcactcgcttcgaggggcacctcgcttcctgcaggtcgtgccaggaccgcctgagcgacaccgcgcagttgctcagagcgctcgcagacctcgaaccacccgacgaaccggtgaccgggtcccaggtggcgcccatggcgcacgaccctcgcccagctcgcgtcgccggccacagtcatcggcgccgtcggggggcgctcatcggattggccggcctggtcgtcggcgcgtcgctcaccttcgcgctcgagcatcccgccgagcagaccccgtccgcggccgaggtgatcacccttgccgctcccccgatccacggcacgctcgtcgtcgaccgccgtgcatggggatcatcgatcaccctgacagcaaccggcctaccgtcgacgggccaggtctcactcgtcgtccgctcgaccggtggacaggtggtggacgcagcgtggcgtgcgatcggaccccagaggatcaacgtccaggcgccgaccccattccaaccgagcgccatcgcagccacgacgctcgtggcccacggccgccacacgaccgtgctctggagctggcaccgactcggcacagaaccggggaccacctagacgcgcgcacacgacgagtgcacgtttgcaatcatgcggcctacgaacggctacactctgctatccgtatgggcaacacgcctgcccatgcaaggaggcacggatgctggtcgtcgcccgccacgctcccgcaacccgaccccggccgggcatggccgatctcgagcgctcgctcaccgaggagggactcgtcaaggcacaagcactctcggtcgagctggtccggctcgcaccgacccatctcgtctcgagcccggcacgccgctgcatcgagaccttggcgccgctcgcgaaggcactcgatctcgagatcatcaccgatgatggccttgggcccagtgcgaaggctccacagatcgccatgagcctcgcctacctcggagcgctcgacggtgtcaccgtcgtcgccacgcacgcgccccagctcgaagtcctcctcgagcagttgctcgccgatcacggcatctccgtggacgccgacgcactccatctcccaccggccggctacgtgatcgtcgatgtcgccgaaggcgtgcgtccccctcgcatcgaccgcgtccgcgcctaccgcgacgtgggaacggacccgctcctcctggtcggctagcgtagccccgtggacagagcgctcggggtcagcgagctgatcgggcgcgtcaacgacgccttgggttcgctcggcctcgtcaccgtgcgcggcgtcgtcgagtcggccaaggcctcccaacgcggtcacctgtacttcgatctgatcgacgacggcgaccgccaagcccgcgtgagcgcagccatctgggcgtcgcgccgtgccggcatcgagacggcgttgcgccgcgctggactcggctcgctcggcgacggcgcgctcgtcgtggtctcgggacggctccaggtctacgctccgcgcggctcgatgtcgctcagcatcgaccgcgtcgagatcgaggcgatgctggatgctcgcgccgcaacccgccaacgccacctacgccaactggccgccgaaggcatcgtggacgccaaccgacgcgtgccggtccccgccgtcgcgctccgcatcgcgctcgtcgcctcgcgtgatggcgtggtgcgtgaggacgtgcgacgcgcgctcgccgacacgggcttcgcgttcaccgtcaggttgtaccacaccgaggtatccacccgcgcagcgagcgtccagatccgccgcgcactcgcggccgcgatcgccgaccagcccgacctcgtcctcgtcgcccgtggcggcggttcggagggagacctcgccgccttcgacgatctcgaccttgcccgagcggtcgccacggcaccggtgccgatctgggtcgccatcggccacgccgtcgatcagccgctccttgcctacgtcgccaactgcgccttcgacgtgccacagagcgccgccaaggccctcgtcgcccgggtcgaggactttcgcgagggccttgccaccgagatcgcaaccgcgatccatcacgctcgggcacggctcgatcgcggctggctccacacgcgccagatcgcccacgccatcgaagcacactcgcaacgacgtcttgcggccgcacaccgcagcctgccgagcccgtccgtcctcgacgctcgcaccgaccagcgcctcacgaacgagcgccacacgctcccggcgacctccgtcatcgacgctcgagtccgggcgcggctcgctcgcagtcgcgcggtgctcacagcagcgcgatcggcccgcgacatcgtccgcctccgcgtacgcctcgaagtccgccagctcgtcgaccaccgccgtgagctcgccgcggcgacgtcggccatcgccaccgctcaccgcactgagcttcacgcgcggcaacgacgcctcacgcgcgccgcggcacgccggcgagcacaccacgatgccgctctcgccgccgtgcgtcggcacctcaccgccgcgtcgtaccggcgagctcgccgggatcgacgcggcctcgagttgctcgcacgccgcatcgaggggctcgcctcaccgctcgagcgcggcttcgccatgatcaccgatccgacgggcacctggcttcgccgcgcggacgccatcgcaacccacgcaatcgtgcacgcccacttcgtcgacggcgtcgccgcgctgaccccagctcgacgatctccgaccacgacgcatccccacctgaccacgcgccaaggaggacgacccaatgacgactgacccggccgatgttcgctggctcatcgacctcgacgaggacgccttcgcgcgagccatcgagcaacgctccttcgaggatcttcgcgacacggcactcgcactcaccgaactcatcgactccgacgccatcggcgtcgatgacctcgcgaccgtggtacggcgtgcgagggccatcctcgacgcgtgcgatctgcgtctgcggcgcgtggagaacgaactcgaccacgacggcaccgccgtcgaggaagcctcggccgaggtcgaggagccgttctagagctctgccgcgagcgcgtcgagggcatcggcgagtccctcgacgatgaccccgatctctgcgggctcgatgatcagcggcggagacagagcgatcgaggtcgccagcacgcgcacgatgatgccacgctcgagcgccaggcgcgcgagtcgagcgagggcgtcggggtgttcggcgagcaggtcggaacgcagctcgacggccccgagcagccctaggccaccgcgcacctcggcgaccaacgcagaggaggccagcggtcgaagccgagccagcagctcgccttcgagcaccgcccctcgtgcgaggatctgctcgtcctcgagaatgcggcagttcgcgatgcccgccgcagtgcaggtcggatgacccccgtaggtcggcccgtgccgaaagaccggggctcctggttgcttgaacggagccgccacacggcccgacaccatgaccccaccgagcgggagatagccgctcgtgacccccttggcgaaggtgatcagatccggctcgacgccgagacgctcgatcccgaaccaggtgccgagtcgaccgaacccgcagatcacggagtcgacgatgaggagcacaccgtgtcgccggcaggtcgctcctagcgcctcgaagtagccgggaggcggtggatagacgccgccagcaccgatgacgggctcggcgatgaccgcggcgacccgctcagggccattggcgacgatggcggcctcgacggcctcgacgtcgtcccacggcacctgcacggtggtcgggatgagctcgccaaagcccgtccggttggcagggatgcccccaagagaggtgccaaagccccaggttccgtggtagccgttcgttcgcgagatgagcacggtgcgctccggctggccgacgagcgagaagtaacggcgagcgagcttcacggccgtctcgacggcgtcaccgccacccgacacgaagaacacctccgactcgggcatcggcgagcgagccgacaagaactcggcgagctcctcggccgggcgattggagaacgtgccgaacgtggagtagccggcaagctcacgcgcctgcgcagcgatcgcatccgcgatctccgcccttccgtggccgacgttggcgtaccacagcgccgcggtcgcatcgaggtagcgccgtcccgtgtcgtcgtagacccagatgccctcgccccgcacgaacaccaccggattcgtgtcgctctcgtagagctgaccaaacggatgccaaaaccgtcccatgcgtccctcctcggacgcgagcctacgggacgtggcgaacggtgccgtcctgtcgccgcacgacgacctccgaacggtcgcggccccgctgcttggccagatagagcgcgacgtcggcggctgcgagcagcgcccgaagatccggcgcgtccgtctcagccgactccgccaacgcgacgcccaccgaggcactcgcctcgacaccgacctcggcgcgaacgctcgaggcgatcgatgctcggatcgcctcgccaagctggcgagcccactcgagttcgacatcggtcacgagcgccacgaactcctcgcctccccagcgcgcgaccaagtcgcgcgctcgcaggcacgaacgcagggcctccgccgaggcgcggagggcaaggtcaccggcgaggtggccgtactcgtcgttgagggccttgaagtggtcgagatcgacgaagaccaccgcgaccgcacggccctcgacctgagcgtcatggagcgcctctgcgccggacgcctcgaaggttcgacggttggcgagcgcggtcagggcatccgtctccgcgtagcggcgcaactcctcagttgcgcgaacctgcccgacagcgatcgcggcctggtcggcgaagaactcgagtgcctggatctggccgaggtccggatagcgaccgtccaccgggttgtcgaccgagatcactccgaggagccgctcgtcctcgagaagtgggatcgacagcgtatcctcgggctgccaggcgtcgtcgtcggcgacgtgctcggctaccgggaccgacatgcggcgagcgaggtcggggtgcagcggataggcgcgatgccggaacaggtacgaccgagagatgcgcatctgcggcgccatgaccgcggcgaacagcgagagtgggatgggaccctcggtatgcaggcgctccgcctcgacgggatcgacgccactcgtcaccgcgaggacaagcgaatcgccttcgcgcaggtagatcgcggccctcgcgaagccacctgccgtcgtgacggcatccgcggcggtctggagcacctcgaggagcgccgtgcgccgctggacgtctcccgaggccgcgaggagccctgcgagtcgagctcgctcggcctcgaggatgcggacctgggccgagacgcgcgaacgcagatgctcctggacgagggcgagcccgaccagctgtgcgagcacgtccaggtacccgacttcctcggcgtcgagacctccgaggctcaccggctggtcgaggaacaagatggcgcccacctcttgctcccacgactccacgagttcaaaggtgagcgttgccgggttccacccctcgacgagcgactccgtctcgcggatggccgccttggcgagcagctcgtcgagcaacgggtggtctccgtcgacgacgtggaggctaccgatgcgccgcgccaccgcaacgaggcgatcgagatcggagcgtgcgagcgcgatctcccggagctcccgagccgaggtcaaccgacccgcgacgtgggtcacacggaagtacccatcgccctcgagactcgcgagcccagcactggcgaacgacgtcaacggagcaatggctgcacacagcgcgcgatcgaggaccgtgtcggtcgtcgggcgggcgagaacctcacccgcgatggcggcaagttcggcgaagcgccgcgcggtcatggcctctcctccgcctcccctcatcggcactatcggacgctggatcggcgatctcaagtcacacgggcagcctcgcccacgccgcgctcagcaccgtggagcgcgtgtcgcgcctacggctgcccgaacgcgaccggcgtacccgaccacccgatcgggtcgacggcgaccggccgaccgggttccgtggcttcgaccaccgacccgccgccgacgtagatggcgacgtggtcgataccggacgaccccaacgtatcgtagaagacaagatcaccggggaccagctgcccgtagccgataggcgccgagtcggcggcctgcgcagcggcgtcgtgcgggagggcaaggccgagctgggcgaagacgtagctcacgagccccgaacagtcgaagtactgcacccctcctgaccactggcccgcggcgccataggagtaaccggtatccccgcgcgccgcgatggcttcggcgatcgaggccgcctgctcgagcagcgatgcggacgcaccctgagccggcggcgtcgcggcaaccgccgccgtctcggtggcgagttggacactcgcccgctgctcgaccgctcgctgctgagcggcttgggcctgagcgacgagctgggccatctggcccttcagcgacgccaacgccgactcgacggacgcctgctcgctcgcggccgccgctcgcgcagcggcggctaccgccgccgtctggctcgccgaacgcacgagtgccgcgagctgggttcgctcgacctcgagcgcgagtgccatggcccgatactgggcgacgaggcttgtctcgtcggtcgcggcgaccgacacgtccgtctggacgatcgctgcgctgttcgggctcccggcgagcaccgcccccatgcccgccaatgcgtcaccgctggtgaactgatcgagggccgcacgggcgagccgggcccgttcacgcccgagcgcctgtgtctcgctcgcgatacgcgcacgcacacccgcgagctcggcctgatcctgggcgagttgcgccgtcgccgcgtcgtagcgctccgccgcgacctggaccgcaccgtcgagggcggtgagcttcgcagcgagctgagccgcttcggactggtcggtggcgagatcgacgggacgcgcaagcggcactgcttggagcgaggccgtcacggccgcagcgatgccgaggagggccgcccgcaccagcacgcgccgcatcgcacctcccgcacccagattgcgctcaggctaccatgccactggcggccgcaccagacaggcgacggcggcccgtccgagcgatggaggtcagcgatggtgcacggcgtcgacgacacggcccagggagcaccttcgggcgcactcgccggcatcgtcgtcgcggacttctcacgggttctcgccgggccgctcgccaccatgatcctcggcgacctcggcgcgaccgtcatcaaggtcgagcaccctcgcggcgacgagacgcgcacctggcgccctcccgagcgcgacggaagggccacctactatctcagcgtcaatcgcaacaagcgtgccatcgcgctcgacctcgacgacccgaacgatcgtgccatcgcatgtcggctcgccgcccgagctgacgtgctcgtcgagaaccttcgagtcgggaccatggcccggtggggcctcgcctacgacgacctccgcgcgacgaacccgcgcctcatctacgcctcgatctcgggctatggtgacggacccggcgctcacctccccggctacgacgtcgcgatccaagcagcgagcgggttcatggacctgaccggccaaccagacgggccagccacgaaggccggcgtcgcgatcgtggacgtcgagaccggtctcaccctcaccatcggtgtcctcgctgcgctcgtcgcgcgggagcagacgggacggggccagctcgtgcggaccagcctcctccagagcgcgttgttcggcctcgtgaaccagatcggtggctacctcgcgaccgggaacgtgccacgacggctcggcaacgcccaccccagcctcgcgccctaccaaccgctcaggtgcgccgatggcctcctcgtcatcgccgtcggcaacgacgcgcagttcgagcgcctcgcgacggcgctcggcctcgacggcctcgaggatgacccgcgctttggctccaacgccgatcgcgtgcgccaccgcgacgagctcgccgagctcctcgaggcgcgactcgcgaccgagacccgcgagacctgggcgcgccgtctcgaagccgcgggcgtccccgcatcgcccatcaactcggtcgccgaagcggtgacgctcgccgagtttctcgggctctcgcctcgagtccggcttcccggcccgctcgagctcgacacgatcgcgaacccgctcgccctctccgacacaccggtcacctacgcgctcgaacctccggatctcgacgccgatcgcgactgggtgctggcgtggctcgatgcggcagaacgaaacgcctgaacgagacgccgtgccacgtggacgagccgcccatcggcaccgaatggcccgacgacctggaccgagaacggcacccggctcgttcgccacgggcccgctccgcccccgaccggcacgctgagcgccggcaggccgagggcgttccaggggatggtgagctcgttgagccgcaacgtcgaccaggcactgaggggtccgggcggcgcgaggagggtcggcacgagcgcgagcgcctcgctgtcggcgaaccaggcctcaaaggccgcccgccacgcgtggagccgagcacgtgcctcgagataggccgcaccgtcgaccgcgagcgctccctcgagccgtcgcctcacccacggatcgagccgatgcgcctggcggaggagccatccccacgtcgccgccgcctcgaagtcgaggatcgtgccgccggcacgggcgagctcaccgagatcgaccggcgccgacaccagtcgctcggcgagctcgccgagtcgcccatcgacgttgggctcgccgacacccacaccgacgagtggccagtcgcccaccagctcgtcgatcccgagcgcacgagcgccctcggacagccgatcgatgtcgggggcgatgagccccacggtgtcgagactgggcgccagcggcgccacacccgacgtcggcagaaggccgtagctcggcttcagaccgaggaccccattggccgccgctgggatccgcaccgatccgccggtgtcggtaccgagggcgagatcgacgagcccgagcccgaccccgaccgccgatccactcgacgaaccacccggcacgagcgacgcgtccaacacgttctccggggtgccatcgaacgggttgacaccgtgcgtcccgtaggcgagctccaccatgaccgtccgcgccgtcggcacccacccggccgctcgcaaccgtgcgacgacggtcgcgtcccgaagcgcaggtcccaccatggtgccaaggagccgactcccgacgcgcgtcggcacgccgacgacgtcgatgttgtccttcaccccgaggcgacgtgcgaccggagccgcttcgatcgacggggcaccgagtgcccaattcctaggagccgtcgacatctgcctcctctgtcgcgacgccagacacctgtccgatggtcgcaacctgcgtcacactgggcgccatctgccgcaggtacgtgtcgaagaacgcgatgctgacggcagcgacggcctgctcggcaggcccttcggtcgtgtagggtccgaggtggtcggccccgaggagccactcgaggtacttgggcgcctgggcgtccgcgtagatcgcctgggatgcggacggcgggttcaccgtgtcggcggagccctgcacgacgagcatcgggacggacgagccgaagaacgacccgccgaagggggagaacaccgcgcccgacagcacggcgacggcacgaacgccagggatcgcacagcaggtgttgtccgcgctcgcaaggaccacgtcgccgccgtcgctctggcccgcgagcgcgacgtcgtcggtcgcgacacggcccgcgagcacgcccgagcgcgcaagcacgtccatctcgccgatggcggccgagaggtcacccggttcgttgagcatgtccgactcgaaggcgtccgcgatcgccgcgtcgtgcaggtcgaccccgtaggtcgccagcgcccacgcagagctcagtgggaagcggggagcagcgaccacgtagcctgcgcgaacccacgcctcgatgagcggcacgtacgcactcggatcctcgtcgaagccggccgcaaacacgatgaggggatagggtccacccacgctcgcgaccggggcatcggccacgatggtactcgatgccgtccgggacggatagaagacgtccagcaggtagctgcgttccgaacacgcgtgcgtcgtcggtacgcacgtcaccctgccaggctcggtgacggtcacccgaagctcgcccaccccagcgatctgcccgctctggtgcgcagacgacgagcgcggccgcgtcgacgagggcgctggctcgtgtcgatgcgtcgtcgacgcgctcggggtcgtcgtcgctcgttccatggccgtcgccgtcacgaccgacgccgacgccacgacgacgacggcaccgaccccgacgagggcgcggcgcctagccctgagtctgcgtgaacgagacgccgttctcgacctccgcgatctgcgcgatccttcgcgcgtgacgccccccatcgaagtcggccgcgaggaacgcatcgacgatggcgagcgcgaggtcgtgaccgagcagacgcgccccgagtgcgaggacgttggcgtcgttgtgcgccctggcgaggcgagcggacagctcgttgtagcacagggctgcacgcacgccccggaccttgttcgccacgatctgctcgccctgacccgaacctccgaagacgatcccgagttcggccgcgccggtcgcgaccgcctcggcagcaggctggcagaagagcgggtagtcgacggactcctcagagtcggtgccgaagtcgaggacgtcgagtccagcctcgacgaggtggcgcttgacggcctccttcagcgcgtagccggcgtggtcggcgcccaatgcgatgatccgactcacaggtaggcccccggtgcttgctgggctccaggaggctgcggcaggccgcgaccgcgcaactgctccagctgtgcattcgaggccatgcgctgggcaaacagggtcgcttggatgccctggaacagaccttcaagccacccgagcaactgggcctgcgcgacccggagctcggcctcggacggcacaacgccctcttggaacggcaacgagaaggaccgcagctcgtcggcgaggtcgggtgagaccacctcgctcagcgcgcgcaacgactgctcgtagatctcggcgaggcgctccctggagcgctcgtcgagggtcgcctgacggacctcgtcgaggagcgcgcgcaccatcgccccgatgcggatcactcgagccggcgacatcaccgcatcggtatcggcgctaccagcgttgggctcgcccgatgctccagccgtcgtctgctcggcgtactcagaattctcagccatcagctccctccatcgaccggctacgcacgaccccgcggcagcctacctcaccggacctaggggcccaccgcgatcggcacgaggacctcggcaggggtcagtgcaccgtggcgagcgcgcatccgtagcgcgccttgatcggctgggtcatcgaagaacacgggcgcggtcgcgacgaggcagacgtcgccgaggcgttgctcgaaggtctccgggaccggccccccgaagagcccagcggcgacggcctcctcgcgtgtgaacaccttcgcgacgtcgccgtagcgagcgcggcatcgctccgccaacgccgccggatcgccagcggtgtgcaaccatcggaaacgaccctcgcccgacaccagcgagcagtcgcctcgcacgtcgcgatcgagtcgcagagcgcctccgtcgaccgccacctgaccatgatcggccgtgacgaccagcgtcacccctggcggcagccgctcgagcagcaggccgaccatcgcgtcgaccatgcgcagctcgcgccggtaggcctccccgagaccgaactcgtgcgcggtggtgtcgatcccttcgtagtaggcgtagacgaaccgctccccacgagcgagtgcctcgtcgatacgcgtcacgacctggctcaaggtcgaccaccaggccagccgcgcgccacggagatgcaccttcgtgaagcaggtgtcggcgtaggcgaacttggtcaccgcaacggggttcgccccgaggaacggggtcaccggcgcgagccgctccggtgccggcgccgggcctcgcccgttcacagtccagcgcaagacgttgagcacggatccaggcccgacgacgacgcggtagccaagcacgccgtgcaccgccggcaccacgccggtcgtgagcgacgtcagcgcggtcgcggtcgtcgtcggtgccgtcgagtgggctggcaccacccggagcgcgccgagggtcgcaagctcgtgccgatgctccatcaactggagatagccgagtccgtcgagcacgagcaggacgactcgctcgggtgaccccacgtggtcggccaaccacgcgggtgctgccggctggcccgccatgtcgagcaggccgaagatccccggcaccacaccggcgagcgacggcccgtcgtagcgtggcactatgaagccgtgatcggcctcgcgcgcgatctccatccgccctccttgggccaaggctaccgtgtgttcgccgcagcctgaaagccgaaccgccgcgttcgtcgcttcacgaccactccacggctcgcgtgtccgtgggcgctcggcccgagctcgcgctcgagccgcgaccagcatgggagctgagctccgtcctgcccgcaccccgagcgaacgacaggagtcgtcgcaccctcgaacgagccagcctcgctcgggaacgacccggccccaggcgcgctcgtggcccaaggtgggcgatcgaccgatcgccccacgacctcgcggccaggagctaggctcgagatagtgagggtctccacgcgcggtgactacgcagcccgagcattgctctcgctcgcgctccacccgagcgaccaaccgacctccgtcgccgagctcgctcgacgcaccgggctaccccagccctatctcgagcagatcctcctcacgctgaagggggcagggctcgtacgctcgaagcggggcgcaggcggcggctacacgctcggccggagcgcggaagagatcacccttgcccagatcatcgcggccgtcgacgggccgatcaccgtcggtgacttcaaggaaccccacgaagacggcgcgtgtgaccacgaaggtcagtgcgcgctgctcgaggtctgggccgaggtcggccaccacatggccgatcacctgcgcagctacacccttgccgagatggtgcgccgtgctcgtgggctccgcggcgacgtgctcggcgccgtctcggatcctcggtgatgacgaccgacggcgagagcgacgcgcgctaccccgcgcactgggagagcgacatcgtcgcagccgacggtcgcacggtccacgtgcgacccatccgtcccgatgacgcaacagccatcaggcgcctgcatgggcgctgttcacccgagaccatctactaccgcttcttcacgccgttgccggagctctcggacgccatgctccagcacttcgtggtcgtcgactacgtcgaccgcatggccttcgtcgccgaatccggcgacgaactcatcgcggtcgctcgctacgaccgcctcgcgggctcctcggatgccgaggtcgccttcctcgtcgacgacgcccaccagggccgcggtctcggcgcggcgctcctcgaactgctcgccgcctacgcgcgacagcacgggatcgggcgcttcgtcgccgagacccttccggacaacgtccgcatgctcaaggtgttccaggacgccggctatcgagtcgcacgcacctgggccgacggcaccgtgcatgtcgtcttcccgatcgatcccacgccgagctcggcggccgtgatggccgaacgggagcgccgggcggctgcccgcagtgtggccgcgctcgtcaacccgacccgcgtcgccttggtcggcgcgagccgaacgccgggcagcgtcggtgacgtgctcctcgccaacctcctctccgcgcgcttcgagggaagcctctgggtggtcaacccgaacgccgcagcggtccgcggcatcccgaccgtcccatccctgcgcgccatcggccaacccatcgacctcgccatcgtcgccgtgcgcgccgaggagctccccctcgtgctcgaggacgcccacgccgccgaggtgcgtgcgctcgtcgtggtcaccgctggcttttccgacatcggccccgaaggggccgaggaggaacgtcggctggtggcgagcgctcgacgtctcgggatgcgcgtcgtcggtcccaactccatgggggtcgcctcgcccgcgatcgggctcgccggcacgctcgcaccctttgcactcgaggccggtggcacctcggtgcacgcgcagtcaggtcccctctcgctcgccatcgtcgccaagttggcgcaggcctcgatcggcatcgcgagcttcgtgtcgtcgggcaacaaggccgatatctccggcaacgacctgctcgcgtggtgggagaccgacgagcggacccgttgcatcgtcctctacatcgaggacttcgggaaccctcgtaccttcgcgcgcgtggccaggcgggtgagcgcgacgaagccgatcctcgtcgtcaaacccgagcgcgagggtcgcagccgtgtcgagcccgaccgaccaggtgtgctcgacaccgaggtcgcgatcgatgccctcctcgagcgcaccggcgtgcttcgcactcagacgctcgaggagctgaccgaactcgttcgtctgctcgagtctcagccgctgcccgccggcgaccgagtcgccatcctcgccaatacccaggggcccgcccccttggtggccgacgccgtcttgcgggccggcctcgatctcgctcccctcgagcccgccaccgtcgagcgcctcggcaccctcggccgcgccgcggctcgcaaccccctcgagctcgggcccggcgtcgtgccggccgactgggaacgtgctctcgaactgctcctcctcgacgccacggtcgacgccgtcatcatcagcttcatccccaccgtggtcggcgcgcccggcgatcctcgactcctcgccaacccactcccgggaggcacgctccgcggcgcaccggcccagagcctcgcgcgcgcggccgagattgccgacgccgtgacgaaggtcgccacccagcgcggacgcgatcgaccgaagcccgtcgtcgcgaacttcctcgcgctcccgggtgtaccagaacgcctcggcgccggtccccgcaccatcccctcgttcgactttcccgagtcagcggccagggccctcggccacgcggcccgctacgcccgatggcgggcgagggccaacggaacgccgctcgagctggtgcccctggctggcgactgggcgcgcgatcccctcgacgaatccgccgacgaggaccgcgagctcgacgccgaggccgtcgcgggcctcctcgactggctggggatccctcgacgcgccccatcgggcggccgccgcgaggaactcgagggtcgagcggtgcacctgcgcctcgagctgatccacctggagcgctacggcccattcctgcgagcgggcctcgctggtgacgccttccgacgcatcggggcctcggtggccgtcgcactgccccacaccgaccgtgacgtgatcgacttcctcgaggcgatcccgggcgcggacctcgtcgtcgggtcggggccgtatccgagcgacgacctcgtcgcgatcgtccaccgcctcgtgacgcttgctgaacgccgctatgacgtggcggccctcacgctcgagcccgtcgtcggcacggcaaggggctggtgggctcgcagtggtcgctgtgtcgtccgaccactgcgcctcgaacccgcgatgatcacgcgaagccttcgcgcgcccggatccccctcacccgcctgagcctcgtcgcaccggcgcgagctcgggtggcgagccgtcgagtggtgacaaaccctcactttgcggcgagcctgcgccctcacaggagggcgtcgatggcccccacgagcatcgggtcctgtggctcgacagtggggcgaaaccgctcgatccgctctccgtcgcgcgagacgaggaacttctcgaagttccactgcacgtcacccgccacgccatcaccatcggggacctcgcagaggctcgcgtagaggcgatggcgcccctcgccgttgacctcgatcttcgcaaacatcgggaagtcgaccccgtaggtggtccggcagaacgtctcgatctcctctgcggtcccgggctcttggccgaggaactgattgcacggaaagccgagcacgacgaaaccatcgtctcgccgtgcatggtagagctcgacgagcccctcgtactgcggcgtgagaccgcagcgcgacgcgacgttcacgacgagcagcaccttgccccgataggcggagagttcctccttcgtgccgtccagccgctccatcaccaaatcgtacgggaacatcgaacccctcctcgcgtctaccgcgttaggtcaaggcctccgtgggcgaagttcttcccattccccagatctcgcccggcgtgctcaggacaggttgagggccgcgtacttgacgttcaggtactcgtggatcccttcgaacccaccctcacggccgaaccccgagcgcttgactccgccgaacggggctgccgcgttggagacgaggccctggttgacgcccaccatcccggtctcgagggcctcgatggtgcggactgcccgggagagcgactcggtgaagatgtagccgacgaggccgtaggtggtgtcgttggcaaggcggatggcctcgtcgtcgtcgtcgaagcgatagaccggtgcgactggaccgaagatctcctctcggaacacgcgagccgtcggaggcacgtctcgaagcaccgtgggcgagaagaagtaccctcggtccccgcgccgctcgcctccggtgaccagtgaggcacccgcagcaacggcatcttcgacgagccccgagaccttcgccaacgcgtcagcgtcgatcagggggccgacggacgcatcgggctccgtaccgcgcgcgaccttgagcgacgccagagccgtcgcgaggcgctcggagaaggtgtccgccagggactcatggacgaggatccggttcgccgacgtgcacgcctccccgccgttgcgcatcttcgcgaagaccgcgcccgcaactgccttgtcgagatcggcgtcttcgaacacgatcagcggtgcgttcccacccagctccatggacaagcgcaagagccctgacgacgccttgcgcatcagcaggctcccgacctccgtcgagcccgtgaacgacagcttgcgcagaccagggtgtccgatgatcgcgtccgagatcgggccggggtgcgaagtcgtgacgacgttcagaaccccaggcggcagaccgacgcgctcgaagatcgacgcaagggcgagcgtacacagcggggtctgctccgccggcttcacgatgaccgtgcacccagccgcgagcgccggggcgatcttgcgtgttcccatggcgagcggaaagttccacggggtgatcaggtagctcggtccgaccggctggcgtgtggtgagcacccgtgtcgtggcgtcgggggagacgtagaagtcgccgtgcacgcgcaccgcctcttcggagaaccaccgcaggaactctgccgcgtaggcgacttcaccccgagactctgcgaccggcttccccatctcgagggtcatcagcagcgcgaggtcatcctgggcagccatgaccgcctcgaaggctcgccgcaggatctcggcccgctcccggggagcgctgtgggcccacgcctcttggtgcgcgacagcagcgtcgacagcctggcgagcgtcgtcgaccgtagcgtcggcgacggaggcgatgacctcaccggtcgcgggatcctcgacgtcgaagcgacccccgtcagcggcctcgcgccacgcgccgtcgacgtagagtcccgtcggcaccgtccgaacgaccgctcgctctcgctcctccacgtcagcctcctcctgtcggatcgcagcaccctgcagcgaccgtagcctaccaagctcctcgcaacggtatccatcgcggaccgcgccgcgtcagctcgattccgcactgccctaggctcaggccatgcacgcatcggagcagtacctgcgcgagctcgtcgagctcgaccccattctcgcgaccgagctcggcctcgacaccgatcgtctccccgacttctcgcccgacggcaacgacgagcgagcgctgctcgctcgtcgcgcacttgcctggctcgccgacgaatccgatccggaccccatcgccgccgacctcatgcgcgagcgactctcgagtcagctcgcactctacgacgccggcgagcacgagcgggcggtgaacgtcatcgcctcacctcagcacgccatcaaggaggcgttcgacctgatgcgcatcgagggtcccgacgacgccgaacgggttgtccgccgccttcgagccgtcccgagcgccctcgccggctaccgcgcgaccttggagcgaggtcgagccaacggccgtctggcgcagcgacgacaggtgctcgccgctgccctgctcgccgaacagaccgcggatgcctacttcgctggcgtcgagcgtcgtgtcctccaggcaacgcagcaaaccgaagccgaccaacggctggcgggcgcgatcgaggccgcgcgctctgcctacggcgagctcgcgagctacctcaaggatgcctacgccccgagcgccatcgaccaagacggcgtcggcagggagcggtgggccctgtggtgccgccacgcgaacggtcgagatgtcgatccggaggaggcggtcgcgtgggcggccgacgaactcgccgcgctcggcgccgagatcgagaccgaggccaggcggctcggcctcgaacccgggcctggtctgctgacggcgctcgatcaggacccctcacggcagatcgtcggtgtcgacgccttcctcgcgtggaaccaggctcgcatcgacgaggccatcgagatcgtcgactcccgagccgtcacgatccccgccgcgatccgtcgatgcgaggcgctcgaggctcctcccggcggtgctgcggccatgtactacacgccaccctcggaagacctcgcgcgcccgggacgcacctggtatccgacccatggcaagacccgcttctcactgtggaacgagctgaccaccgtctaccacgagtccgtccccggccaccacctccaactcggcatcgcgacctggcgtggcgcagcgctcgatcccttccaacgaacgctgggctcgatctcgggtcacgtcgagggctgggcgctctatgccgagcgactggccgacgaactcgggctcttccccgacccggcgtttcggatcggctatctcctctcgcagcgcttccgtacgctgcgcatcctcatcgacatcgggctgcacaccggcatcggtgcgcagcgacgctcggccgagcccctcaccccagagcgcgccatcgacgacctcgtccagatcgcaggtctggagcgtccgttcgctgcaagcgaagtcgatcgctacctcggctggccggcacaggcgaccagctacaagcttggcgaacgagcctggcgagacgcgcgcgagcgcgctcgcgcgcgtggggtcagcgatcgccgcttccacgagtcgctcctcggcctcgggttcatcagcctcgaccagctcgcgaccgtcgcggccacgctggcaccgtaggggtagcgccgtcgtcgtgcgccaccccaacgacggccttagccctgcttgggtggacgggtcgcgctgcgcaccaacgcccgaagggcgagcaccaccacggcgacgatcgccacgacgaccgcaaggctgatgatggcgtgcacaatggtcagcaagaagcccaagaccagcacgcccacgacgacgaccgcgacacctatgaggacacgtccaagcatcggaccacctccacggtcaaccctagaccacgatgctgagcgaagtccgaatccgcgctcgagaaccgccgcacatctcgagtacctagctgacgatgtccttcgacagaaagctcgacacagcagccgtaccccacacgaccaaccacgccgcctgctccgcaaggtccttgaggatgggcgtcaggtaggccggcgagcggaacaagttgatgaacgagccccagtacgtcgagagcaagatgggtcgcacgacggcgagctgcgggacggcgccgatgacctccgcagcgatcacgatggccaacgtgatcgcggtcgccgtgagcgacgacgaggtcgccgtcgagatggcgacgccgacggccaccactccgaccagcgacgctcccacgacgagcgcgctgaggagcacgtcgccgacgccggacgcgacgccgacggcggtcccggacagcgtcacgagccgcccgtgcggaaacaagacgaagcccacgacgagcccgacgaccgcgacggtgagcgccgcgacgatggcgaacaccagtgcggcaacccccttggcgacgacgacccgcgagcgagaccccccggacaggagcaggtagcggagcgatccgttggcggcatcacccgccaccgcatctcccgcgacgatggcgacagccagcgggagcaccagggtccccatggtggcgagcgcggcagccggcaagaagacggcgttctgggtgatgaccgagaagaacggcggaccgccgccgttgcgaggaccacccgcgaccttgaccacgataccgagcacgatcggcaagaccgagagcaacacgaggatgaccaggttgcgaggacggcgaaacacccggccgagctcgtcaacgaacatcgaagccctcccccacctctgcgaggaagagatcctcgagactcggcagcaccggggtaacctcctcgagttcgataccgcgctccaccgccgaggcgatgagtgctggcatcgccgagcgcggcgcgacgacctggaccgcgaccccatccgcagacgccgtcgccccagggagggcgagcaagcgctcgagcggccgaccgcgcaggcgccaggtcggctcgtcgatctctcgcagctcactgaccggcccctggcgaacgacgcggccctgcgacatgaaggccacgtgactacagagcagttccgcctcggcgagcagatgggtcgagaggaacacggtgcgaccctcgtcgcgaagggcagcgagcagccggcgcacctcgcgcatgcccgcggggtcaaggccgttggtcggttcgtcgaggaccaagagctccgcatcggtcatgatggcttgggcgatgccgagacgttgtcgcatgccgagcgagaaccgagcaacgcgtcgatccgccacggccccgagccccacccgttcgagcgcggcttcgatcagccgctggcgcgcgcccgacgcgacgcctctcgcggccaagagccgggcgagattgtcgcgagcgctcaggtacgggacgtagcccggaccttcgaccagcgcgccgacccgtgcgcgcacggaggcgagtcgcggaaccgtcgcaccgagcacctgcgcgcgaccggcatcgaggaagatgagtccgagcagcgcgcggatcgtcgtggtcttccccgatccgttcggaccgaggaagccgaagatgctccctgctgggacctcgaggtcgacccggtcaaggacacgggtgcggccgaaagacttctcgagcccctcggcactgatgacgatgctcacccaccgatcacgacggtggcgtcgctctcgaggatcgcaggggtgacggcgccgacgaggacttgtccgctcggcaactggagggcgttgacgagcgcggtctggagcagcatggcgtgcgctccatcagcgagcgtgactggctgctccagggtgcgaagcgtcgagccgaacgacgaggaccccgcagacgtcgaggtaggcgcgccgagcgctcccttcggcaacaccgcgacgcgatcccagcccgacccaagcgtcgtcgcaccggccacgttcactgcacaggttccgggcgcataccccgtccagccggacgcggtcggcgtcaccgacgaactctgcagaggaaccatgcagcccgtcggcgagagcgccacggactcctgacgcaccgtggcaccggctggcggcgtgaacgtgaacgtggacgcaggcagcgagccgaaggagatctgggtgaactgccacgagagatccgtggtgccatcggcaccctgaatcgccataccgagcacttggtcattggctgcgtcaacccagaagctcacccgcccgatggtcgagccggcctgcgtcggctggatcacgagggtatagacaggctgaccagcgacgtaagtgttgtggccgaggcgcacggtcgaatcggtgccaagtgccgcaacgatcgtgtccgccgccgtggtggggtcgaacgtcgactgtgcggccgaggacatcgacgatggcgccgagccagaggccacgagatgcatcgcctgctcacctgatgagttccacaaccacaccccggtgcggctcgcgtagaggtcccgctcgctctgggcgttgagcacctcgacccgcagaccttcgcccacaccgcgccacagccgcacgctggccgttccttcagggattgccacggcgttcgtcgacgacgagccctggacgcccgagagcaaggacgccgccggacccaacaggttggacgtgatctggagggtgcccgagaacgactggggtcgagccccgagcaccgccgcgaccaactcctgcggtgacaccggcgtcaacgactcggtctgcgcactcgccagcgagggcgtcagtgcggccgcggccaccgcgaccagcgcggctccgacgggaatgccaacgcgtaccccacgacgtcgcacaccatgcgccatggctcctcctctacgtcctctacgcttgcccgtcctcaacgtccgacggcgctcgatcgacggcactcgattcggtgcctgaatcccacgctagtcctccactcagagcgccgtcaccgccgatgtgtcgggatctcaggcaaccataggcctcctacaaggacaccctcgagcgcgtctcaccccatcctcagctgcgacgacacactcgaccttgtgcgtacggaccgtcgcggtggcccctgaaggacgatggatgctcccaaccatcgggccacggcgcagctgcatcgcgccctcgcgctcacacgcagacggtgcacgagcggctggacccagagcgcgtgcgtccgtcgcctcgcacacgccctcgtggccgatcgagcggagcacgctcgagcgtggcggcatcgaccacgggggctgcgaacaggaagggagcgcaccgtcgtggtcgcagcatgctgcccaccgaaccaacgcgaacgccgtcacatcggcgaaccacggaacgtgtccgagggttctgacgcgagcggtcgcgccggcggaagcgggtgtcagcagggaaacaatcccgacgcccgacgtgttatactgtggcagcgccacctcgtgccctcgtcaagttcgacccgtgtccacgccgatcccgaagacgacgaaccgaaacccgactagatcgagtgggcagccagagcatggcgagagcctcggggggctgtgcgagcgcagtggctctcgtggcaggtcgggacacgactcctggtcgctacacggagcacggcgcccagcgtagttcggcgcgtcgatgaggggcagcagcgataccgttcatgagagagggcacgatggcgacgaagagtgatagcgcgctgaagcagagttcgcgtaagcgacgctcggtccaggcggaggtcgactctgcgctccaggcggcgggccttggagcggactcgatccgcctcttcctcgacgatctcgccaagcaccccttgccgtcggcggctgaacaagtcgaactcgccaagcgcgtgcgcgagggcgacgaggacgccaaggccgagatggtcgccgccaacctgcggctcgtcgtccactgggcgcgccgctaccaagatcgtggcgtcgaactggccgacctcatccaggagggtacgttcggcctcatccgggctgtcgagaagttcgactggcgacgcgggttcaagttctcgacgtatgccacgtggtgggtccgccagtcgctccagcgtgcggtccacaaccatggtcaggcgatccgcctccccatggaggcagcagagcgttcccgtcgcgtcgacaacgtcacccgtgagctcgcggctgacctcggccgtgcgccgaccgaagaggagatcgcgatggccgcgaacctctccgcgagtcagctcgccgacgtgcgtcacgcggctcgcgtcgtcgcgagtctcgatcaggcggtgggcccagagggcgagacgagccttggcgatctcgtggtcgcccaggacacctcgttcgaggaagaggtcgacgaatccatctcgcgggaaatgctgcgtcgcgccgtcgaagagctcgacgaactcgagcgccaggtcgtcaccctgcgtttcggtctccaaggagatcggcctgcttccctcgaggcgaccgcgcgcatcctcgggatcggaccgcgacgggctcgtcgcctcgaagcgagtgcgcttgcaaagctcgctgagaatccgcggctgaggacctcggcggcctagaacatcggcggcagagcacctcggcggccaagaacctcggcgggctcgggccacggcccacgcacacttccagcgtccccgacggccaccgttgggcctccgggcattgagctgcaggcgcactgcgacaggctggggcgccatcagcgactcgccagccaggcaccgcaccagatatcagaagccgaaggcgacatcgctcggcgagcagccggccacactcccgcccgaggggctcgtcaacgcccctcgtcgacgcggagaatcgcctccgtgcgggcgcgcgccgcgagctcgccgaggtcctccgggagctccgcggtcacctccacgcgtccaggacgcgttggatgctcgaacgcgagcgcggtcgcgtggaggaacggacgttcgagcccgccgtaggggacgccatagacctcgtcgccaacgatcggatgcccgatggcgctgaggtgcacacggatctggtgggtcctcccggtctccagcgtgagctcgacgagcgacgtatccggaccatgccagaccaccctcagctgcgttcgagcgtcacgaccgccgctcaccaccgcgacacgggacagatcgcgcagatcgcgaccgagcggcgcctcgatgcgtgcagcttgcggcggtacgcccacgacgagtgcacggtagcgacgctccacctcgtggtcgtggaccgcccgccgcaacgactcgtaggcgcccgcgctgagggcgatgaccatgaggccactcgtgccgcgatcgagtcgatgcacgagcccacgacgcaacggatcgccgggaagggcacggagcgacggccaccgttcgagtgcccaatccgcgacgctcggacgcacatcgcggaggtgggtgcgatggacgatcagaccagccggcttgtcgatcaccgccacgtcgtcgtcctcgtagcagaccaccggtgcgccctccggagccggcggagcggcaggatccggccaggtggcctcgaggagctcgccggcccgcaggcgcctcgaacgtcgctgctcgacacggccgtcgaccaggaccccgccatcgtccacgagctgctgggcgaacgcccgctcgatcccgccggcgatcgcgaccgcccgatcgagacgctcgccagcgagcgacgctccgatcgtgaggcgcagctcacccacgatgcccgcgcacctcggacagagcgagcacgaccaccccgaccgtgatggcggcgtcagcgaggttgaacaccggccacagcgggagctggatccagtcgatgacggcgccgtggtgatgacgcaccacgcgatcagccagattcgagatcgctccaccgaccacgagagacgcggcgatctgcgaggcgacaaagcgccgcgtcaggccccacgcaccgatcgcgacggcgaccacggtcgcgacgacgccggcgaccacggggtgacctacgcccagcgagaatgcgacgcccgtgttcaagacctcgacgagatggatcggcccgatgctcaccggatgcgttgcgaagtggtcctcggcgatcgtcttcgtgacctggtcggcgatgacgacggcacccgcgacgcaggtggtcaggaggatgcggcccctcaacgacggcgcgtcagccccccctccttgcaccgcacgcacaagcgcgcgtacgggagcgcgcgcagccgcgccctggcgatcggctcgtggcagacctcacaggcaccgtaggtaccggcatcgatcttggccaatgcatcggcgacctcactgagcgctgcgcgagcgctggcagcaagggcgaggtcgcgctctcggtcgatcgcggccgtaccaccctcgccagactcctcgtcgaactgcacctcgagaggcccgttcgtctgcacgagctgatcggcctccgccttgagctgcgaagcctgctgctcgagatgggcccgctcgacgaggagcaggttgcgctgctcctcgatgaacgtcccttcgtcgagcgcgtcgagctcgtcctcgtccaatgcgaggtacgcctcggcacgctcgtcgttcggaatagttcgctcagccatgaagtcctcactcctcgctacggtgccggccccgggcacgcacgagctgctcaatgatagctggcctccccgtcggcatcgacgccgacgaagaagcgcggcccagctcagcgctaggctggcgccatggacgaggcacctgagccatatcccgcgcaacctgcgacccttgacctcccagcactcgagcacgacgtgctcgcctcgtgggagcgcgaaggcaccttcgccgcgtccatcgagcgccgtcgcgccgagggggcgccagccttcgtgttctacgacggcccaccgttcgcgaacggcctgccacactacggccacctgctgaccggcttcgtcaaggacgcggtaccgcgctaccagacgatgcgaggcaagctcgtcgagcgtcgcttcggttgggattgccatggcctgcctgccgagatggcggtcgagaaggaactcggcctcaccagccgtgaggacatcgagcgcgtcggcgtgggtgtcttcaacgaccactgccgagccctcgtcgaccacacctcggatgagtgggaccgctacgtcacgcgccaagcgcggtgggtcgacttcgaacacgcctatcgcaccatggacctgccgttcatggagtccgtgatgtgggccttcaagcgtctctacgaccgcggactgatctacgagcactaccgcgtgctcccctactgctgggagtgcgagacgccgctgtcgaacttcgagacgcgccaggacgacgcctatcgcccgcgtatcgaccccgcggtcaccgtggccttcgccgtcgagggcgacccgagactcgcaggcacgctcgagggcccactctgggcccttgcgtggaccaccaccccgtggaccctgccatcgaacctggccctggccgtcaaccccgccgagacctacgtcctcgttcgctcccaagccagcgatcaagacgccggacgcacttacgtcctcgcggaagcgaggctcggggcctatgcggaccgatttcccgatgccgaggtcctcgcgcgcgtggcgggccgcgacctcgtcggccgtcgcttcgcgcccctgttcccgttcttcgccgacacgccgggcgcgttcgtcatcctcggcgccgacttcgtcaccctcgacgaaggtaccggcatcgtccagctggcccctggcttcggcgaggaggaccagcaggtctgtgaggcgaacgggatcccggtcgtggtcccggtcgacgaccgtggccgctacacggccgaggtcgagccatgggcaggggtccaggtcttcgaggccaacccggcgatcatcgaggtcctccgcgaccaaggagcgctcatcacccaggaggactacgagcactcctacccgcactgctggcgtaccgagacgccgctcatctaccgtgccatgagctcatggttcgtcgccgtcacggcgctcaaggaccgcctcctcgccgagaacgagagtatcgactgggtaccggcccacgtgaagcacggcgcttttggcaagtggctcgagggtgcgcgggactggtccatcacccgaaaccgctactggggtgctccgatcccggtgtggcgcagcgacgaccccgcctacccgcgtatcgacgtctacggctcactcgatgaactcgagcgtgacttcggcgttcggcccagcgatctccaccgaccggcgatcgacgagctggtgcgcccgaaccccgacgatccgaccgggcggtccatgatgcgacgcgtccccgacgtcctcgactgctggttcgaatcgggatcgatgcccttcgcccagctgcactatccgttcgagaacaaggagcgcttcgaggccaacttcccagcggacttcatcgtcgagtacgtcggccagacgcgagggtggttctacaccctccacgtcctcgccgtcgccctcttcgaccgaccgccgtttcgccactgcatcgcgcacggcatcgtccttggcaacgacggacgcaagctgtcgaagcgactgcgcaactacccggacccttgggaggtgttcgaggagatcggcgcagacgccatgcgttggttcctcctctcgtcgccgatcctgcgcggccaggagatgctgctcgagcgcagcgccatggtggacacggtgcgccgggtcatcaatccgctctggaacaccttcaacttcctcgtcctctacgctcgcgccgatcaccttcgcggccagcgcgtccacagcgcgacccacgtactcgatcgttacctgctcgccgcgacccacgatctcgtcgtcgaggtgaccgacgccatggatcacttcgaactctcgcgtgcgacgacggcggtcgagcgtcacctcgatcgcctcacgaactggtacgtccggcgcagccgctcgcgcttctggtcgcggcgcgacgacaccaccgaagatgccaagcgcgaagcctacgacaccctccataccgcgctcgaaacccttgcgctcgtcacggcgccactgctccccatgctgagcgagcacatctatcgcacgctcacgaacgaggcctcggtccacctcgccgattggcccaacgccgaggccctcccgagcgacccgacgctcgttgcccagatggaacgcgtgcgcgaggtctgctcactcgcacactcgattcgcaaggcagcagggctgcgtgctcgcctccccctccgtcgtctcaccgtcgtcctcgcagatcccttcgatctcgagccctacgtcgagctcatccgggacgaggtcaacgtcaaggaggtcgtggtcgagcccgccgccgaacacccagtgacgtggcagctctcggtcaacccgcgcgtcctcggaccacgcctcggggcacgggtccaagacgtgatccgcgctgcgcgcgaaggtcgcttcgacatcagcggcgaccgcgtgacgtgcgacggcgtcgagctcgcgcccgacgagttcaccctgaccctcgccaccgacgaccccaaacgggtgcgttccttcgccgaccgccgcggcctcgtgatccttgagaccacggtcgacgacgaactcgagcgcgagggccttgcgcgcgatctcatccgtctcgtccagcagcatcgcaaggatcacggctacgagatcgtcgaccgcatccgcctcgcgatcgccctcgaccgcacgggccgggtccagggtgcgcttgcccagcacgccaacgaggtgctcggcgagtgcctcgcgaccgaactcatcctcgacgacgcagcggcactggatcttcccgaccgctcgcaggtgacgatcggcggcgagcaggtgacgatcgcgaccgaaccagtccgcgctctgacggagcccgacggccagcgctagcgacgcagaggggcccctcgcgccagggagtgcactcgatcggactcttcgagcgccactgatcaacgacgagtgtgtcgcccaccccgcgagcgaacccagagcgaccacgtccacgcgaggccgccccggcgggcagcgacgatcctcgctgcccgccagcgacaccaccatcagtccgcgaccggactcgctcgcagctcggccgcgctcgcgaacgcgtcatgcgtctcggcgctgtcgcgccccgacgccaccgcccacgcgtagaacaccaaccccaccacgatgtccgcaacgatgtcgtagggataatggatcaagcccttgtggtggtcgaagggagctccgaagcgagccgcaccgaagcaggcaagtgcgagcatggcgagcaggtacaccacgagccacgctccatgacgccagtcggcggccgtgatcttggcaacgggagctccgagcgcggccgcaacgacgtagacagccgcaccccccaagatccccacgacgagcttccagtcgacgctccagcccgaccagtagatgatgagcgtcccgccgatgaacgcgagcggcgcgaggatcttgtcgcccgagagccggaagggtcggtgcgcatcggggtggaagcgacggaacaccgagagcgacaccggacccatgacgtaggtgaacgccgtcgccgacgagatcaccccgaccagactctgccagctcgggaacggcagcaagaagacgatcgagaacacgaccgtgatccccatggcccacaccggcacgccgaagcgctccgagatcccggtgaacacccgtccgaggtaacgattccgagcagacccaagcacgacacgcccacccgacgagaggtagacgagtccggttcctgacggagagaggacggcgtctgcgtagagaacggccgcaagccaaccgaggccgatcacggtcgcaacctgcgcgaacggcgatgtgtagctgaggcctgcccagcccttggcgagggcggcgtgcggtacggcggcgatgaagaccacctggaccagcgtgtagatgagggcacccaggaggatggcgctgatgatggcgcgcgggacgtcgcgctgcgggttgcgagcctccccggcgagatcgaccgcctgacggaaacccagcagcgagaagacgatcccgccggacgcgaccgcgatgaacacgccggcgctgccgtagggcaagaagccgtgcgtggccggggccgtgtagttgctccagtccttggcgacgaacaagatcgcgaggatggtgagcgtcggggtcacgaacttgaggaacgtcacgaccgagttgatcttcgcgaacaccttgaccccgtagatgttgatcgcgaagaacacgaccagcaagatcgcctccacgacaaagtcgaggccagtgttgttggcgaacgctcggatgtagtgctctgcgtactggacgaccgcctcggcctcgatggcaggaacggccgcgtatccgaggaaggcgccccaactcatgatgaacccgaccagtgacccgtgggtgaagtgcgggaaccgcgtgatgccacccgcctcgggcaacatacccgacagctctgcgtagaccagcgcgatgaagatcacgatcaccgccgcgatcagccacgccaccaccgccgcagggcctgcgtagttggcagcgtacagcacgccgaagagccaaccggatccgatgatcgccccgagaccggcgaacgtcaggtcgatgtaggacatctcccgtcgtaaccggccccgccctccactgtggtcgctcgccatgcacaacctcccccgtgcgatcggcaaccttcggatctcgctccgaaggccgtacgcggacctgcccacgtacgccgcgaacgctagcagccgcgatgccgatgcgggatacggaatgcaacgaattcacgaaccagcaacggcccgatcgtgtcaccgtgtcctcgccgcccagcgagctatcgcgtcgacgctgcgtgttccgcgcaccgctggatcgggagcaggtgactccacccccgcctgaaggcggggacttcgggtgcgctgttcacgcacctgtggctcctaccgcaggaggaaccttggcggaaacgcctgccgccgtgcggcggcgactcgggccagaagccctgcccgcgctgtccaccgtgcgccccacggcaataccaccaccaacgagggcgatggcccgatcaaggatgttccgtgcggccaccgcgtccgcatgtgcggtatgaccacactgcacgcatgcgaacgatctcccgcaccctggcctgctcgctgggtctcggaccccgcatgcaggacaggtctggctcgtgcctgccggtggcaccgccacgagcagggagccgtacttcgggcacttgtagtccagttgccgacgccgctcgccaggagctatgtccaagatggaccggttgagtccggctttctgacggactctggtgccgggagcctcgaccgtgcccctggccgagctcgtcatgtgcttcacccgcaagtcctcgatggcgacgaggctgtggttcttggccaagtcgctcgtgagcttgtgggtgaagtcctggcgtctccgggcttggcgagcccggagacgtgcgatctcacggatcgtccgacggagtcggttcgagtaccggcctccgttgtgacgcttcgcgtaggtgagctggcgagccttacgccgttccaggccacggagccgacgctcttcgcctggggtgagcgtcgggggcatgatcctcggggcagactcgccagcgacgtaggcggcgcaggcaataccgaagtccacgcccaccgtgggtccgtcgttcacgggcgcgcggtgggtcgtggcgaggacggtgaagttcacctgccacacgccaccgagcagcggaacgtggccgaggcaagctcaccatcgagtgagcgcgagcgtcggaaccggacccaccccagcttggggaggcgcacttcggaccattttcggttgaggtggcggatctggagatcggaggccgagggccggaagcggagttggccgcgcctctcgaaggctggcttacgggcgcgtccttgccaccagttctggtgtgcccgatccacgtcacgaagtgcttgttggagaaggtgtgccggtggctcggccacccactcgacgcacgagcgcagttcagccagctcgtgacattgttcgcggtacgtcacctgcgccctcgctcttgaccacgccagttgccgatgctcgatggcgaggttgtgaatggcacggcgagtatgtgcccaggtggtcattctggctgcctggtgcgggctcggggagagccggtagctccgaccgacgtactcgcccacgtcaccaacgctcgtcagcgtcatacctgcaaggaggggctgttcgaggtagtgccctacgtcgagtaacagcgccgaccagcatgagagcgccgcttacctcccgcctcgaggcgggagtccgcgcggcgcgttgtggtcgccgtcactgcctcggcgatggactcggtccgaggcgagcggtcgctcgagcggcgagctgacggtggcgcgacctcgcggccctggacccccgggtgagggcaccgacgcgtcactcgagacggccgctggatgcctcgacgggtgcatcgagaccgaggtgcacgtatgcccggggcgttggcattcggcccctcggcgtgcgcacgatgaggccacgctggatgaggaacggctcgtagacctcctcgagcgtgcccgcgttctcccgcaccgcaacggcgagcgtcgaaagtccgacgggacgcccagggaactggacgcacagcacccgcaagatctcgaggtccacgcgatcgaggccgaggacgtcgacgccgaagaggtccaaggcctcgagcgcgagctcacggtcgatcgcaccgtcgccgcgcacctcggcgtagtcccggacccgacgcagcagccgattcgcaagcctcggcgtgccccgcgatcgacgagcgatctcgagcgccgcgtccggctcgatcggcaccgagagggtgcgcgccgcacgttcgaccaccgcaacgagctcgtcgtcaccgtagtagtcgagccgatagtggtagccaaagcgatcgcgcagcggcgccgagatgagcccgacgcgtgtcgtcgcgccgaccagcgtgaagcgcggcacgtcgagtcgcaccgagcgagcacccggccccttgccgagcacgagatcgacccggaaatcctccatggcgccatagagcagctcctcgacggcccgggggagtcggtggatctcgtcgatgaagagcacttcaccaccgtggaggtcggcgagcaacgaggcgagatcaccgatccgctggagcgcggggcccgaggtcacgcgcacaccggtgccgagctcgcgcgcgatgatgaaggccaacgaggtcttgccgagcccgggagggccggcgaacagcaggtgatcgggcgtctcaccccgaccacgtgcggcctcgagcagcacctccaactgtgccttgagctcccgttggccgatgaagtcggcgagacgctccggccgaaggctctgctcgagcgcccgttcgagcggatcgagcgcgatggcgtccgatccggctgcgcggcgtcctccggcccactcgcgacgcggactcatcgagccagctccttgagcgcccagcgcacctgggcctcgaagtcaaggtcgccggggcaccgccgcacgacggcgtcgatctcgcctggccggaatccgagttcgccgagcgcagcccgcagcgcggacacctcctggctcatgggcactcccgtcacgggcgcgaggcgcttcgcggtcggcgcaagctcgaggacgacccgcttggccgtcttcggtccgacgccggcgatcgcggtgagccgcccgaggtcctccgtggcgatggcggtccagagctcgtcaccctcgatcccgccgaggatgccgagtgcgagctgcgggccgaccccactcaccccgatgagcgcatcgaacgcctctcgctccgcctggctcgcgaagccgtagagggcaatggcgtccgcccgcacgatcgtgcgtatccagagctcgcactcatcatcgcggcggagcagcgtcgcccacggagcagtcacgtgcacttcatagccgacgccagcgacatcgatcacgaccggtgagcgcccggcgctcgccacgcggccgtggagccacccgatcatcgctcccaccgccgctgcgcgagccgcgtataggcgatcgccatggcgtcggcgacatcgggcggctgcggcggctcgtcgagaccgaggagccgcacgacggtccgctgaacctgctccttggccgccgacccgccgctggtcgccgcgttcttgaccgtgttcggggagatgtcgtaggccaccaccccacgccgccagagcgcgagacgaacgaccccgacgacctcggacaccgggagcgccgaggagacgttgcgcgtgaaggcaagacgctcgatcgccgcctccgtcggatcgaaatcgtcgagcacgctctcgaacccctcggcgatctcgtgcaaccgactggcacggcatgcccgtgccgccgtcgtcacgagacccgcgcccacgagacgtagggtatctccggtcgcctcgatcaccgcataccccaggcgtgcgagacccggatcgacgccgaggatgcgtagcctcgcctcaggcaccgacggcctcgcgaaccgcctcgagcagctcatcggagggacggaacgtgagtccagcccgcgcgatgtgcaggtagatcacccgctggtcgcgatcgagcacgaagacgctccgccgatagaagccgagcggaccgagcacgccataggaccgggccacctcacgatcggtgtcggcgagcagcggaaaggcgatcccacgtcgctggacgaagctctcgtgtgaatcgagaccttgcggcgagatcccccacatcacggcaccgagcgcgcgaaagtcatcgatggaggctgagtaggcgcgcagctgggccgagcacaccggcgagaagtcctcggggtagaacgcgagcacgaccggcgtcccgcgttgcgctcgcaggtcgtagcgctgtccaccggtgccggggagcacgaacggcggcgcttcgtccccgagcctcacctggctcactcggccacgaactcctcgaggagcgactcgggcatgtcgaagttcgccgtgacttcttggacgtcgtcgaggtcctcgagcgcctcgacgagcctgaggacccgacgggcctcctgggggtcctcgaccgggacggtggtctgcgggaccaactccacctcggcgctctccaccgcgaacccagcggcttcgagcgcatcacggacggcaccgagatccgacgccgcgacggtcacgagccacgcatcgccgtcgtcggtgaggtcttctgcccccgcggcgagtgccgcttggaacaactcgtcctcgtcagcgtcgcgcgagagacgaatctgtccgagacgctggaactgccacgacacggcaccgggctctgcgagcgagccgccgttgcgcgagaaggctgcccggacgtcggcaccggttcggttgcggttgtccgtcaggcacgacacgatgatcgccacaccacctggggcgtaaccctcatagttgacctgctcgtagcgagcaccttcaagctcaccagtgccgcgcttgatggcgcgctcgatcgtcgcctggggtaccgaggcgtctcgcgccttctgcaccatggtacgcagcgtcgcgttcgccgaggtgtcgcctcctccttcacgggcagccacctcgatctggcgaattagcttggcgaacagcttgccgcgcgccttgtcgacggcgcccttcttgtgcttgatcgtcgcccacttggagtggccggacatggtcctccttgctacccatacgtgcccgtcaccgggcaagcagagcttactcgtgccgcacgaggtgtcttgagatgtcctcgcggcgtgcgccaccccgcgcgaaggcgaggacatggagccgtgcatcaccgagcaactcagggtggaacgaggtcgccacgacgttcccctgtcgcacgacgaccggcacggttcgctcggatccatcggcgaactggtaggccacctgggcgaccacgtccaccgaggatcccacacgcgtcacgacgggcgcacgaatgaacacggcccgcatcgggccgccgtcgacacccacgacggtgagatccgcctcgaaggagcgcacctggcgcccgaacccgttccgtcgcacgtcaacgtcgagcaccccgaacgaccattggtcggggcgccctccctcgatgccacgagcaagcaagatgagtcccgcgcaggtgcccagcgctggcatgccctcggcgagcgccgccgccaacggctcacgcaacgcggccgcctcgatcagcaaggcctgcgtcgtcgactcgcccccgggcaacacgatcccgtcgacagcggcgaggtcggcgagacccttgacggggcgagctgcgaggcccgcagcggcgagagctgcgaggtgcgcgtctgcgtcgccttggagcgcgagcaccccgatcatcggctcaccaaccgcgctcggcgagtcgctcgtcgatctgatcgagaccgaggccgaccatcggctcaccgaggttgcgcgacaccgcgagcaccacgtcgggctcgttgtagtgcgtggtcgcctccacgatggcacgtgcccgcttggcgggatcaccgctcttgaagatgcccgagcccacgaagttcgcctcggcgccgagctgcatcgtgagcgccgcgtcggctggggtcgcaatacctcccgcgcagaacagcggcacagggagcttgcctccgagcgcatggacctcagcgacgagttcgtagggagcgccgagtcgcttggcccatccaaagagctcctccgggcgcgcctgggcgatggctcgcaggtcccgcgtgatggagcgcaggtgtcggaccgcctccacgacgttgccggtacccgcctcacccttcgaccggatcatcgccgcaccctcagcgatacgacgcagcgcctccccgaggttggtcgcgccacagacgaacgggacctcgaaggcccacttgtcgacgtggaactcctcatcggctggcgtgagcacctcactctcgtcgatgtagtcgacctcgagagcctcgagcagctgagcctcggcaaagtgcccgatgcgaaccttggccatcaccgggatagtcacggcgtccttgatctgctcgatcagggcggggtcgctcatgcgtgcgacgccgccatcacgacggatatccgcaggaacgcgctcgagcgccatgaccgcgaccgcacccgcatcctcggcgatcttcgcctgctccgcgttgaccacgtccatgatgacgccgcccttgagcatctcggcgagtccccgcttgactcgtgccgtgccgacttcgtactgggtcatggctcctcccttcgaacctggccgctccttgtgtaccagagtctaggagggccgtgtaccacacactcgctcagacgtcgatcggtcgacgtcgggtcgcccacggctcgtcctcgatggcgtctgcgcgcgccaggagttcgtcagcgttcatccccgtcgccgcccatgcccaccacacgagcccggccgtctcgcccgtcggctcctccgcgaggcggcgcaagagccgtgcgacgaccggagggtaccgagtaactgcacacgcgaccaggtcgagctcccacgcgagcgcgctcatccacgggcggcgccgaccgccaccgaggatccgatcgatccccatcgcgagcgacaacggcccgagcaatccaagcctccacgcggcgagcgtgcggaccactagcgcctcgagttcgaacgacgacgcgagccgtaccgccccggcggtcagcacgacgagcggctccccgcgacggccacggaccaaggctgcgttcacggcgtcgccctcgatcaccgcaacctcggtggctccgagcccgagcagcggctcgaccccctcgacgatcgaggcgagccgcgcctcgtcggatcggctgagcgcggctcgcctccctcggggcttccggggcaccatggcgacgaccaacaccacagcggccacgatgatgacggccaccaccccaccgagggcagcggccatggcggtgagccctaggagcgctcccacgacgcccaccacgacaccggcaccgatcgcaaccgcggcaagacgcgcgagagcccccgtgagcaccactcgacgccgcaacggccgccgcacaccccacagctcgataccacccgtgttcacgtcaccgacccctctcgactgacccgctcgacgagctcgaggtagcgacgagcaatcgagccgatgtcatgggcgtgtgcgcgctcgtagcctcgtgcgacgagcacacgccgacgatcgcgatctcccactatcgagcgtattgcgccggcgagcgccgatggatcgtttggctcgacgagcacccctgcatcggcgacgaccggccggtagccctcgattgcactcgcgaccaccaccgctccccgcgccatcgcctcgaggagcaccacaccgaacgactcgccgccaagcgacggcgcgacgaggacctcggcctcccggtaggcacgatcgagcgtcgcgtcgtcgacgcggccccgccacgtcaaccaccccggccagcgctcggcagctcgacggacgagcggggcgagcgggccgtcgccaacgatcacgaccgacgacaccgagtccaccagcatcggcagggccgcgagcaagacccgaatccccttgcgctcctcgaggcgcccgacgaacgcgacggagccgggcctgcgtgcctgatcatccggcaccgcttcgggcacgctgagcccgttcgggatgatctcgatcgggccgggggcccatgcgcgagcaaccatcgctgccgatggcgagaccgccgtcgcgacgcgtattccccgcgcccccacgcgaccaacacctgcgagcagagccctgccaaccccacgcggcatccctgcgcggtgcccggtcgcgatgacagggatgctcgcccgacgggcgagggcgatggtcatcggtccgaccaggggcacgagcggctcgtggaggtgcacgaccgtcgcgcctcgcatcgctcgcgacagcgaccggaccatgcgcagatcccagccgatcggggcacgggacccgttggcagggacccgaaccgaccggccgagaccgccctgcccaggtccgaccagatccaccgacacccccagctgcgagagggcgcgcgtgagcgccgcggcttggcgctgcacgcctccgggaacgtcgaggtcgtaggggcacacctcgaggactctcacgaggtccgcctcacgtcgtcacagtgcgagcatcggcgaccaggttgtgccattgactcggtgcggcctggatctggcgctcgagtgcgcgcaccacccgtcgatgaagctcctcgatgcgagcctctcgtgacccctgcgtcggcggcatgatcggcgcccagatccgaatcaggtgcctccgtcccggcagctggtagcacgccgccgggtagaccggcgctcccgacaacaccgacagcaccgccggcccggctgccaccgagaccttccgaccgaacagttccccgggacgacccgaaccggtgacgtcgcgatcgaccacgagcgcgacgcgcccaccttcccgtagggtgcgcaacagagcccgagttgcctggacgccggtggggacgacgcggatgccgagcgcatcacgcagtcgatcgaagaagctcgtcaccgacgcctcgggaagtcgctcggccaccgccgtgacgggtgcgccggcggccgacgcccacaccccggcgacgtcccagttgccgacgtgcgccagggcaacgatgcagccttcaccgcgcccgaccgcctccaggaatgcctcgtggcccgtcacctcgacgccgtcgagcagacgcgccatcgcgtgaggggctcggagcgtgtcgacgtagtagcgcgcataggacacataggcccgaagcgtccaggcgatcgcccgcggatcgctcatcgggcgtctccgcgccaagcactggtgctcccaggcgatacgccgccgcgatccggtcagcacaaaggcgatcgccccaccgacccaccagacgatcggatcgagtcgccacggcagccgtcgcaccaacgcagaggcgatctcgaaccgtcgagctcgcagaccagcgcgcagcgaccttgcggtccgcaccgcctaacgcgcgtcgcggcgccgccgacgccgagcagtggtcacttcccgcgacccgagcaaaccgctcagacgcgtccgcagccgcgcccgccgccgccgattctcgcgtcgcagcgcgacgaggcgctcatgggcacggagccgatctggctggcccgaagccgagcgccagatcctgacgaagcgctgtgcagccgtccaggtcgacccgaggagcagcacccacaccgcgatggggagcagcgcccacacggcgatgccgaggaggaggacgaccgagcgctcagcgcgctcgaagacgccacccttggcctggaaaccgagcgactccgccttggcgcgctggtacgagatgagcgacgccgcgagagcagcgccgaaggccgccacgccaagaccaggctgatgctcgacgagcaccaaaccgaccccaagtcccccgaggaccgccgcgtcgctcacacgatccgagaccgagtcgaagaacgcgccgcgacgggaagcagccccactcgccttcgcaacgggaccatcgagcaagtctccgaggaagccgacgagagccagtgcaaggcctacccagcgtgcgccgaacgcgagcgcgaggccggcaccgatcgccgcgacgatccctgcgccggtgagcacgtctggtgtgatcccgagccgcgcgagctgacgaccgaccggcgcggtcgcccgatcgacttgccccctgaactctccgtccagcacctccggccactccttgcgatcgcccatccgatgtcgtcgtcgctgcaacgcatctacgctcggacaacgctacggcgtagcctaccacatcgcctccacccgcctgtgctggtcgcacggggcgtgctatggtgggccagctgcatcgacagcttgggaccgacgggaggtgccgtggacgccactgtcgcagcgagcccgcgtgctcgcatcatctgcgtcgtcggacctgcgggcgtgggcaagaccacgctcgtgcaggcgctcgccacgctccagtctccaccgacgcgcggcgacgacgatgcccgcgcactgatcgacacgtcgccggaagagcgcgcgcaccaccactccgtcgacctgggcgtcgtacgcctcgagcaccgaggccacgcgatgaccctgctcgacgtccccggtatcggtgagctcgccgctgcgcgggcacttgcactcgccgtcgccgacgcagcgctcgtcgtggtgccacccagcgacagccccagcccggagctcctgcgcatctggcgcgagctcgacgagcgccaactgccccgcttggtggtcgtcaatcgctgcgacgacagccgctgtgcgatcgacaccgtcgtccgtgccctcaacgagcgcctcgaggcccatctcgacgccgtcgagctcgtcgccatcaccgccgacggccatcaggacctcatcgacgtgctcgcggaggcgtccatcgtcggcatcggcactgacgagcacctcgaaccgctgcccgaggtcgagcgcgagttcgagcgccaggcacacgacgccttgctcgacgacatcgtggccgaggacgacgccctcctcgagcgctacctcgccggtgaggagctcgacccgaccgagctcaacgctgcactggcgatcgccatccgcgagcggcacctgacccccgttctcgccgcgtcggcgaccacgcgtctcggcctcacccatctcctcgacatgctcgatgccctggtaccagcgtcgccgacgccaacggacaccacgagcgcgctggtcatcgccacaagctccgacaactttcaaggtacgtccgcgacgctcgccatcgtccgcggcgccatccggcccgacagcgtcctgcgcgactcggcccaggaccgcacggagcgactccatcagctgctctggccgaccctgcccaagcctacgccgacgacggaggccgccgcgggtgacgtcgtgatcgcccccaaggtgggggccgcggtggggacctggctcatcgatcctgctggccacgacatccccgatccagtgcagcgcccgacaccgacctacacgctcgccgtcgaggttcccgaccagcgcgccaacgacaaggttcaagcagctgccgctcgcctcgccatggaagacccagggctgatcgtcagccgggaggcagagacccaccgcctcttgctcaccggcatgggggcgacgcacttggctctggtgatcgagcgactcggccgccgcagcggagctgcgatccagacggtcacgccacgcacgccctatcgcgaaaccattgcgggcacggtcgaggtggaagggcgccacaagaagcagaccgggggccacggccaatacggcgtcgtggtctgccgcatcggacccggacctcgtgcgagtggcgtggtgttcttcgatgagatcgtcggcggggccataccgcgaaccttcattcccgcggtcgaggcgggcattcgggaggcgtgcgagcaaggtggtccgcatgggttccccgtcgtcgacctcgaagtccacctcatcgacggcaagcaccatccggtcgactccaacgagctcagcttcaagcttgcaggggcgctcgcgctgcgcacggccctcgagcgagcagggagcgtcgtcctcgaaccgatcgcacgtgtgcacctcagcgtcccggcaagcgcacagggcgacgtgctgggctacgtgacgtcacgccggggtcgcatcatcgagtccactccggtcgggccgagcgtcgagatcgaggcagaactgcccgctgccgaactcacgcatctcgccgtggacctccacggcctgacggcgggccagggatcgttcacgagcacgcacgaccgctacgagcccgtcccaaccgcggtcctcggacgcttgctcagcgcgacatccaagtgacgccgccctacggcccgactcggcactccctccctggcaactcacggtcgacgaccacacctctgcaccccgtacacccgagaaccgtgcgttctgcggcgctcggagagagcggtatcgtgaccaccgatcctcccttgcccaaaggctgtgatcgagtcggggcacgccacggtgagctggtgcgactcggtggcggcagccggacctcggagtcgctcggcaagcatgtcgccatggccgcaggcagctggcggtggtggctcgtcgagccaccaccgggtgcgtaccactccggccgacgtcggcagactcgatgaacgcacgcacagtcagagggccagtcgtgcgcgccgcgatccgctcctttcggcaggggtccatccgctccagtgaacgacgaggtcccccgcacggctcacgttggcctttgcacgcggccttcacgacgcgcgggagcacctccgctccaacaagccgagagcgacggcggcttgcacgcgggcgatcggctccgccacgacgctcaggcctcggctctggagggctctcacgaggtcacgctgcgctccgctctcgttcggaacggcactcgcgccgtccgacacctctcggcacgttctccgcgacggcgaccacatggagctcatgtggccccaacagatcacaccacgcggatcggtgactcgacaagggacgaattacccagcgttgtcgatcacctcaatgcgattcccaaaggggtcgtcgacgtataagcgccggactcccggaaggtcttcgtcccaccgccaggaagcgcccgacgcttcgagcttcgcaacgagatcgtccagctcctccactcggagggcggggtgcgccttgcgcgccggcctgaaatcctcctccaccccaagatgcagctgcacgggcccgcacgcaaaccagcggccaccacgagctgcgagcggctctggcttcgcgaggacagtgaagccgagtacgtcgcggtagaacgcttctgcctcgggctcgcgaccggctggcatggcgagttggacatgatcaagggctacgactcggacgcccacgacgtgaatcctcccacccacgctcgactcgtgccgcgcccggcgccaagcgctcatcaccgctcgcgaccactgacgccgagaacagctggacgcctccttcccagaggcagcctcagacaccgcagtgctcgtcctgtcaggtgccaagcccagcgaggcgttgtgcatgccgggcaccgacgtcgatctccatccgtcgtgccactcgcgaccacatcccgcgaggggtcgtccccaggtccgcgcctcttccccagagacaccgtcgcggacgacgagcgtcacgacccccgcggccaccgctcactcgagcggcgcgcgcgacccacaccactgctgcgagtccagaaggccgatcagctcacggagcaactgccgtactcgggcccggcgccggcgtcactacgagctcgccggccacgcgcggcgcaaccgatcgcgcgtgtccccgagtgcctcggggaggacccgtgtctgcgcggcggtcaccatgaagttcgcgtccccgacccaccgaggaacgacatggacgtgcaggtgctcgacgatacccgcacccgatgcccgaccaagattgaggccgaggttgatgccctggggatggtaggcgctctccagcgccgccattccctcgcgcacgagctcccacatctcgccgagctcctcgtgcgagagcgcgccgaggtcgctgccgtgccgccgcgggaccaccatcaggtgccccgacgtgtacggatagaggttcagcacgcagaaggcacgcgcgcgacgagcgaccacgagatcatcggccccatcggccccgtcgccgatcgcgcacaggacgcacccgtcgaccgccggagcaccctgcgtgacgaacgcggagcgccaccccgcccagaggtagtccatcacggacgcacctccgccatggcgaccgctcgtgcgatctcgtcgatcgccgtctcgagcgcgacgccgcgggcctgcgaccgatcggggcgcgtcagcccgaccgaatgcgcagcgacgtcatcgttgcccacgaccacgatgtaggggactcgctcggtccgagcacgtcgcacccgtgccccgagcggttcgtcggccgcgaccacctgagccccgacgcccgcagcaacgagcgcagcacgaacctcctcggcccagccggccgcctcatgagccaccggcaaaatgcggaccggttcacgcacgagccacggcggcagctcaccatcgaagtgctcgatgaggatggcgaggaagcgttcgacggacccgaagagcgcccgatgaatcatgaacggacgctccatccggttgtcagcgccctggtagccgaggtcgaagcgctgcggcaactgcagatcgacctgcaccgtcgagagctgccagcgccggccgatcgcatcacgcaggtggatgtcgatcttgggcgcgtagaacgcaccctcgccctcggcgacccgataggtgagccccgaccgctccagcgcgctccgggcggccgacgtcgcgaactcccagtcctcgtcgctgcccacggacttggcgggccgcgtcgacagctcggcctcgaagtcgttcagcccaaaggcgccgagcaggcgcatcgcgaggtcgagcaccccggtgagttcgtctgccaactgatcgccgcggcagaagatgtgggcgtcgtcctgcgtgagcgagcgcacccgcgccaatccgtgcaaggtacccgaacgctcgtagcgatacaccgtggccagctcgaacagccgcagcggcagttctcggtagctacggggatgctgccggtaggcgaggatgtgcatggggcagctcatcggcttgaggaagtactcctcgtcgtcgagctccatcgccgggtacatcgactcgcggtaccagcccaggtggccagagagctcgaacaaggcgccgcgcgtgacgtgcggcgtccacaccgggacgtagccggcggcaaagtggatgcgacgggagaactcctcgagacggtaacggacccaagccccgtcgggctcgaacacggggagaccgccgccgatctcacgagggaagaagaagagccgctgctcctgaccgagccgacgatggtcgcgccgctcggcctcggcgatctgcgtcagccacgcctcgagcgcctccggggactcgaacgccgtccccgcgacgcgctggagccgtgggccgtgctcgtcgccgcgccagtacgcgccagagaccctgagcaggcggagggccgagagatggccggtagagggcacgtgtggccctcgacacaggtcgatgaagtcagcacccgtgcgatagatcgagaccgcagagcccgaagcggcatccgtctcagcctcgccagcggcgatgcggtcgaggatctcgagcttgaacggttggtcggcgagctggcgccgagcctcgtcgagctcgagctcgatgcgctcgaagggttcgtcggccgcgacgatgcgttcgacctcggcggcgatcgcggcgagatcgtcgtcgtcgagactgcgtcccccggggagctcgacgtcgtagaagaacccctcctccgtcgccggtccgacggcaaggtgcgtacccggccagaggcgcgagatggccttggcgaccacgtgcgcacccgagtgacgaagcacctggcgaccctcgggtgtcgaggcagccacaagggtcgcacccggaccggctcgatcgagatcaacgagctcgccgtcgtccgagcgcgccgcgaccggtcgagtggggtcgacgaaccggctcacagctcgaccccgagcatccgtgcggcctcgctcacaccccgacccgctcgagccgcccggtcgatggcctcgagtgcacccggggtgtcgaggtcgttgtcgagcgccgcgtcgacctcgtccacggcaccgtccccggtgccggctgcgcgccagagcccatagcgctctcgcgcctcctccaggagcccacccgtccagtcccacgacgtccggtagtgctgcgacagcaacgcgagccgtaccaccgcagcgggcacttccttgaggagctcgcggacgaacacgaggttgccgagggacttggacatcttgacgccgtcgagccgcaccatgccgacgtggacccagtggcgcacgaagggttcgccggtgatggcccgcgactgcgccgcttcacactcgtggtggggaaagatgagatccgaaccaccgccgtgaatgtccaccacggggccgagctcgcgcatggcgagcgccgagcattcgatgtgccacccgggccgacccggaccgaaccgcgactcccaggcgggctcgtcggccaaggacggctgccacaacacgaaatcgagaggatcgtgcttcctgggatcgtcgggatcgccgccacgctccctggcaagtgcgatcatggtgtcccgatcgaggtgggagatcgatccgaacgtgggctcgctcgccacggagaagtacacccatccgtcgacctcgtaggcgtgccccgagtcgacgaggtcctgtaccagggacaagatctccgcgatcgccgaggtcgcgcgtggctcgaccgccggccgtcgcaccccaagggccgtcatgtcctgatcgaactgcgcgatctccatcgcggcgaggtcgaggtagttggtcccgagctcgcgcgccttgcgcaagatgtcgtcgtcgacgtcggtgacgttgcgcacacagcgagcgcgctgccgatggcgctcgaggtgtcgtgcgagcacgtcgaaggtcacgtagaccgccgcgtggccaaggtgcgcggcatcgtagggcgtgatgccgcaggtgtagatcttgatctcctcgcccggtcggagctctaggtccacgacccgttgcgcttgtgtgtcgtagatcctcattggccgtcgtcctccctgatacccaccactcgcaggctcgacctcgcgcgatagcgcaggttcacgttcagcagcaccgcggtcatcgcctccagtgcgccggccgcggcgagcgaaccgacatagagcgctcgcagaccgtcgatgctcccgaggagctccatgacgacaccagcggagctctggaagtccgaggccaccatggtgtcggcgtgcacggggcgcccgagctccgcgagatcgcgggccggcacgtggtgcagcgccgcgaccaccatcgaccgcgggagcgtcgactggaggagctgggccaccgatccgcgaggcggtgccagcgctgcgaactccgatcccgtacgcaccaacgcattcgcgacgcacaccacggtcttggccgcaagcgcctcggcgaactccgccgcgacaggcacgacgctctcccagggcacggcgaccacgacgagatccgagcgagcggcaagctcgttaccgcccccgaccagaccatcggcgagctggggccagcgatcgccgagccgactcgccgactcttgcgcgcgctccggattgcgcgagcccagcacgaccgtgcggcctgcctcggcgagtcgagcaccgagcgcactgccgagcggcccggtcccgccgatgatgccgacatccacgaacgcccccagagtcccatcacgaggacgccgctggggcaggactcgcaggccccaagcggctaccgtaggtccgagtctacggtgaaggagatcacatgggcatcctcgagggcaagcacgtgctggtcactggcgtcctcaatacctcgtccatcgcgtaccacgtcgctcgagtcgccatcgacgagggtgcggaggtctcgctctcgagcttcgggcgcgccatgtccatcacccgacgcgtcgccgagaagctcggcatctcctccgagatcatcgagctcgacgccgccgatcccgcgagcgtcgacgcagccgcagccacgctcggcgagcgacacgaccgtctggatgcgatcgtccactcgatcggctatgcgccgccgagctgcctcgacggccccatgctcgatgccccgtgggacgacgtcgcggtcgcggttcgggtgtcggcgtactcgctcgccgagctcgctcgcgccttccgaccgatccttcgctcgggcgaccatcccgccatcgtcggcctcgacttcgacgcgacggtggcgtggcccggctacaactggatgggggtcgccaaggctgcgttcgagtcactctcgcgctatctcgcacgcgagctcggtgccgacgggattcgcgtcaatctgatctcggcgggcccggtccgcacgatcgcggcgaagtccatcgacgcgttccgctccttccaggacagctgggccacgcgcgcaccgctcggctgggatccgaacgacgccaccccggtcgcacgcagcgtcgtcgcgctctgctcagacttcttccccgccacgacgggcgagatcatccacgtcgatggcggctaccatgcgatgggtgcctgagggcaccgagatcgctgcggctcacgtggccctgggcgttccgcccgacccaaccaggaggtgcaccgatggtgcgcatcccgagcacgctcgccagctccttcgcgatcgcagcttcgcttgccgccgcgagcgcgatgtcgttcgctcagccggccggcctccgcggcggtcagagcggcaacggctggaccgtcaccgcgaccggcgcgtcatcacacacgacccccactgggccgaaccctggcctccagcccgtctactggccggtcctcgtcacgcacacgggttcgtcgctcgcgacgagctgcgtcgaggtacgcacgctcgacccgggcgcgggatcgtatccgaccgtgctccaggcggccgaggccgcatgggcgcatcttgccggcgtacctcgctgtgatgcgagcgggccgtcgccgtcggccatcgtcaccctctggaccaggaccctcgcggcgacgctgaccccgccgagcgccgctgtctggccacccagggggatcgtcggcctgcccctcgaggtcacggtcgccggagcgaccactcggacgttcaccacgcagacccctgcgggacccctcgtcatccgggcgaccggagcactcgcggcgcagctcggttcagcctcgatcaccctggcgagcggcgacgccacgctgaccccggacgtcgtcggtagcgtccgcctgctcccgatcgagacctgggacgccgtagcgaccctcgggacgaccgagctcgcgctgcccgccgtcacgatcgtcggcccagccaagctcgtctcgatcgccgcactgcacgccgagctgcgcagcctcgcctagcgaacgcagcgagcgccaaacgagccgtcaccgacagcgtgcccgcacccgaggcaccaccgacgagtggccttgtctggactcaagcgctactggtcgtcgaggtcgtcaccgtggagcgtcgaggcctccacgtgggcgacgggttccgtccccaaccggcccgcctgatagtcctcgaacgcttgacgaagctcagacctcgtgttcatgacgaacggcccgtaccacgcgatcggctcaccgatcggggtgcccgcgagcacgaggacctgggtccgtcgcctcggggctgcgagtacgaccccttcgccctcgcccatcaccgcgagatgaccagcctcgacctcgacgcggtcctcgccgatcagcgccgcgccgtcgaagacgtagagcaagcacgtgcgcacggcaggggtcggaatccgagcctccgcaccggcctcgaggatgaggtgagcgaccgtcaccggccagtaggtgtcagccggacccgagatgcccccgaggctgccggcgaccaccttgaccagcgcgccgccatccgcgctctggccgatcccgagatcaccgcctcgcacgtcctgatagcgaggggccgcccacttctgccgtctggggagattgacccagagctggaaaccgtggaagacgccaccggtcacgacgagccgctccggcgggcgctcgatgtgcaagatgccgctcccagcggtcatccactggatgtcgcccggggcgagcgcaccaccaccgccgaccgaatcggcgtgttcgaacgcaccctcgagcagataggtcaccgtctcgaagccccgatgcggatgccagggggtgcccttgggctcgccaggaccgtagtcgacccgtcccatctcgtcgaggtggatgaacggatcgagttcctcgagtggcacgccagcgaaggcccgcttcaccgggaaaccctcgccctcgaggcccgacggcgcggccgtgagccgcacgactcggcgccacggacccgtcgccctcaccagcacgtcagctcgcgtcacgttcgtcatcgggcctcctttgttgcagatgcaatcatagtcgctcgtgacggacgaggagggctcgcaccgctgcgacgtcctcggcgcggggaccgtcgcccgctcccgggacctcgagcaccacatcggcctccggcaggcgccgatcggcgacgagcgagcagagcgcctcggctccgatcgccccctcgccgatgttcgcgtgacggtcgcgccctcgaccacgctcactggccgaatcgttgcagtgccacagcgccacgggcacctgtgccgcctggagcgccgtgacgatctcctcgcgccccgcggcttcgtcgatggcccagccgacggcgaacaggtgctgggtgtcgagacacacccccacccgcttcgtccggagggccccagccagggcccccagctcggccggaccggacgccaccgaacccgtcgccgggttctccacgagaatgcgaatcgtcgacgtcgcctcgagcacgcgctcgagcccctcccggatccgctggcgcgctgcatcagggtcgtcaccaggcgcggagccggcgtggacgaccaccgactcggcgccgatgccttcggcagcgatcgcggtctggcgaagcaacgccagcgatcgatcgcgcagcttcgcgtcgacggaggcgaggttgatcagatacgacgcgtggaccacgatccgttcgacgccggctcgctgcgccgcctcgcgcaccacatcaggctcgggcgccacgccgacggaccaccgccacgatcgaggggagcccaagaagcactgcgcaacgctcgcgcctcgctctccggcgcgttcgagcatcttgagcacaccgccagcggccgacacgtgacagccgacgcgcaccgtggcgaacctcccctgttgcaagtgagccctgttgcaagtgagccctgttgcaagtgagccctgttgcgagtgagccctgttgcgaccgggccctctgtctgggtccctccgtcttgctcggcgctgctaatcctcgcgaccgaactcgggcagctcgaccgtggtcgccgaacgcggcgactcggtcgcggccggcttcgaggatgcgccctcaccgaagaggtcctccagcatcgacagaccgtcatcgcgtgtcgtctgctcggcgcccgcgcccgcctcgtggcccgttggccggtcggccgtggcagcccccgcctcgtcaggggcgacctcggcccccgtgtccttggggccgtcctcagggctgtcgacatctggctcgccagccgacccgccggaccgagccccaccggcggcctctgcggcctcggcagcgagaccggccgcgtccttggccagcagggacccatcggccaccaggtcgtcgacgacggagcgagcgtgacgggcgagttcgcgcaagctgccctcgatcctgcccccctccgcctggagtcgctcgatcacgccggcgaggcttgcggcgagccgatcgctccgcgcacgcacctccgcggcctcacgctcgaaccgcgaccggaactcctcctccagtgccgcagctcgcgccttggcctcgtcgacgacacgggccgcctgggtcgccgcctcgcgccggagggcctcggcctcggcctcggcgtcgcgccgcaacgtctgcgccgtctcctgcgcgagtcgtagcgttcgaccgatcacgctgtccggatcgaggtccacctccacgccagcggcagactcctgggaacgctgctcgtcggcgagggcaaggcgtgcctcgagttcgcgaatccggcgtcgcgcgtcggcgagttctcgctcgagcacctcgacgccctcggccacgcgctcgaggaacgcatcgacgtcatcttggtgatagccgcgcatgcgttcgcgaaactcgacctcgcgaatcgcacgcggattgacgacatgctcgtccatagcgactcctgtttcgtacggctgcgggcgtctcgggccagagcgcggcggttaccgagcgatgatcgggatcaacaggagctggatgaccaagatcacgatgagcggagagagatcgagccgcacccctccgccaccgatggcgggcatcacacgcctgatcggcccgagcaccggctcggtaagccgcccaagaatgatgcggatctcatggagcgtaccgccgggattcgttaccgggaaccagctcagcacgaccgagagcacgatgatgatctcatagagctccagcaggtcgatgagcagtcccctaactcccatgctgtagtccggcccctctctgaacggtccgctgtcgcatccggaacatgtcctcgtccgcaacctcgatgcgcgctggcgacaggaggtagacgctggaggagatctccttcaacttgccaccaagagcataggcaagccccgcggtgaagtcgatgatccgacgccgaagctccttatcgactccttcgaggttgatgatgaccggctgatctgccttcatgcgatcaccgatctcctggacgtcggcgaacttcgtcggcatgacgagatggatcttcgcccgctcgggctgagcactcaacgtccgcaacaccggttgggtgcgttcctcgtgctcccccgcatcctcgccctgacccatcagcacctgcaccttcggtgttcccacggtactcaccggctccgtgcgcagccgccggtccgactcgacgacgtccctgtcgaaccctccagagatggttccttccatctcctcatcctcctcaaccacgcccaaccaggcaagcgcgcggcggaacccgctcatggaacctccactccctccgacgcgctcaggttagcacgtgaaccggggcgagggccgagcaaagcggtccccaatcgcaggattgtcgcaccctctgtggttgcccagcgccaatcagcgctcatgccaaacgagcgctcagggagctccaactcgtccgcaagggccacgagcgaacggaagaacgtccgcaccggtgcttcctcacccggcaacgcgacacccatcacgccgacgacacgcagaccaagggatcgagcggcggcgaccagctccggagcgccttctcgcggcacaccactgcgagtcgccggagcgtctggcggtgccacctgtacgaagacctcgccgtcgaagccgagggcggcgagacgttccgcttcgaccactctcgagagcgtctcgaccacgctcgcagcaccactcacctgcttgatctggcgacgctgcaagtgaccgatgaagtgccaccggacgtcgagatcgcggagcgcggcggccttctccgcgagctctgacgcgtagttctctccgagctcccgattacccgcctccacggcggcgcgcaccgtttcgaccggatgggtcttcgtcacgcagacgatgcgaggcggccggaccggagcgagcgtggccacctcggcctcgatggcgcgacgccgctcgcgaagctgctcgacgaggttcatcgacccggcccgacgaggagcgcttggcgcgcagacgtgcgatcccgccgccaggagtaccaccgctcctcgtggatggtacaggcctcgagatcgacgatctctccgacaccgacacgcccaagctggtcgcggatcgccgccgtgagatcgagcgtcggacctcgaaagtactgggggccaagggtggtctcgacctcgctgcgagcgggcccgacgaactcgtagcagcatgcccgggcgtgcgccccgatcaccgcgacccggacatcgccgccgagcccctccgctgccctctcgacgatccggccgaccacgcccggccaaccggcatggaccaccgcggcgtcgccgttgcgtgcggcgaggaccaccgggacgcagtcagccgatcgcacgcccgcaacgagctgatcgccgactcgccggatgatcccgtccgcgtcgacgccccgacccacctcttgcgcctcgacgaccgccgtgccgtggacctggtggacccacgcacacggcagctcccagccgaacgcactcgctcgtggccacagctccgcggcatccccgtcgccacgctcggtctggaccactcgcagacgcccatcgagcagactcagctcgatcacggtcgtctacctcagaaagaaaggaacgtccccgtcgtcgtcgtcgggatccggctccggctcggccacgacctcacgccgcggagtgaacgtgagcggtggcagctcggcgtcgtccacggcgacgcgacgcgtcgcgtcgctctccgaccaggtgttgaacccggccgcgatcaccgtcaccttgacctgatcttcgagggcgtcgtcgatgaccgacccgaagatgatgttggcctcgtccgaggcggcagcctgcacgatctgggccgccttcgtcacttcgtgcagcccgagatcttgcccgcctgcgatgttcatgaggatgcccttcgccccgtcgatcgaggtctcgagcagcggtgagttcatcgcctggcgcgctgcggtctcggcgcggccatcgccgcttgcctggccgatgcccatgatcgcggtacccgccgagcgcatgatggtccgcacgtcggcgaaatcggtgttgatcacaccgggagtcgtgatgagatcggtgatgccacgcacccccgacagcaagatgtcatcggccatgcgaaaggcctgcacgagcgaggtcttctcgttcgcgatcgtcaggagacgatcgttcggtatcacgatcagcgtgtcgacgtactcacgcagccgactgatcccatcctcggcctgctgggcacggcgacgaccctcgaacccgaagggtcgcgtgacgaccccgatggtgagcgcaccgagcccgcgagcgatctccgcgacaaccggcgcgccgccggtccccgtcccgccgccctcgccagcggtaatgaagaccatgtcggcccccttgagggcctcctcgatctcctcgcggtgctcctcggcggcctggcgcccgacctcggggtccgaccccgcgccgagccctcgcgtcagctgtcgaccgatgtcgagccgcacatcggcgtcgctcatcagcaacgcctgcgcgtccgtgttgatggcgatgaactccacgcctcgcaggcccgactggatcatgcggttgacggcgttgccgcctccaccaccgaccccgaccaccttgatcaaggcgatgtagttcgccttcgcgtccaccacgttcctcccgccgccgttggcccctcaatcccccctacgctaccgtgcccacacggaccgcttagccggaacgcacgccaaacgtgccggagggtccaagggcgagcacgttggccccgagggccacgcccacgcctccgcttcccaccaacgcgccacagctcacgagctccccggcgaccagagcgggggccggcccgagcacgcacgaggcaccggacgccaagaccgcgacgacccggccgccagcgctcaccacgcggcgcactccaccccgaaccccgacgacgaccgcacgtgcggcgaccgggccgacatcactgccgacggggggagggcacgcaccgcccgagcacagcgcaagatgaggctcgacggacgacgccaccgccggcacggccacgacccgtcccgacgcgagcagcgcacggccctcaccgagcgcgaccacgcccgttcgggcgcgcacgcgcacgatcacaccgtccggcaacacccgtcggaccgcgaccaccgccacgatcgggcgctcctcgcccagcatggcggcgtcgaccgccggcactccgagcacgagcggcgctccggcgagccgcgcgtcgagcgtccccgcgacggcgcggtccatcgcctgcccgagcccttcgacgcgaacccaccgaacccgcatccacggaccccacacgacgctcaccgcggcgccgacgcccagggcgagggccgtgagtccgatcaggactcggcgccggatgcgcctcgatcgttcgcgtcgtgcgtcgtcgagtcggtaaatccgacgagacgcacctccgtccgcagctcgactcccacccgacgagcgacttcggcgcggacgaattccatcaacgctcgcacgtcgtcggccgagccccccggatcggcctggatgaagttcgcgtgcttcggcgacacctcggcgctgccgaggcgataccctcgaagacccgcctcgtcgatcagcttggctgcgggagcctccggcgggttcacgaagaccgaccccgcgttgtgaccgcccggctgatgtgcgcgtcgccatcgcaccacctccttgatcatcgcctcttcgtgggcacgatccccgcccgccaactcgagctcggcctcgagcaccacctcggtgggaagcagcgcactgtggcggtagccgaactcgagcgcctcgcgactgcgtcgtctgatctggccgctcgcgacgtccgcgacgaccgccgagccgagcaccgccgccatgtctccgccgtggccccccgcgttcatgcgcaccgcgccgccgacactccctgggatgccgaccgcccaggccatacccgcgcgaccgaccgcggcgagtcgtcgggccgcgacgggcaggagcacggcacctccgaggatgaccggaccgtcgctcggggcctcgatctcggcgaatccggcgccgagctcgacgagcagcccgtcgaagcctcgatcggcgaccagcatgttcgatcccgcgccgaggacgaggatcggcaccttcgccgcacgaacgagcgcagcgatcgccgcgacatcctcgacccgctcgagcacgacgccccagcgagcgctccccccgacgcgataggtcgtccgcgcacccaagggaacctcacggtgcacctcgatgccgagctcgccgccgagacggacgagatcgctcacccgagcaagtcctcgagctcgctgtcgaccatggtcacgtcaccggctcccatggtcaggaccacgtcgcccgggcgcacgacggaggcgacgaaggcagccagcgcgccacgatcggcgacccagtgggcgcgctcccccagtcgctccgccgcggctcgccagacgacctcgccgctcacccctgggatcggctcttcaccggccgcatacacgtcggtcacgacgacctcgtccgcatcaccgagcgcccgaccgagctcgacaccgagcaacttggtccgactgtagcgatgaggctggaagacgaccacgatccgaccggagcccagctgacgcgccgcctgcagggtcgccgtgatctcacccggcagatgggcgtagtcgtcgatgatccgagcgccacggagctcgcgcttgaactggaagcgccgcgcgacgcccacgtagcggcgcagcgccaacgcgacggcgtcgaagggtgccccgacgctgagtgcagccgccaccgccgcggcgccgttgcgcacgttgtgcatcccgagcacgccgagctcgatactgccgaggcgccgatgatcgaggaagcactcgaacgccgaatgggtcggcgtgaggacgggattgcgaatctgcagccgcgctgcctcggcgacaccgtaggtcagggccccctccggggcgagagccgccagccgtggatcgtcgacacagatcaccggtgcgagcgcgctgccgccgacgaacgcctcgaacgaggcgaccagcgcgtcgaagctgccgtagtggtcgaggtgatcgggctcgaggttggtcgccacggcaaggtgacggtccaccgcgaggaaggtggcgtcgctctcatcggcctcgacgacgaacaacgacccgatccccgcgtgaccggacgctcccgcctcgttgagctcggcaccgatgacccagctcggtgcgaggtctgccgcctggagcgcctgggcgatcatggccgtcgtcgtggtcttgccgtgcgtacccgagacggcgacgacctgcttgcccgccgtcagcgccgcaaggagctccgcgcgcgacagcaccggcacgcctcgggcgcgcgcagcggcgagctcgacgttggacgacggaatcgcggtcgaggcggcgacgacgtcggcgccgtcgatccagcgcgcatcgtggccgagatggacctcgaccccgatcgcctccaaccgctcgacgagcggacctcgcttgagatcggacccgctcacgacgaatccccgacccaccagcacgctcgcgagcgcgctcatgccggctcccccgatgccgaccaggtgcacccgacgaatcccctcgagcgacgtcactccagccatcgcgccacctcctcgacgagacgttcggtcgccctttcggtcacgagcgctcgagccgccgctcccatggccgtgcgcagggatggatcaacggcgagctctgcgatggctcgccccagcctctcggcaagcccagggccctcctcgacgacctcgctggcaccagcggcaacgaagtactccgcgttggcccgctggtggtcacccggtgccttcggcaacggcacgagcacgctcgcgacgcccgcgatcgcgatctcggccagcgtcgacgaacccgcgcgcgcgacgacgacgtcgcccgccgcaatggcatcaccgagccggggatcgaaaccgacgaccggctggtagctcgccatcgggtctggcacctgcggtggaacattgcgctcgccgaggaaatgccagaccacgacgtcgtcgacgagaccgcgcccgacgacctcgaccatcgcggtgttcaaggcgagcgatcccagcgagccactcgtcgcgaccaccagcaccgcgtccggcgcgatcccgagacgcgacctggcctcggctcgcggtgggagttcgcgcgtgggtggacccacgatcaccgcacgatcgcgcaccaacctcggcacccgtgcgggccacgcgaggacgagctcgctcgcgaacggcgccatcagacgattcgctcgacccagcaccgcgttctgttcgacgaggacgatccgcgcgcgccgtgcggcggcgacggcgagcgcgagcacctgtggcgccccaccgagaccgaccgcgaccgacggttgcggtgcagccaggaggcggcgaacgttctcaccgaatgcgccgagcttcggagcgcggcgcgcgcggacgatcccagcctccgcaagacgcacgcgctcgatcgcgtgtcctcgcaacgtcgcatcctcgacgggacgatcgctggtcacgagcagcacccgggcgcgggcaccgagcgcggtcgcgacctcgaggcccgcgtggagatgaccagccgtcccgccagcggcgacccacacgacgcgatcgctcatcgacgccgctccccacggtggaccgaggcgagcacgaccccgagcgcgatcgcctcgacgaccaacgacgaacccccttgcgaaacgaacggcagaggaacgccggtcacgggcaagagccccaccacggcaccgagattgaggagtgtctgcgccgccagccacaccgccacgagcaccgccaccgcatgcgcacccgacatcggcgtccgctcggcgagcgccagtaggccgaggatgatcccgccgagcgcagcgatgaccccgagcgcaccgatgacgccaaagtcttggaccacgagcgtcatgacgaagtccgtgaccgcattgggcacgtagccccagttggcgagtcccgctcccaggcccgaccccgtgacgtgggcggtggcgaaggaaccgagcgcctggacctcctggtacgacaggcttgcacgatagcgccatgggtgcagaaacgacagcaggcgcgcacgccgatacgccgacgagaaggcagcgagcgtcgcgaggcctccgcccgtgagcgcgatgggagcgagtcggcgaagcgggaccctcgcgacgaccagcgcgccggctccgatcgccgccaccaccagtgcggtgcccatgtcgggttcgatgaagatcgcaccagcggtgaccgccgtgaccacgagcaccgggccgaggacgcgctcgctgggtcgtgacgtgacgagcttggcgaggtagagcaccagcgcaagcttggcgaactccgatggctggatctggaacgggccgacggggatccatcgctcggcgcccccgacggtcgtgccgagcccagggaccatgaccgcgcccagccccgccagcgccgccgcgaggagcaccggcgaccacgcgagcactcgctcgaggccggcacggcgtacgaccacgaagctcacccatcccatcgcggtggcgatcgccacccaggcgacgtcgtggagggcggcggacaccggcgaacgcccgaccgctgcctgtgcctccacggtcgcggccagtccgacgagcgtgccggcgagcgcgagcccgcccccaaggccgacgatccagccgacggccgagccacgcccccgacggcgcccagagggccgaacacgtgcgtcgatcaccgccacgcccatcacctcccaagcgccgcaacggcgcggacgaagtcctcacctcgttcctcgaaactccggtaccaatcccacgaggtcgccgccggcgcgagcagcaccaccgtgcccggcagcgctcgctcgctcgccaccgccaccgcctcgtccatcgagttcgcctccacgatccacggcaccgcgtcgccgaggtcggccaccactcggtgggcactctcgccgatggcgaccacgccagcgatccgctccgcgacgtcgcggagccgctcgaaccccgtgcccttggttcgaccgccggcgatgagcacgacacgatcgaagctcctcaccgcagccacagcagcttccggcgtcgtggctttcgagtcgtccacgtaggtgagcccaccacgaacggccacgacctggagccgatgagcaagcccccggaactcgcgcgcgactcgacgcgcgcgttcgagctccgcgccactcgcctccgcaagcgcccaggccgccagcatgttcgcgacgtcgtgtggtgcacgacgtcccaactcctcgacccggacgagcgtgcggccgtccggcccgacgagtgcaccatgctcgacccgatagtcggcgtcacgcgccgtcgcactgaaggtccgcacctcgaccccgcgagggatcgcgatggcgtccacggcaccctctccgacgggccacacggcgacatccccgggcgcgagccgctcgatgaggcgcgccttggccgcgcgataggcctcgaacgacccgtggtagtcgagatggttcggcgtgaggttcaacacggtcgcgacggaagctcgaaacgtcggggcccagacgagctggaaggaggagacctcgaccacgagtcgacgagcgccactgtccgccaccgccgagagtggcgtgccgagattgccggccgcgacggccccgtcgccgagcatgctcgcggtgagcgtcgtcaccgtggacttcccgttggtaccggtcaccgcggtgatgggggccgcggcgagaaggtagccgagttcgagctcgccgatcaccggaccgtcgagcccgagacgttccacccgttcggtgcgaatcccgggggacacgacgaccaggtcgaagcgcgcgccaacgatggcgtccggatccacgagctcacgcccctcggagcgcgccttgtcacgcagcgctcgagcgtcgtccgccacgatgacctcggcgcccaacgatcgcagcacccgttcggccgcgagaccggacacgctcgctccgagcacgagcacacgcccgcctgccacctgggcacgcagcgcatcggcgctcatcggacccctccgagcgacaggaagtcggcatagaacacgccgatcgcgagcgccgtgcagaccccggcgatgatccagaagcgaatcaacacggtggtctccggccacccgagcagctcgaagtggtggtggatcggcgacatgcgcaagatgcgccggtgccagacgcgaaaggtgaacacctgcgccacgaccgacaacgtctcgatgacgaacagccccccgagcaagacgagcagcagatcaatgtgcaggagcagggcaaggccaccgagggcggacccaaggccgagcgacccgacgtcacccatgaagatgcgcgcaggcggcgcgttccaccagaggaaccctgcgagcgcgccggtgactgccatggcgaataccgcgagatcgagcgcatcggggacgtggtagagcccgacatggcggaacatccaatacgccatcagcgcgagcgccccgaaggcaaagatcccagaacctgccgcgagaccgtcgaggccatcggtgaggttgacggcgttcgaggaaccgacgacgacgatgaccgcgagcacgatccacccgaccgacccgagttcgagctgggccccaccgacgcgaaccaccgcgagcaccggagggactccgacccaccatcgagccaggaccgcaaacgcaagcgcgaccgcgacctggagcgagaacttccccgccttggtcaacccgagcgagcgccgattgcgcaccttcaagagatcgtcgacgaccccgatgaggctggaagcgatcgtcaggccgacgacggcgataccgccgcggctcagctggacaccgagatgggcatgcgtgaccgcccagccaagggccgtcccgaccacgatggcaatgccacccatggtcggcgtcccggctttgaccaggtgccggctcgggccgtcctcacggacctgctgacccaccccccgcgcgcgctggcgctcgatgagccacggcgttccgaccacggcgacgaccagcgacaccaaggcgctcgcaaggatggcgatcacgcgagcagccccccgtcgtcttggagcgcagcgtgcaccacgtcgatgtcgtcgaacggcgtcgcaacgccgtcgatgacctgaactcgttcgtggcccttgcccgcgaccacgagcacgtcgccgggggccatcatcgccacggcctcctcgatggccgctcggcgatcgaggacgacccgcacgccacgacgatcgcgccaccccgcgacgatctgggccgcgatggcagcaggatcctcgctgcgaggattgtcgctggtgacgatggcaacgtcagccagctgctcggcaaccgctcccatgaggggccgcttggcctgatcacgctccccgcccgcaccgaagacgacgagcaggcgcccccgcggaccgaccaggagtcgagccgcccgcaacaccgccgccagcgcgtccggagagtgcgcatagtcgacgacgaccaggcctcgcgggccgaggatgcgctgcatgcggccccgtgggctctcgacctcgccgagcacccctcggaggaggtcggggtcgaagcccacctgctcgagcacggaaaccgccagcaggatattgcggagattgtgctcaccgacgagacgcgagcgataccagcgtccgttgcgacggaaccggatccctgccgcatcgatctcgatgtccgtcacggcgctgatgctcaccggtaccaccggcacccgcaccgacgccgcgagcctcgcgccccagggatcgtcgacgttgatcacgccgatcgccgtccgttcgggctcgaacagccgtgccttcgcggcgaagtagtcctccatcgacccgtggaaatcgaggtgatcttgcgacaggttggtgaacaccccgacccgtacgtgcagcccctcgatgcgctccatcgcgatcgcgatcgaggacacctccatcgccacccagcgccgccccgagtcgcgaaactcagcgaggcggcgggcgagctcgggagcctcgggcgtcgtgaggcgactccagagcgtgccgagcacaccgaccccttccccgaggcgctcgagcagctgggacacgaccgacaccgtcgtggtcttgccgttggtgccggtcacaccgatcaccgagaccgccgacgacgggtcgccgaagatgcgatgggcaacgcggccgaccgccgtacggagcgaggcgcgtggcaccacgagttggggcacaccgaccgcgaccggctggccggcggtgagcaccgcgacagccccgcgtcgcaccgcctccgcggcgaagtcacgcccgtccacgtgacgccccggaaccgcggcgaacaggtcacctgcgcggatctcgcggtggtcgatcgcgataccggtcaccgaggtcgcccggtcaccgacgatgcgcgcgtgctctacgagggccccgagggcgtcgagcgtgacgccaacctctggacccacctcgcagactcccctcccgcacggacccggaccatggtagccctgcagcacgggggcagcgttcacccctggaccccagcccctggatgcatgtcgacgctgctcaaaagggtcgacgtgacttgcccttcgggcgtcaccccgtagcgagccagcgcagcgcgcatgatctgggagaacacaggtgccgccgtcatcccaccgtagatgggcaccggctggtcgaccatcacgatcgcactgaggaccgggtgctgggccggcaccatcccgacgaacgtcccccagtacgccccaggctggtaaccaccgcgcgcatggtagggcttctgcgaggtgccggtcttgcccgcgacgaggtagccaggtatcgccgcatcaggagccgtggcgttcgaccccgtgacgtgcgagaagagccccagcagctcggaggcgatcgccgcaggcatcacccggtgacgaggtgcggccggcgccaggtggacggtcccatcggtgcccacggtgccagcaaccagggtcgggttcacgaggacgccgccgttggcgaccgcgttgtaggaatcgaggatctcgagcggcgtgacgagctggtcctgtccgatcggggtcgagccgatcgccgtcggtgaccactcggagggaggcttcaggtaccccgcggtcgcgcccgggaacgcgagccccggatcgacaccccacccaaggcgccggaaggagtcgtagatcgccgtcgggccgagccgctcggccagttcgatcgtgcccacgttcgaactctgggcgaggatttgcgacatggagaggacctcggtggggtgcgactcggcgtcatggaacaccgagccgtcgatcaccagctggtttggaacggtctccgtcgaggtcggggtgatgatgccccgctcaagggccgcagcgaacgtcgcgatcttcgcgaccgatcccggctcgtacgcgtaggccaccgggtcgttcaaccagctctccgtcggcagggcgcggggcacgtcgacgggctgactcccgccgaccgacgacgtgcccggcagcgccggcgccgcgagcgacgccatcgcgaggatctggcccgtgtggggatccatcaccaccgccgtcgcgccgagggctcgcgtcgtctcgatctccgacgccaaggcgttctcgacgtcgctctggaggacgggatcgatggtgagctcgatggacgtccctgggcgcggcgggtgttcggcaacgaggcctccgggtaccggcgcaccctgagcggtcaccctctcgagggcccaccccggtgctccggcaagcacgcgctggtaggcgtactccaggccaaacgtaccgacaccagccggactcacacgaccgatcaccggctcggcgagatcgccgagcgggtacacaggcagcgtcgtcggtgtgacggtgatgccgggcagcgcgccgtcgagggcgagctgctcgatacgcccaccgacgctcaagagggcatcgggatcgacgacgctgtagcctccgtgcacctcgagcgcgctcgtgaccgacgccacggacagcccgagcagccgcgccagtcgctcggcctcgggcgcaacgtcgtggatctgcaacggatcggcgatgatcgcgtcgcgctcgatggaggtcgcaaacgcgacgccgttgcgtgcgaagatggcgccgcgcggtgccgacagcacgacgcgtgtctcgctctcggacgtggccagctgcccataccgcggcgccgggcccacggtcagacggacgagctgcgcggcgatggcgccgagcgccaccaccgtgacggcacccacgatgcgcacgtgcctagccacgcgcgaccgttccggccggaaggggcgccgactcgcccgttggttgaccaagcgccgtcgtcgggacgggtgctccccgtccactagcaagctcctcccacgtcgggtggacgaaaccgtgtgccgccgcgaccgccgccgcgtggctcggtgcgctcagggtgctgagctcggcgacgaggtcgagatgatgcacctcggcggcttgcagcgcgagctcggtcgcctggacggtattggcgaggcgctgtgcaacgagccgcgcggcgatcacgcccaacgcggcgaccacgaccacaccgatcacgagcacacgccatggcaccgaccgacgacgtggtgcgcgcgtcagcacacgaagctcgggggaacgtaggcccgagcgacgaggcagtgcctccgctagcgcagcgcgagccattcgtgcacctccctctcccacgctggtgcgagatctgccaccgcgagcttgcgcgcgaccctcaggcgggcactcctggcacgagggttgcgcgccacttcgtcgtcgctcggcacgacgccccgccgggggcggcgctccagtacgctcgtccagctgccagccggtgtggtgcgcggagccccgccccgctcggccacctcgaagaagcgcttcacgaggcgatcctcgagcgagtgataggtgagcaccgcgagtacgccaccgacctcaagcgcctcgaacgccgcagggagcagggccgtcagctgaccgagctcgtcgttcaccgccaggcgcagagcctggaagacgagggtggcgggatggcgcctcgtcgtacgccgcgacggtggggttgcctcgacgacgacctcggccagctgctcggtcgtcgtcggcatggcggcgaggatcgcgcgggcgtagcgacgcgcaagcggaccgacctcgcctcgacgcagcagctcggtgagcccatcctcgtcgagcgaggcaagcaatgacgccgctgacgtcggcgcctcggggtccatgcgcatgtcgagtggcccggcgaggcggaacgagaatccccgctgcgcgtggtcgagttggagcgaggagacgccgagatcggcgatgaccgcatcgatccgacgcgcgccgacgacacgtgcgaggtcgcgaaacgtcccgcggaccggctcgaaccgatcaccgaacgcttcgagtcgccgcgccgcgagatggagtgcctccggatcccggtcgaggccgatcacgagcgcagcaccggcatcgaggagtgccgccgcatggccgcccaagcccacggtgacgtcgagcacccgtcgaccctgcggttcgaccgcgcgcacgacctctgccaccatcaccgggaggtggatcggctcagccacgatcgcctccccgatagcgctcccaggtcgctggatcccacagctccacggtgccgaaggcgccgtggacgcgaacgtcgtggtcgaggttggcataggcacgatggctcggcgggagcatcagtcgtccgaggcggtcgatctcggcctcgaaggcttcggaggcccacgaacgcagtcgccgacgctcctccggatcggcccagtgctcggcgcgcacctcgccgacgaacgcgttgaagtcctcgacgcgccacacgaccaggcaggggtcctcgtactgcgaaggcgtgacgaagcactgatcgccgaactgaccacgaaagcgcacagggagcgtcaagcgtcccttggcgtcgagcgcatgcgagaaggagccgaagaaccggccggtcggctcaccgagctgccacacctccccgcgcctcctcaccgtcacccagaagggtgccactcacgccatcggcacccacggcgccccactttagcccacgacaccccaccggggcgtgtgaatcgcgtccgttggctccacgatgcgcacgagaccgtgcgagcgacccacgccacgctcgcgcgagatcaataccgaggtcggcgtcagggtgctcaaggagggcgccgagttcgcttgagacgatcgcgacgggtccgcgtgtccgacaggcctccatggctgcagtgtgagccgggagccggctcacagcgagaaccgaggtggagttagcgagccaagatcgcccggcgcaccgtcgcgacgagcggatcgagctcgataccgagctgctcgagccccagggaggccatggtgccttccggtcgatcgcgcagggcgtcgacgagttctcgctgacgatcgcgccagagcacggcaacctggaagatcgcgccgcctcgacgacgtcgctgcgcgagacccgcgaccttgttgccgccgacggcgacctctccccagccccagccagcaaagcacacctgcgtcgagagcgggactcgctcggggacctcacgcaccaccgtcacgtcggccaccccgagggctccaagggcctcggcgacggcttccccgagccagaggaacgatctgccaagatgcggatcgagacgcgggtcagacgccggcacaaacacgtggaaccacgcctgctcgccgggagccacgacgaccgcaccgccaccggatcctcgccgaacgatgtcataacccttggctacgaggctcgcagcatcgatcgcgtccacgcgcgtggtcgagcccagcacgaccgtcggcgccgtgggctcagcactgagcagccacggtgatccctcgtccgctggccaccaacggtggatgaccgaggccggagcgcgcagccgcaacgtccgccacggctgcacacgacgatccatgcggccgatcttacggcgtcctcaggcgaggcgataggcgcgcgccactcggtgcctagcatgggggcggcgtcggaccgggaggcaaggcagggctgtggaggcgtacgtgctcattcagaccgagatcggtcaggtcgcgtccgtactggccgaactgcgcaagctcccgttggtggtacgcgccgacgacgtcacgggcccgtacgacatcatcgccctcctcgagggcgagaccctcgaggacatcggacgtcacgtggtcgagggcgtgcaggtcatcgacggggtgacacggacgctcacgtgcccgctcggtcacctcagactcgacgcctaccactccgtcagaacgcagagagcgtccgagcggccccagccctgacgacgccatggcggagttcttctacccgccgcagttggaccgacgacgacgtcgcgaggacctcggcgctcgtcacggcatctgcgagggcgagcacggtctggacacggtgcgtcgccgatgccacgagacccacggtgagcgcggtctgaccggtcacgagggtgcagtaggcggcgagcaccgcccgcggcccacccaccgtacgcaagaacccgacttcgatctcgcgcgggcgaatctcgaacccggtcgcgcgcgtgcacatgccggtcgccaccggcgcagcccacgccgtcccgcccaggacttcggccgcacggcgcccgctggggccgaacgcgacgagcggcgcagcaccgaggtcgatcccgggcggacccaggacgagttcatgctcggccctcgccgtcgtgcgacggagcgccgcaagctggatcgggatcgcgatcgccgccaccaccacgaaagccgccacgccacctgcgagccaccgccgacgccgtcgcatccgtcgatcgctccaggcgcgctcgccctcgagcgctcccggagcttcgtgatcaagcgagtccacgcttccacgctagcgctcaccgacgacccaccccggggagtccatcgatgccaagagcgctgagcaggcgccgacgtctgcgccagcggcgagcggtgaccctcggtgccgtcaccgtcgcgatcgtcgcgggaaccggcgtgatcgacgcggccctcaccctcgatccatcgattcgggtcacgccccgtcacgtgagcggcgtgcgtgccccgaccgcgcccccgatcaccttcaagcacggcgtgcagtccgcgacggtgatcccggcgcttggatcagggtctctcgaagcctcgccccacgagcgacccgtcccgatcgcgagcctcgcgaagctcatgaccgccctcatcgtcgtccgccgacacccactcggctcgaccgcatccggccccactctcaccatgaccccagccgacgtgatcctcagcgacgtcgacgtcgctgaggatcagtcgactgtaccgatcaccgccggcgaacgcctgaacgagcgccagctcctcgaggccctgctcgttcgctccgccaacaacatcgccaccatcctggcgacctgggttgcgggctcagaatctgccttcgtggccacgatgaacgcaaccgcacgcacgatggggctcaccggaacacactttgccgacgcgagtggcttcaacaaggccaccgtctccactgctcgtgacgtcgccatcgtgaccgctcgcgtcgaggacaatcccacgctcgccgcgatcgccagcgagcatgccgtcacgctccctggcgctggcaccctgcccaacatcatccaagcgatcggcaccggcgacgtcgtcggcgtgaagtccggcttcaccatctggtcgggaggctgcgcctcgatcgcggtgcggacgcccacccccgtcggtgagctcaccagcgtgggtgtcgtcatcggcgaacagggctacgcctccctcgcgcgtgcggcgcggcgcgcccaggcgctcgcgaccaccgctgctgcgcgcgtcgcgagcgagcgcatcatcgacacgcgcgagctggtcggatgggcgcgggcaccgtggcgagcggcgccgattccgatcgtcgcagctcggagcgttcgcgtcctcctgtggccagcgaccgaggcctcggtgcggatcgcgctgcgaccaccagcgctgccggcgccacgcgggcgcgccgtcggcgagatcgtcgtgaccacaccgaccacaaccatcaccgttcccgcgattctcaccgcgagcctcggaacgccgtccttcggctggcggctcacccacgcgctctaaggagcgtgcgcgtcgcacaggcctcctgcggcgcgagccttgctcgctcgatcgccgacgaaaccaccccggtgtggcgtcgccaacgacacggagcgccggttcgtccggcgctccgtgtcacactgatgattcgccacgcctgcgggtgcgatcttggctcctgccgtcagcgaagcgcgccagatcctcgcgctccaccctggcgccgacgctcctcgatcgcgaccacggcaagtccgccgacaccaacgctcgcgagcgcgacaccaccccaggtgagcgcggtgatcgaggacggggcgctacggggccccgtgaccagcttcaccgcggtcggctgggtcgcgaccgtcggagctgacgacgtggccggagcggtcggcgtcgtggatccactcgtcgtcggttggggtggcgtcgagcccgcggcggtactcggcggcgcgacgaccgtcacgctatccgttgccgactgcggagcggcatcggtcgagaccaccgtcgcggtgttcgagagcaccgtgcccgcggcatcggtcgcatccacctggaccgggacgatgatcgagggcaacgattgaccgggctggagggtctgggtcgacgcaaaggcatacgtacacgtcaccgtgggtggcgtcgaggagcttgccagcgtgcagctccagccgtcgttcgcgttggcattcgtcagggccgtctgcgacacggtcacacctgcggggagcgggtcagtcacggtgaacgcgaaggaactcgaactcgatgggctgttcgacagcgtcccggccgcgaacgtcgctcccgagctcggacccggctcggcggtcgccgagctcgtcgcaacgccagcggtgatctcccatgagaaactctcaccagggttcgcgacgtggttcacgttgtcgaccttcgtgatcgagaggatcggacccgtggagaagtaggcgggatcggacccaacgagcacgaagtcgtcggctcccaatgaaagattcgggggggtcgactcgtaggtgaggttgatttggccaggactactcttcgtcgaggccgagacgatgtcgttcgtcaggctcgacggattgacgtagccgaagtcgacgacgttacctgcgctggaggagccattcacgttgcccgacgcgacccagaggttgcccgtcgtcggatcgagcgtcatggactcagcctgcgacgcaccgttcggggcgttaacgatgttgtacactgcgccctgtccgctcggcacgttgctcgtcgaactggcgttgtcgatcgggaggctgggcaggctgacgtagccgacctgcgtgtcgaactcacggacgaaccacagctcattctggccagcgtcgagctggaagtctccaagccccgacgagcccgtcggcagcgaccagctgtaggcggccgtcgtcaccggcgacgatggaatcccgctgcccaggttgtacatcgcgatatctggcgagggactcgtctcgccgacgaatgcatagacggtgccgccgatcgtatcgacagcgagcgaacccgtcagcgacgcggtgaccaccgcgctcacggtgttcgtcgtcgtatcccaagcccagacgtggctgccaccggtccagtacaccgtcggccccaccgccgcaatggcgtagtgctgggtgctggagaactgcgtccccgcgggctccggcggacagctgatgcttcccggcaccgatcccgtgctccactcgtcatagctcggcgaggtcgccgaggccgtcgcgttctgcgatgtgaacgcctggaggttcacggcaatcactggacacgcgctgacgccagtgacgcccgtcgggatcatccccgtgacgttccggtagtacagcatgttgccgacggcgaccccgtcgccgagatactgaccgcccaggccgttcagctggatcgtcccgaccaccgcatgtggcgcggctcccgacacctcgatcaggtaattcggcgagttggagtcggtgtcgacgtagtagttgccgttctgagcctgaaccgtttgctcgagatggaccaagggggagatcaccccgttgtcgacgaggacaccgaggttgaacgccaccggctgatacgcaggtgccgtcgacgccgacagggcgctcggccccatccacgcgaccgcgaccagcgctcccgcaacacccgcactcgtggtccctcgcaggatccacgtcgatcgcctcgtcacaacgcccctcctcaacgtccctcccctacctggctcgacgcagtgcagctgcgatcggcgtcagtactctagcactcactgtgtctcaattccacacgtcttgtgaactctcacggaatgcattcttcatactactcattgtggttatccgacctcgtcgacgtcgaactcctgtcgcgacgcaccgttctcggcagctcgcaatgagcccgaagaatgcctcgcaccgtccaatacggctgcaccaggcgtccatcaggatcggggcgcgacacacacgccaccgcacgcgctcccacgctggtcgaggtcaacgctccgcacgcaggtgggcccggtgggattcgaacccacgaccaagggattatgagtcccctgctctcaccgctgagctacgggcccttggttgcccacgcggccatcgacgctctctcaacccgtcagagcgcgggcgacgaccctcgctcacgccagattcgaagctccgggggagagactcgaactctcaaccgcacggttaacagccgcgtgctctgccaattgagctaccccggaaagcgacgtcagtctaggggtcacgatcacgctcgcccacctccgacgctcgttcgacgcgactccaccagccacgcgaacggtgtccgcgtgagcaggaagtcatcgaacgccgtcaacagacctaccgcgggccgccagccgacccagacgacgacgcccccgagcaccaatcccgccaacacgtcgcccgggtagtgcaccccgacgtagacccgcccgaacgcgaggaggaggcccgcgatcgtcgcgatccaggccatgaggcgatcacgcgcgagccagaggccaacgatcaccgcaccggcgacggtcgcgtgaccgctcgggaacgagtagcccccgctgcgcgcaagcagcacctcgacgtggtgcagcgtgacgtagggccggcgttcacccacgagcggtttcaggacatagtgcgcgatcacccaggcgaggacggtcccaccagcggcccagagaacccccgcaaccgcacgtggcgcctgtcgacgcgagcgagcgcgccaccacgcgaccagcagcaccacggcgagcacgccgacgccgacgaagtgcgcatactgcgccatcgcgccgtgggcccaccccgtctcacgcgcgatgcgattgacgtcgagataggcctcgtcgttgagatgctcgagctcgcccacgtcacacgcctccaccagtgttggcgatcgagcctaacgcacgcatgcgaaccggtgcgccagggccgcagccgaccctcagcaccgctcggctagtcctcgagcacacgccgcagcaccggcgcgagatccccgcggcgcaaccgtgcgatcgcgcgagcctcgatctggcgaatccgctcgcgcgcgatgccaaagtacgccgccgcatcctcgaggctgtggggctcgttgccctccagaccgaagcggaaggcgagcacctcacgttcgcgtggctcgagatgggccagtgcgcctgcgatgaccgtgcgaagatcagcgtgctcgatggtctcctcgatcggttctgcgtcgcggtcgggcacgatgtcagccagcgtcacgtcgcgctcctcgcctaccgcctgatcgagcgagagcaccgaacgcgcgtaaccctggagttcgcgcacgcgcagctcatcgatcccactcgcggcggcgagctccgccatcgatggctgccgcccaagggcttgctcgagctcgcgccgctgaacctccacacgagcaagttcggcggcgatcccccgaggcaagaccacatcgcggcgcgtccgcgtgagcgcctgcgcgatcgcctggcgaatccaccaggttgcgtacgtggagaaacgaaatcctcgccgcccgtcgtagagatcgatggcacgcaagaggccgatcgtgccctcctgcacgaggtcatcgagcgagatccccggttgcacgtagcgtcgagcgatgctcacgacgaggcccatgttgccctcgacgaagcgctccctcgccgcttggaccaccgccgcgacgtcgggcggcacgtcttcggcttcctgggcttcctggagcacgatggagagggcgacctcctcgtcgggcagcaggcgaccccgcctcccgcgcgccagcaccgcccgagcgccgtccagcgcctccggcgacaccccactcacgagccgctcccgagcgcgacgtccgaccgcgcctcgacgaggtaggcgagcagcgcaccggctgcatcgagatctcgaggttccgtacgaaggcgatgcagggtcatgatgtgatccgtccagcgacgctggcgctcctcgcgctcaggtccagagaggccggcaaggccgcgcgcctcacgctcgagttcgacacccgcctcgcgcaacacgagcaccaccagggcatcgtcgaagctcccttcggagtcgctggcagcgatgcgatggtagagctcgcggacgtcatcgccgacgccctcgagcgcggccgcgaccggcgcctctcctcgcgagccgagggctgcagcgagtgcacgataggtcgggtcgcgaaacagtgcgggtaccacgaggtccccgagcccaggatcgctggcgagggcgatgagcaccgacgccgcagggcgatcgaggcctgacgcctcgctcgtacgcagacgtcgcggtcggagggcgctcggaagccgcgccgcaagctcggcctcgcgaaatccggtccgatccgccagcatggcgatgtactcagaccgcacgagcgggtcgccgaccgaggcgagcaccgcagcgacgtcggccactgcacgcgcccgcccctccaccgatcgaagatcggcacgggcgaggactcgttcaaggcggaaccgagccaccggcacggggctcgcgagagcctgtcgaagcgaatcgggatcctcggcgaaggcctcggcaggatcacgtcctcccggcaaggtggccacgagaagctccacgcctgctgcctcggcgaggggggcgacctgctccgccgctcgctggcctgcgtcgtcaccgtcgaacaggaccacgacctggggagcgaagcgacgcaggatgcgcaggtggtcgtcggtgagcgccgtgccgcaggtcgcgaccgcagcgacgccagcggcatcgagtgcgatcacgtccgtgtagccctcgcacaccaacgcgcgccgctcgcgcaggaacgtcgaccgcgctcgatcgaggttgtagaggacctgacgcttgtggtagtaggccgtgtcctgcgtgttccgatacttcgggacgccatctctggccggaggcacgacccgaccgccgaacgcgatgacctgacccgcgacctcgcggatcgggaacacgatgcgtccgctcatcgggtcatgcagcgacccgtcctggccgcgcacgcggatcccgacctcgagcgcgatcgccgccgatgctccgagttcggcgaggctcgccgctcgcgacggcggtgcatagccgatgcggaacttcgcgatctggtcctcgctgatccctcgagccgcgagatactctcgagcgcgctcacctgccggtccagcgagctggtccgcgtaccaggtggtctgggcttcgagcacggtaagtgcctcgcgacgcgtggacgctcgcggctcaccggcagcctcgtgctcgatgcgaagaccggctcgtcgggcaagctgctcgacggcttcagtgaagtcgaggccctgcacctcacggacgaaggtgatcgcatcacctcgggcgtgacagccgaaacagtagtacaccccgagctctgggttcacactgaacgacggcgagcgctcgtcgtggaacggacacagaccgacccaacgcctcccgacccggcgcagcgcgaccgtctcggagacgagcgcgacgaggtccgtcgcatcgcgtacgcgccgcacatcggcgtcggctatggccactcgctcaaggctacgccgtctcggcggcgtccttcgcgcgcatcaacgactgtgcgacggcgaggcgcgcgatcggcacccggaacggtgacgcgctcacgtaatcgagaccggcctcgacgaactgcgcgatggaggccggatcgccaccatgttccccgcacacaccgaccttgagtccgggacgctctcgccgccccgcctcgaccgcctgccgcacgaggcgcatgaccccgcgtgggtcgaccgtcttgaacggattggccgcgaggagctcgctcgccagataggcgggcatgagcttggcctcgacgtcgtcgcgcgagaagccgaaggtcatctgggtgaggtcgttcgtaccgaaggagaagaagtcggcctcgcgagcgagttcgtcggcgatcagcgcagcccggggcgtctcgatcatcgtcccgaagcgcacttcgaatcgcgcgtccgaggccgcgcgcgcctcgtcgaaccattgcctggcgagcgcgagctcctccctgctcaccgtgagcgggatcatgacctccacgatgggctcaccaccggctcgtgcgacgtcctcggccgccgcaaggagggcgcgcacctgcatcccgtagaggccaggcttgacgacgccgaggcgaacgccacggatccccagcatcgggttctgctcatgccacgcacgtgccgcagcgagcaggcgctcgccctcgtcgtcgagaccccccgctgcctcggcacgctcaagcgcggtcacgtcggggaggaactcgtgcaggggtgggtccaagaggcgaaccgtcaccggcagcccactcatgacctcgaggatcccccgaaagtcacgccgctgggcctcgaagagctcctcgagcgcgctcgcttcctcctcggggctctcggccaggatcatccgccggacgatcgggagtcgatccggctggaggaacatgtgctcagtgcggcacaggccaatgcccttggccccgaagcgccgcgcacgctcggcgtcgtcggcggtgtcggcgttggcgcgcacgcccaccttcccaaaggcgatctcgtcagcccatccgagcacgatctcgaactcctccggcggtgcggactcggcaagcggcatccgtccggcgacgacgacgccactcgtgccgtcgatcgaaatccagtctccgacaccgacctgcctgccaccgacgcgaaaaccgccctcctcgatcacgatcgcgtccgcccccacgacggccggcttgccccagccacgcgcgacgaccgccgcgtgcgacaccagcccaccgcgggtcgtcaagatgccctcggccgcgagcatgccgcggacgtcctccgggctcgtctccttgcgaacgaggatgaccggctcgcctgccgcgtgtgcttcgaccgcactcgcggcgtcgagatacaccctcccgacggccgcacccggcgaggcaccgagcccccgggtcagtacgtcgacgacttcggcggcaaagcgcgggtggagcacctggtcgaggtggtcgggagtgatccgggcaaccgcctcctccttggtgagggcgatggcgggatccttggtcatctgcaccgccatgcggagtgcggcgacaccggttcgcttgccgactcgcgtctggagcagccagagcttgccctgttcgatcgtgaactcgacgtcgcacatgtcgcgaaaatgccgctccagccgtgcgaagacatccatgagctccgcaaagacctcggggaactgatcctggagggcagacagcggctcggtaatgcgaatgccggcgacgacgtcctctccttgggcgttgacaaggaagtctccataggcaccctgctccccggtcgcggggtcgcgagtgaagccgacgccggtacccgagcggtcatcgcggttgccgaagaccatggcctggacgttcaccgccgtccccaggtcgtcagggatgccttcgcgctcgcggtatgcgtgcgcgcgctcgccgttccacgaccgaaacacggcctcgatcgcgccacgcagctgatcgcgagggtgctgtgggaacgggctccctgcgagctcaccgacgagctcgaggtaggcaccggccagccgacgcaactcgcttgggggcagctcgccgtcgttctccgtgccgactcgttgcttcgcctcgacgagcaagcgctcgaacggctccggatcgagcccgagcacgatgcgcgcgtacatcgcgatgaatcggcgatacgagtcgtacgcgaagcgctcgtcattcgtctgacgagtgagaccttcgaccgacgagtcgttcagccccaggttgaggaccgtgtccatcatgcctggcatcgagaactgcgcgcccgagcgtaccgacacgagcagcggatcggatgggtcaccgagccgccgacccatgcgatcctcgagcgccccgacgtgacggtcgagctcctcgtcgagcccgtcgggccacccgttgcccaagtaggcacgacaggcgtccgtcgaaatcgtgaagccgggtggcaccggcagaccgagcacgctcgtcatctccgcgaggttggcacccttgccaccgaggagcgccttgagctccttcggcgcgactgggtgcgcatggtcgaatgggtagatgaacggcacgaaggaccctccacagctcaccgctcgtgcgcacggggcgcgcacgaggcatccgacgccgggcgtcgttgcccacaaggtgatgggagtctagcgttgatggaacgttaatgtccgagcacgcggcctcggcgtggccgccaagcgctcacgaacgtgggcgaccaggtctgcgaccggaatgcgtacctgctcgagcgtgtcccgatcgcgcaccgtcacggcgcgatcctccagcgagtcgaagtcgacggtgacgcaccacggggtgccgatctcatcctggcgccggtagcgcctcccgatcgactgggtctcgtcgtagtcgacgtccacgatcgtcgcgagatcggcgaagatctcgtgcgcgagctcgacgagggccggcttgcgcgagagcggcaagaccgccacggtgtagggcgcgagatgaggcgagagccgcagcacggtccgcgactccccgttgacctcgtcgacatggtaggccgcgaggaggaacgccatcgctgcgcgtgtgacgcctccggctggctcgatggtcgaggggtagtaacgctcctcggtcaccggatcgagcacggagagatcctcccccgaggcggcggcgtgggctcgcaggtcgaagtcggtccggtttgcgatcccctcgagctcaccgtagccccagggaaagcggaactcgatgtcgacggtgcgtgacgagtagtgcgagagctcgtcggcgtcgtgctctcgcaggcgcagccaatcaccctcgaggccgagctcttgataccagcgcagtcgctccgcgatccagaagtcgtgggcctcggcggccaccgacggatgcacgaagtactccatctccatctgctcgaactcgcgcgtgcgaaagacgaagttgcccggggtgatctcgttgcgaaaggacttgccgatctgcgcgataccaaaaggcggacgcagccgcatcgcgcgcgcgacgctctgtgcgtccacgaacatcccctgagccgtctcgggtcggaggtaggcctcggctccctccccctcgaccggaccgacgaaggtgcgaaacatgagattgaaggcccgtgccggggtgaggtcgcgagacccgcacttcggacacacgccatcgatctggtctgccctccagcgctcgtggcaggaccgacagtcgaccagcggatccgtgaagtgctcgaggtgacccgaggctcgccagatggccggaggcgtcaggatcgacgcctcgaggccgaccacctctcggcgctctcggaccatgtaggaccaccaggcctcgcggatcttgcggagcagaaggacgccaagcggcccgaagtcgtacgccgagcgaaatccgccgtagagctcggcggacggaaagatgaagccccgacgcttcgtgaggctgacgacggcgtccaaggtatcgggctcaggcatggcgccagtgtaggagcaacgaccctgctcatggcgcgacgggccggcttgggcgaggctcgggcgcgacgtgggcgagaccgcgcaagcgacgaccgaggaccgcctcggcgatccgggtcgcgagctcctcgaagcgccgcgcagccacggcatccacggcgcgcagtccgtcgcgcgtacgcccctcgagcaccagccgagcggcccgcatcgccggaaccccgatcgcgaccccgccgcaggcgtcacagcgcgcctgctgggaggcggggtcgatccgagtcagctccccctcagcgccgcacgaaccacaccgatcgaggctcggaccaaaacctgcgagctggaccgcccgcagcgtcaacgcggcgaagagctctcgagaaggggcctccacgagtagcccgagtccgcgcgcgaggagcgcgaacagcgcgtcgtcgccgtgcccgtcctcgctcagaccatcggcgagatcgagcagctcgtaacaccaaccgacggtgtccggatcgaggtccccacgtccggcgaggttcgccgcgacgagctgggcttgggccacgccgtcgagctcgcgcccccgccagcactccacgtcgagcaccgcggacggctgcacgatccctctgaggcggctcctcgcggcccgcgccccccgaacggtggcacggaccttgccgtgctcccgggtgagcagcaacgccaggcgatctcgctccccgagcggccaggtccgcagcacgaccgcaaggtcgcggtaccttccgctcacggcgcgcgacgtcggaagcgacgacgacgccccccgacgatgagcaaggcgacgaagatgaccccgacgagcaccatggctccgatcccggccgcaccccctccgatcgcaccggccgcgagggcacccatgaccgccaccacgagggcgagcaagaaccacccggccgctcgctgcagttgacccgagccgctcatcggcccaccccgccaaagcgccgatcgcgcccctggtactcggcgatggcctcgaagagatgctcgcgccgtacgtccggccagagggtgtccagaaacaccagctcggcataggcgagctgccagagcaggaaattggagatccgatactcgcccgacgtgcgcaccacgaggtcagggtcgggcatatccggaaagtacaagtgggaggccaccgtcgactcgtcgatcgctcgagccggcacgccttcggcaacgatccgtcgaagggcatcgacgatctcggctctgccaccgtaattgaaggccatcgtgagcgtcaggcgatcgttgtgcgcggtcagctcagccgcgagatccatctcgcgcgtcaccgacggcggcacgcgccgactgcgtcgccccaggaaccgaatccgcacgccacgatcgttgagctcatcgcgccggcggcggagcaggctccgattgaagttcatgaggaagcgcacctcgtcgggcgggcgtcgccagttctcggtggagaaggcatagacggtcagccaccgaaccccgacctcgagcgccccctcgaccacgtcgaacagcgccgtctcgccagcggcgtgcccctgggtgcgcggcagtccatagcgctgagcccaacgtccattgccgtccatcacgaacgccacgtgcagcggcacgcgcgtcgtatcgatgcgctcgagcgccgatggcacctcgctgggcctagccacggcgcaggcgtgactccaagtgctggtgcatgccccgctccatggcgtccatccagagctccgtcatgagctcatccccgcgcaacgtgaagcgacgctgcaccgcatccactcgcttggcgctcggcgtcgtcgcgacgacgagtgaggtcaaggagatgacgacaccaccctcggcttcctcggcaccgccctcgaggacctcgacgatgcccgttggctgcgccacgacgagctcgagccgaccgttcgcgacgaagcgcagataccccacctcggtgtggagcggcgatccgtccggacccgtcgtgtgctgttccatgcggaggaacggccgaccattgctctcgaagcgcaggcgctcttggtagctgaactcggcaacctcgggatagctgccgatcccgctcccggtccaggttccctcgagcatctctcgaatcgtcatcgcccctcccccggccagccctcagcctagcgaggtcggcgtcggcgcgtccgggcgtccggacctcacagccccagctcgtcgagcatccgtgcggatcggcgccagtcgcgctgcaccttgacccggagcgtgagcggcgggtacgcgcgcagccggcgctgggcctgacgtcgcacggcggccagcacccgtccctcgtggccgagcacgatcgcacgctggctcggccgttcgacgtagacgacgacctccacaccgtcgtcgctccacgactccacctggcacgcgagcgcctgtgggagctcgtcgcgcagatggtggaggaactcctcgcgcaccacctcggccacgtaggtcgcgcgtgggagatcgagcgcgacccctgcctcgtagagggcaggaccctccggcaacgaagaggccaggtaggagcgcagctcttcgatcccttccccggttcgcaccgaagccacgaagtactccgcgagcggcacctgagcgagctcggcaaggaccgcgagcgtgcgagcacgacggacgcgatcgatgcgtgcgacgacggcgacgtcgctcggcttcagacggctcgcgagttctcgctcacgagcacccacaccacgctcggcatccacgaccagcagcgcccggtccgcgccgtcccactcgtcatcgacccagcgtcgcaggcgcgccgagagttcgtcgtgcgccgctgcgatgccgggggtgtcgacgaggacgagctccgcatcgcccacgcgactgatgacccgcacggagcgccgggtcgtgttcggatgtcgagacacgatggtcgcgcgctcgcctgcgagcgcattgaccagcgacgacttgcccacgttcgtgcggccgatcaccgcaacgaaccctgatcggcgaatgggaggcgcgtcgtcaggatccatcgagacctcccgggtggcgctcgacgagcacggacgcgacccggtgacgcgccacttggcgtacctggagtcgcaccccatcaacgtcgacttcctcaccgacgcgcggcagatgaccgagcagccccatgatcagccccccaaccgagtcccactcgccctcgggcagctcctcgccgatacgctccgagaggtcgtcgatgctcaccgagccccgcacctcccagcgaccctcccccagctccaccacaccctcaccaccggcgtcgaactcgtcgtggatctcgcccacgagctcctcgatgaggtcctcgagggtcacgatgcccgcggtcgagccgtactcgtcgacgaccacggcgaggtggaacttcccgtcgcgcatctccttgagcaggtccgccaccggcttggtctccggtacgaagtggatcggtcgcatgtgctggccgaccggcacgtctcgaaggccagtgtgctcgagtgcgagcagatccttcgcaaggacgatgccaaggacgttgtcgagcgagctctcatagaccggcaatcgagagcgaccaacctcgatgacgacctcgatcgcgcccgcgaccgtcgtctccgctgggacggcgacgacgtccgggcgcggaaccatgacctcccgcgcgatcgtgtcgccgaaggagatcaccgagtggatgagttcacgctcgtcggtctcgatcacgtcaccctgctcggccgcgtccgccatggcgagcaactcggcctcactcacggtggcgccgggcgcgcgccacggcgtgagcagtgccgacaacgaggcgacgccaccggccaacacgcgaatcggccagaagcgcaccaagacggcgacgatcggagcgagacgcagcgcaaccccttcggggtgcaccgccgcgacgttcttggggatcgcctcgcccaccacgaagatcacgaggatctcgaccgccgttgcgacgacgaccccgagcgtgccgaagacatggtcggcgacgaccccgaccagcgtggccgcgatgagctgactgacgagcgttaggagcaacaccgtcgacaggtacgtcgagggagcttcgacgagcgaggccaaggcgcgagcgccccgccgtcgctgatcgacgagcgcttgggccttgactcggctcgtgcgtgtcaggccagtctcggccgcagacaggatcgccgataccccgacgagcagcacgaccgcgacgagggaccaccaatcagcggtgctcaccgctcgctcgccacctcagcaccaacctcgccacgaagcgcgcggtagcgctccagcagcgccgcctcctccgcctccatgcgctcggcgtcctcgtcggcctcgtggtcccaacctcggatgtgcaagatcccgtggatgagcagcaaggccacctcgtcacccacgctcccgtcgtggccacgatcgccgcggtgctcaggcgcgttcgtacgggcaacctcaggacagatcacgacgtcgccgaggagggtcggcaatcccgatgcggtcgagggacggtgctcgctggcgtcgtcgccgacgtcgtcgatcgcgaaggagaggacgtccgtcggcccgacgcggcctcgatagcgagcgttcaggctcgcgatggtctccgcatcgacgaagaccaccgacagctcgctgaccccgtgcacgccgagggcggtgagcacctcggtcgcgaggcgcgccaccatcgcttcgtggatctcgacggcggactgctcgttcgcgacgaccaccgtggccgcgggaggcgcaggatcagccacgggaccctgccgcggtggggtcgtcgtcgtaggcctcgaggatcgcgcgcaccacggggtggcgaacgatatcgcgccggtcgaggcgcacgatcgacacgtcggggatgttggcgagacgcccgatggcatctaggagcccggacgtccctccatcgagatcgatctgggtcgcgtcaccggtgacgacggcggtggatccgaagccgatccgcgtgaggaacatcttcatctgacccgtggtcgtgttctgagcctcgtcgaggataatgaagctctggttcagcgtacggccacgcatgaacgcgagcggagcgacctcgatcagccctcgctcgagcagtcggagcactgcttcgggctcgaggagatcgtagagcgcgtcgtagagcggacggagataggggtcgaccttggccgccacatcgccaggcaagaatccgagccgttcgcccgcctcgaccgccgggcgtgtgagcacgatgcgttgcacccgcttggcacgcagtgctgcagtcgccgccgccaccgcgagataggacttgcccgtgccggccggaccgacgccgaaggtcacggtcgagcgttggatggcttcgacgtagcgacgctggccggccgttcgcggccgcaggctgcgaccgtcgcgggtacgcaacagctcgagatcgctcacggccgacgggctctgctcgtgacgcaacatctcgaccacccgatgcacgaccgcagcttcgaccgcgtcgcctcgggcagcaagcgcgagcaactccccaaggacgcgcgccgcgaggtccgcatcggcgcccgagatcatcaccccgccgtcgcgcacgacgacgcgcgcctgtccgaccgcctcctcgagcacccggagcagctcgtcgtgggcgccgaagacgatcgccaacagctcaggccgatcaacgtcgacccgcgtcgccgcgagcggcggggtcaggcctgacgagaccgcgctcatcgatgccacccgcccagcacatggctcaagtgcccagaccgacgcgccgagacgagccccgtggacgagcgagcacacgaacccacgacacggggtgcctctcccgaccgcgtgatcgacctcgcggacgtgctcgcacggaccgagcgcgccgaggttcgcctcgtcgacggccgaacgtccaccggcttcgtcgatgcctggtcgtcgaggtgcgtacgcctgatccacccgggcggatcgacgtcgctcatccccaccgacgcggtggccgtgctcgccatctcgacctcacgcgcccctcgcgcgccaacgctcggctccttcgccgtcgagctcgaacgagcgggtctcggggcgaactggaccctgtggttgcgagacggctcgagcctcgcgacgagacgcatcgacgcactcggagaggacatcgcgctcatcgtgagcaccgagggcagatccctcgtcgttgcactccgctccctcgtccttgctcgccgctacgaccgcacggcaccacagtgacggctgttcgcgctgacaccacgcctctggcgccaccacgtttcgaccgtacggcacccctagcttagcaggctctgactcgtcatcgaggaagctccgtgcacgcgtcgactgccgagcgcccctggccgaacccgggccgactcgaggaacgcatcgaggtccgagcgtcggatccgcaagttccggccgatctggtacgccacgatggccccatcgtcgatcaaccgatacagcgttcgcagggagatgccgagctcttcggcggcctcccgagtaccgagccacccgttctccatggacacctccgtcgtcaacgcccatggtagacacacagcgcgatgaatcggcacgaacggcactagctgacattccagcacgaccacgacggttccatccatcgcttgcgcacgaggcgaggtggcgctaacatcgcgggcgcacggaagcaccactgatcaaggagtgatcatgcgcagcacgacgctgctgcgtggcgcgcgccggacctgggatcggccagccgtccggtggccctcgttgggttcctcggcgctacgcatcgtcggatccatcgtcctcgcgggcgtgtcgctggccctgctagtggcatcatggctgggtggcgttcgcaacgccggagcagcggttggcgtggtcgtcacgcgcccgatacctgctggcgcgaccatcgaacgcgccgacctcggcctcgcctcgatcaccgttccccaggcggtacgcgccacgctccttgcggtcgacgacgcggtgggccgcaccgcagccgtgaccatcgcacccggtaccctcttggagcgctcgatggtgctcgggccacgaccacggacgccagtgcgctcgatcaccattgccgtcccgtcgacctcggtcgcctcaggcgtcatcgaacctggtgatcgcgtcgacgtgctcgcaaccacccagagcgcatcgagccccgcaaccctcacgatcgcgacgcagctcctcgtcctcgacgtccaggcttcctcgggcgacgaactcgtgaccgtcgcgaccgacagcctcgaccaagctctcgccatcgcccaagccctcgctaccgccaaggtcgatctcgtgaacgccacgggcgtacccggagacacggtgctatcggtgtacccaccctcgatcgcagggctcgcgacccatggatgagcgtccagtcgtcgtccttcagctcgcgcacgccaacgcggtgcgcgcgctcgccgagctcgcacccgtggcacacgacctgcggttgcgatgggacccgaccggcgacgcgctcgacccggcgaccgtgtcggtgatcgtcacggatcgctccgcggccgtggcgcccggggtccggctcgttcgaacgaccgaccccaactgggtggtctcgcttcgcgaggccgtggccgcacaacggccgcgctcggacatgtgtggcagcgacgtcgaacccaaccgcccccacccactctcacgcgacgagcgcccccggtggtcaggtctcgaccactcggacgacaccgacgtcggcgagcaccaccacgtggcggcggcatccgcctcagacgatgccgtgggcacggcgcccgagcacgacctcgaggtgcgtcgagcgcgtctcgtggtcatcgtcgatctcggctcggcgagctccgtcgccatcgcactcgcagcctgcgccggtcggggcacgctcctcgtcgatgtgcgcgatcggccgacgctctggttcctccatgacctcgccccagagctcacgacgacggcccgcatgccggagcggccctacgagctcgcacccccgcatgggaccctcgccaacgagctcgtcctggcagatccgctcagcgagcgccgaacgcttcgagccgccacccgaagcttcgacctcatcgtggtcgtgaccgatgcccgcgaccacgccgccggcgatgaacgatcgacggcgctgcgatcgctgtggcgcgacgcccaggcgaccgtactggccggagcctgcaggctggaggaccgctaccgcatcctcaccacggccgtcgcactctccgcgctgcgccgtgacctcacggtcgcctgtgtcggcgcacgtggggcctcggcgcacagccacgcgaccgcgatcgtgcgcgcactcagcgagcgtgtcccgcgatcggtcagggtcgacgggttcggtctcgaagagctcggcgaccagatccacgagcgacgccacccgatcccggaccgcctggtgcgccccctccgtcccgtcgtccaagaggctcgctcgaggccaccgttcgacccgggagatccagacctcccgctggcaccgctcgaggggctcagatggctcgtccccgaggcgctcgaggcgatctaccacacctcgtcggacggcaaggaggcgtggtgagggccctccgtcgcgacgagcgctcgcgcccgctcggcgagctccggcgcctcgtgatcgcccagccacacgagcgtcgcgagcgtctgacgcaccgccgcctcggtgacgatgggatcaccgaggtcgccatagatcgtccgcaccagttcgccgaggtcgaggccttcgccgagcgcctcacgcacctgatcgatgcgagtacgtcgatgctcttccaggaacgtcaggaccgccccgatgtgcgcaccttcgaccacaggcccatggccgggcagcaggcggcgcggttcgagcgaggcgacgaccgtgagcgacgcgaagtatgcctcgagggagccctccgggtagatgatcgccgaggtgccccggcccagtacgtggtcaccggtcagcagctgtcgatcgggcgtgacgaaccccacgtggtcggctgcgtgacccggaagcgcgacgacgaccacgtccatcgcctcgagcagcgcttcggcgccgcggccggatgcatggacatcgcagccgagcagcgccgccaagggctccgctgcttcggcgtggtcagggtgggcgtgggtggtgagcacaccccgctgcctcgcgcccgcacgatcgatggcatcggcgatggccccgagatgcgcgtcgatcatggggccgggatcgaccaccacggcgtgggtctgcgtcgagaggatgtaggtgttggtgccctcgagggtcatcggggaagggttcggcgcgaggatccgctcgatgcgcaccggtccgtgccgcgacggccccacgtcagcatcgcgggcgtctcggtgtgcatcggcctcgaccacgactcccacgttaggggacgacgcggtggctgagtacccctggctcgaccgctacctgtcgctgtgcgctcgcctcgagcacgcggtgcgcgccgagctcgatcccgccgccctgcccaccgacgcagcagcgctcgaccagctcgctcgccgccacgccctcgacatcgacgaccttgcggcctcggaacaactcctcggcgccgtcgtacgctacgtcatcttctcgatgcgcgcgctcggtcccctggagccgttgctcgcggaccccgacgtcgaggagatctcgatcaatgccccgagggaggtgtgggtacggcgccgggggcgcttcgcgcgcgcaccgctcggtttctacgaccacgagcacgtgcgacgagcgctcgaacgcctcaccacgaccgctcgcggcgcccaacgccagctcgatccaggccagggcatccaagacttcacgctcgccgatggctctcgcgtccacgtcgtccatcccgaactcaccccgcacggcacctggctcgtgaacatccggcgcccgctggcgaccatcgggcacgccatggccgaggtaccgcccctcctggcgagcgccgtgcgcgtcggcgccacgatcctgatcgcgggcctacctggcgtcggcaagaccacactggcacgagcgctgctcgatggcctcgacgacgccgtgcgagtcgtcgtcgccgaggaggtcggagagactcggctcgcgcgtgggaacgttgcgcacctgcaaacccgccgccaacggccgggggtcgaggcgatctcgctccgtgcgctcgttgcggcgtcgcttcgcatgacgcccgagcgactggtcatcggcgaggtccgagacgaggaggccctgcccttcgtcgtggcggtcgcgagcggcatcccaggactctcgacgatccatgcccgcgagccccgcgcggcgctcgagcgactcgcgacgctcgccgccatcgcaccagaggcgccaggcaccgcgacgctccgccatctcgtggccgacgcgatcgacctcgtcgtgcagctcgcctggcacgacggaccacgagtgaccggactcgtcgccgtcgagggactcagcacccccgatggcatgggccccttcgtcgtcaccaacctgctcgctccggccgctacgcggacctcacgcctcttcagcagattcccacagctcctcgaggcacgcacggagctcgtcggatgagtgcacacttgcgcgacgcgatcgccgggctcttggcactcggcgccatcgctgtgctcgccctacccgcccttgcccggttgcacgcccgtagctccgcaggacgccgaccacgacctgcgaccgtcgcgctcgggcttgccggtgcggcgatgatcacgctgtggcgtctgccggcgatcgccgatctcatcgcggcagcggcgctcggactcgccgtggtggggactcgtcgccgcgacgctcgccgcgagctcaccgcgctcgacgcatggcaccgatggctcagcgagttggcactgcgcgtcggcacgctcggcgaggcgctgtcggaggcgttctgggtcgccgtggagccgatcccaccggatcttgcccttgcgatcgcacgggccagatcgcactttcgcgtcgctcgggacttcgccgcagcgatcggcctcctgggtgagcaggcctcggatgcgacgaccgccaccgtatgccgagcgctgaccaccctcgatggcctcgcgacccacgaggtcactcgcagtctcgaggcgctcgctcgcgacctcgatgcgcaacgagcggtggcccacgaactcgatgcgcggctcgcgggcgcgcggctggcccgcgggctcgtcctcgccgtccccgcactcctcgtcgtcgtcgggatggcgatcgccggaccgagtgcctatgccaccccgctcgccgaacgtatcgaggcggtgagcctggttaccctgctcggctgctggctgtgggcgtcgcacctgctcgtgccggtggttgccgttcgcggccagaaggaggtgccgtgagttccttgatcggccttggtggtgtcgcgctcctcctcgcctcggcgtggttggcgacgaccgtgcgcgagatcgtcccggctcggctcctccgccacctcgagctcccgcccccgtcacgtccggtcgcgcggtgggtcgcacgtcgctccgacgactggctgctggccacaggggtgcagcccgcgaccgatctcgctcgcttcgccgatccggccctcggagcctcaggattggtcggcgccgttggcatcgtgggccacagcgctcccgccgtgtcgggcgccctgatggcaccggtcgtcgtcgtcgcgctccgcgtcgccatggtcatggccaccgcacggcgcgtccgcgagcgcctgcgcgcgacgtggtccagcgagctcggtgagatccgtcatctcgtggccgctggcgcaagcctccccggggccctcacgactcgtcgggacgccgacaccccatggtcgacgcagtggcacggtgccctcgccgagatgggcgagggcaccgacctcgaggtggcgctcgcgcacgtggcggaacgcctgcgcgatgcgaacgtcggggcagcgctacgcctgctggggagctcgtgggcggtcggcgccgtgacccctgcgctcggcgagctcgaacgcgacgcgctcgcacgccgacgcgccgacgcactgcgtctcgccagccgacgtgagcagctcgtctggatccccgtcgcggtcagcgccctcgtacccggcgtcacgttggtcgtcgtcccgctcgccgcgggccttcagaagctcgtcggcctctaggagccctctgaacaagcccctccctggtggtggctgagcacgcccacccagcccgggaacgagcccagctgacccgttcccatctcgctcctcaccctctcctcctcgcccctcctgtggggcgaggaggagaggacccgagcgcctctcaggtggcaagcacccagccaccacccacccgggtgagccccaggcgaaggagcaccttcaggttccaggtggcacagagcagctcgaagtggagtcggttgcgcacgagccccaggtagcgcagcctcgcgccggagagcttgcgtttgagctgtgcgtggatccgctcgacgttcggtcgggtgcgctgatagtcgagacgaacggcagggtccccaaagtgcgcccgctggctgattgcgtgccaggtggcaggggtgaaggtgaggacccgtcctcgcttcgagcgcgtgcagcgatcccggagcggacagccggtgcagtgcttgacaaaggaagcacgacccttggcggagatgggtactcggtgtccttggggacagctgacccatccctcctcgacgacgaagtcatcgatggtaaagccaccagggaccgccatggcaaggggccgaggcttgatcacctcgtcgtggccacgagcggcgagctcgttggagacctcgctcgtggcataggcgctgtcgccatagaccgtgcgcgggccgtcctcgtcacgaaggagctcgctcgccactgctgcgtccggcacggtgcccttcgtgatggtcgcagcggtgacgatgccactgtctggctcgacggccacgtggcccttgtagcccatcgatggcacgggcacgtgacttgtggacgtggcgagcgtcagggtccacggtggagatgaccctgtctgtggctacccgcctcgcgatgcgccagcgaccttccttggcatcgacacactccacgtcttggcccgccacgagcccaaggagaccaagggcttcggtctgtggctcggtgagggatgcgagcttctctgcatgggcgaggtgggcagtggcatcggcgacgagggcactcaccgtgcgcaccactgcctcttcgtcccgatagtcgatggcaggctttgcgcgggtgtagtcgatcgctggtgacagaggaatttcgcgtagttcggggatcagcctgcgtacccggttgatctgggcgacaagttgggtcatggtgtcttgggtggcaaccgcatcggcgagcacggtggagtcgacgacgcgcttcgtcttgcccttgagcacccccgtggcaccgatcacctcggccacgagctcgccgatgagtcttggggtctcggaggtggcgatgcgcctgcgccagtaggtgagcaccgtggggtgaaagcctgggtcctcgagatcaagaccaagggcgtacttccagcggaggttgtagcggacctgctctgtcgcctcggtgtccgagagcccctcgagcacctggagcaccatgaccgcgagcaccctcgaggcggggatggagggtctgccggtcgtggaggggtagagatggcggaagcgctcgtcggggaagagctctctgcggtgctcggcgaggaaggcgtagatggaccctggctcgatgagcgaggagcagaaggcctccgtcgcggtgaggtgtgcctggtctgattcggtgcccagcatgcaaaaagtctagctgagctgggcaaatggcgcttgacaggcggagggaagcgcttcccgtagccgccctacgtggaggagttgttcaggggactcctaggcacgctcaccgagacgagccgagtttcttgcctctttagtcattgtatggtatcctatgatcatccacggaaggaggtcacaatgccgacacggacgttggctccatcgacgcgcgactggttccgccgaaccctcgagcgacgacgacggatcgctcggagtctcgagaggctggtcatcgccatcgtgacacggaacgatcccctccacgaggctggcgagggcgtcgtgtcgaccgcgatcatcgtcgtgatcatggcgttcctcgcggtggggttgtggttcgcgttcaagaccatcatggccaatgccacgacgaccgtctcgaatcaggtcgcgcagctcgggagctgaggatggctcctcactcctggcgagcctcctggccgcggctgggacggtgtggatcctcgcactcgtcgccgccgtcggcagcaccgcgctcgcccaactccagctcaacgagtggtcccaggaggcggtggccgctgccgcggcgacactcgccagcggcccgacggccgcactggccgcaggcgaccaggtcctgcgcgccggaccgaccgtggtccgcgacgcgcacgcgacgtggaccatcacgtcgaccaccgtcgcgatcgacctcacgacccatgccccgagcgcactcgtcggttcggtcacgctcgacgctgcggcctcgcagcgaggaccgtgaacgcggctcgatcgatctcgtcgcactgatcgctgcgctcgccgtcgtcgcatgggtcctcggtccatggctggtggcgatcctgcgcacactcagcgccgaggcgacactgtcacagatcgcgtggtcgctggcgcgcggggccgagaccaccgggcagccaccgccccaggccgtcgcggttcccggcatcggaacggtcacggtgagctggagtggcagtctcggtcgctgcggcatcgcgacggtcacgacgcatgcgaccctcgctgccccacgctttggcgttctcgggccaggcgcgatctcgctcgccgagcgagcgaccgtctcgggcgacgccttcgtcggcggcacgatcgtcggggcgtgtggtgggacgtgagcgagccgaggcgggctcggcgctcgtgctcatcccgatcctcgcactcgcgacctcgatcatgctcctcgtcatcggtgcgatcggtgcgctcggtgtccgccacgcccaactgcgcaacctggccgcgagctgcgcgttgtacgcatcgcgtgccgtgtcgacgacggcctgggaagcgactggccagctcgccatcgacccgacgacggcacgcctggacgcggcgagttgccttggcgcaagcggtgtcgccctgtcgggttggtcgttgaccgtcacgcccccgatgaccgtcaccgtggcgctcgaggaacgcctcgcgatcccagtcgtgagctggctcaccggctcgcccgcactggtgcaggcaaccgcaagcgccacccagtcgtcctccggccccggataggctcgctgtgtgcacgcccttgccgtcgacgcgaccttcgtgcgagccgcatcggtcctcgtcgtcgcacgcgatcgcgtccccggtgccttcgcgagcgcctttcgcccctggggcgacggctcgctcctcgccatcgcgtaccaaggagacgagcccgccccgctcgtgcgcctcgtcgaggacgggaccaccctcgagatcgcgacacgccgtgttcgcctcgatggcgccaccaacttccgcgatgctgggggactccagacgcctcgaggaccgctgccttggcgccgtcgcttccgctccgagaatctcgcacgcctgagcacacgcgactgggacgtcctcgaagcgctcgggatccgcctcgtcatcgacctgcgcgcaccctcggaagccgccatggccccgacgcgagcaccgtcgttcgtcgagcttcgaccgatgccgctcgcagcgccactcgcgggcgccgaggacgccaccgaggccatcctcacgggcaggctccagagagtgacccccgatgacctcatcgtccactacgagcgactcgtcaagcaccacgcgtcggtcctccacgcagccgccgacgtcctcgacaccgcacccgacccgctggtcgtgcactgcaccgccggcaaggaccgcaccggactcgtggtggcgctctggcagctcggcgcgggtgccgacctcaccagcgtgatcgaggatttcgcactctcgaacctcctccgaaccgtgccacgcttcgtcgaactccgagatcgcatcgccgcaaccggcacagatccacgggccgtccagccctacctgagtgccgtcgtccccgcactgctgcacgcgctgtcactgctcggcgtggtcaccgcctgacaccgcgcaccgtccgcgacgaacgtccgggcagcgcaggtgcctcgaaggctcggtgcacgatcgcggaaccatcgtggctcgaaggccggaatgcttgcaggtgcgcgtgcaacaagctactgtcgggtttggccaccacgcaccgtgggggcatggcactcgtcgacacgtcacaagcgccaccagcacagacacgcggacgaaggagggggcatggccgatccaacgatcgaggcgctctacgaagagagcaggctcttccctccaccaccgaacgtgctcgaaggcgcagaggtcacctcgcgcgagatctacgagcgcggccgagatcccatcgcctactgggagcaggaggcatcgcacatccagtggcgcacgccctggacgagcgtgctcgattggtcgaacccgccctttgcgcggtggttcgtcgacgcaacgctcaacgtgaccgagagctgtctcgatcgtcacgccgaggccacgcccgacaaggtcgcctactacttcgagggcgaagagggcgacaccagggtcatcacctatcgccagctcctcgaggatgtctgccgcttggccaacggtcttgcgcagctcggcgtcagcaagggcgaccgcgtcgcgatctacatgggtatgatccccgagttcccgatggcgctgctcgcctgcgctcgcctgggcgcggtccactcggtggtcttcggcggcttctccgccgacgcgctcgccgatcggatcaacgacgcccaagcaagcgtggtcatcacctgcgaccagtcccgtcgcaagggccagaccatcgacctcaagcgcatcaccgaccaggccctcgaacgatgccccagtgtccaccatgtcgtggtcgtcgaacgcacgggcgccgacgttcccatgacgaccggccgagacgtgcgctaccacgacctcgtcgccgaccagccggccgagcggcccgccacggagacctcgagtgaggacccgctctacatcctgtatacctccgggaccaccggcaagcccaagggcatcgtgcacacgacgggtggctacctggtcggggtgtcgagcacgcatcgactggtgttcgatctgcggcccgacgacgtctactggtgcaccgccgacatcggctgggtgaccggccactcctacatcgtctatggcccgctcgccaacgggaccacgagcgtcctctacgagggtgtgccggactaccccgatcgcgaccgctactgggcgatcatcgagaagtaccgcgtgacccagctctacaccgcacccacttcgattcggacgttcatgaagtggggggacgagtaccccggtcgccatgacctgagctcgctccgcgtgatcggcacggtcggcgaaccgatcaaccccgaggcgtggatgtggtaccgcgaggtcatcggccagaatcgttgcccagtggtcgacacctggtggcagaccgagaccggtgcgatggtgatcgcaccgatcccgacggtgacgcccacgaagccaggatcggcgaccatccctctccccggctaccaagccgacatcgtcgacgacaacggcgagtccgtcccgctcggtggcggtggctacctcgtgctcacacacccgtggccgtcgatggcgcgaacgatcttcggcgatccccagcgctacatcgacacctactgggcgcgcttctccgatcgcgagcacaacgtgtggcgctacttcgctggcgacggcgccaagcgcgacaacgacggctacttctggctgctcgggcgggtcgacgacgtgatgaacgtctccggacaccgcatctcgaccctcgaggtcgagtcggcgctcgtcgaccatcccgcggttgccgaggccgcggtgatcggaagggccgaccccatcactggccaagcgatcgcggccttcgtgacgctgcgcgccggcatcgtcggtgacgacgccctcctcgcggccctccgagaccacgtcgccgagcgcatcggcaagatcgcccgaccggcctccatcgtcttcaccgacgagctgccaaagacgcgctccggcaagatcatgcgcaggctcctgcgcgacatctccgagcaacgccagctcggcgacgtgaccaccctggccaatgcggacgtcgtcgccgagatcgctgcgcgcgcccaggcacagcagacaccttccgacgatcgttgagacggaggcacccgatggggtgccacgagcagcacgaaagagcagcagcacccacgtgggtgctgcgaccaatcgcccgacacggccacagcgcccgcacggacgtgtcggggtcagccgcgccacccgcgcgggcagccagcatcgttggctgcagcatcacagggggaaaggaaaccataccgatgaccatgactgacgcccacaccgaggtggaggtctcgtccgtcaaggcgaccgcggacccgggcccgctcgggctcgctggcttcgcactcacgacattcgtactcagcacgatcaacgccgggatcgtatcgggcaccctcgtcggtgtcgttctgcccctcgcgttgttctacggcggtctcgcccaactcctggcggggatgtgggagttcaagcgagcgaacggcttcggcgcggttgcgttcaccacgtacggtgcgttctggatgtcgttcgctgcgtacgcctactacatcttgccgaagctgccagcggcgacggcctaccaagcgaccgggctctacctgctcgcatggaccatcatcacggtgatcctgttcgtcgcgacgctcgggctgacgcccttcttgaagatcctcttcgcactgctggccctgacgttcctcgcgctgaccatcggggcgcttggccagtcgacgtcgatgaccaagatcggcggttacctcggcatcatcaccgcgatcatcgcctggtacggcgtgctcgccaacctcacgaaccaggccttcaagcgccgggttctgccccagtagtaccgcgcgctcgctgagcctgaaacatcgccgccaacggggacggtccgaggacctccccaatggcggcgatggcgcgttcacggcccgccccatcgccagctgccaccgcgtcggcgagctcctcgagcagcgcaggcagcgcgtcgagctcgacgagctgattgagcgtgcggatctggcgagcctcacggcgtaagcccgtcgcatcgtccgctccaagggccaccgctgcgcgctcgatcgcgctcaccaccgtccgctgcttccgtccgtccatcgctcatcctcccgagtgcgagacgacgctccgacgaggccaccctcgccgcgagcctcccgcgccctcgcgcggcccacccatccgtcgccgggtggagcgcttcactgcccacgcgaaccggtgctcgagacgcgctctggccgagcccccgtggtgattccgtcggctgcgcgcttcgatggcgcgctgccacctcgggccaccgtccgcctgagcgccccgacccacgaggtgagcctacgtgggcggatggccgtcgcgacgcgacgatgactcgaggatcgcagcgacgacgagcgcgacctcgcgcacctcgatcgcgaacgccgcgagatcagccaccgaccccgagtggtgtcgtaacgcatcggccaccgcctcacgcatcaccggatcgaggtgacgctcgagcacgtcgaggaggcgttcggtgacggccccctcgtcgtcgagcaccaagccgagcgcttccgcgtcgcgcttcgtcaggcggcccaccgtgcgtaggctagcgctcgtcccagcgagccacgatctcgtcggcgagcagacgaccgcgcaccgtgaggcgacgtcgtccgggcgcgccttcctcgaagaacgcagccgcccaggccgggacggcctcctcgtcgatcccgtcgcgctgacggagggcgaggtaacgagcctcgaggacacgggcgctcgatgaaagcacctcgagcccctccgtcggcacgagacccgcccgcacccgctcacgccacctcggccagctcgccacgttccacgagcgcacaggatcacgaaacgaatgcgcgctcggtccgagcccgagataggcgccaccaccccagtaggtctggttgtgtcgcgactcctggccggggcgggcccagttcgagatctcgtaccacgcataaccagccgccccgaggacggcatcggcgacctcgtagcggcgagcctgtgtctcatcgtcgacccggagcgaccgaaagcgcgtgcccggctcgacggtgagggcgtaggtcgagacgtgcccaatgccgaggtcgacgacgccggccaaggtgcgtcgccacgacgcgtcatcctccagcgggtcaccgaagatgagatcgacgctcaccctgaggtctgcgaacgcctcgacgaccgcacggatccgtccgagcgcatctgctgcgttgtgtccacggccgaggtgggcgagcacgcggtcgtcgagcgactgcagcccaaccgagatgcgcccgacaccggcctcccgccacctcgcaacccgccccacggagagatcctcgggattgacctcgatggtgacctcggcgccggagacggggcgcgcgagccgaatcagcctcgcgaccgcgccgtcatcgaggtaggagggcgtccccccaccgagaaagaccgaggtggcgcagaagcgttcgtcgacgaggccctcctcgacgcggttggcaagctcgcgttcgacgtcgtcgacgaagtcgcggtcgggctcgcgaatcgcgaccgagaagtcgcagtaggcacagcgtcgccgacagaacgggacgtggacgtagagcgccgcctcccggaggggctcgtcgcgaccgtcgacgctcagcgtggctccggcagggccctcagacccaagcggtcgatgtgctcgatcatgccctcgagactcaagccgagcagtgcaccgatgatccgcagatcctcgcggcgcaccgtcatgacgcgaccgttgaagtcctggcgttgcacctggatcatgccgaggtagcgctcgaggagctcacgctcgggcccctcgaggctccgcagccgctggagatcgatggtgcacttctcggtcgtcggcgccgccaccgatgccgcccgctccatctccgcgagatcgatggtgacgcgatcgtcgtcgaggatccgcgcggcacgctccgtggtgctgaccgctggcgtcagctcactcgtcggcctcgggagcagctgctcgacgtcgacccgatagaacgctgccaagcgccgcagccgcggcaccgaaatggacctttccccccgctcgtaggcgccgagcaccgaggccttgaactccttggccgagagcgcctcgaccgcctggaggctgtagcgctgctgcttgcgcaccagccgcaagcggcgaccgacctcacgtgcatacgcgcgctctgcgctgtccatcgcgatcctcctgtccgcaccatggtgagcgcgccctcgctccgctcaacctcaagcgtagccgcccgcacacgcagggtccacaatattgccaccaagggcgacgagcagtgcacccgcgaccacagccgccgtctccacacggaggatcccgcctggcaaacgcacgcgccgcacgtcggcgaggccatcgatccggccggactcaggaccgatgacgatgcagcgtacgtcgcgtcccacgaggccacctcccgccggatctgccacgacgacgccgtctcgcgggagctcgtcgagtgtgccgacgtcgtggatccgcaccacccagggcacctctgcctgctgggccgcttcccgcgcgatgcgctcgagccgaccgagctcgtgcgctgagagcggttcgccaccgcgacggtcgtggggagcgcgcaggagccacagatcggcgatgccgagctcggcgagcttggcgaccatccacgccaggcgctctctcgagggcgcatacgacgcgatcgatacctccggcgtgcgtcgtggctgcgccacgatctccccgcacgcctcgatccgagccgtccgacgccccacctccgcgagcgtcgcggcccgtacgcgaccccgaccgtctccgatccagatcgatgcccgaggcccgagtcggcgagcgcgcaggtgggcagccaaggcatcgtcgacgaccggggcctcgagatcgtcgacgatgaagaacggttcgaggcgtccggttgccccgttggcgtcgcgacccacgcctacttgaaggcggaacgcagcttcgagagcagcgactggtcgtgatgctcgctgaccagctcaccacgcagggcagcgaggcgccgccacagctcgtcctcctcggccgtgagctcgctcgggatcgtcacctggacctcgacgatgaggtcgccgcgcccgcgacgacccgacagcgcaggcacacctctcccccgaacgcgcgtcgcccacccaggctgcgtgccggcggggatctcgatgacctcgagcccatcgagcgtctcgagttcgagcttggtaccgagcaccgcctgcggcgccgagatctggacacgggtgatgagatcgttgccgcgccgctcaaaccgctccgacggctccaccagcacgtggacgtacagcgttcccggctgaccaccacggggcgctgccggccccttgccggagagcttgaggaccaacccattgtcggcaccaggtgggacatcgaccacgaagcggcgctcctgcgtgcgtcgaccctcgcctcggcagtcggggcacgggtcggcgatcaccgttccctcgcctcgacagacgtcgcaggtcgccgtggtcaccatgcgcccgaggaacgactgggtgatccgcctgaccgcaccggttccctggcactgcgagcacacacgcggctgggtgcccggccgggcgcccgagccttggcaggtgccacacaccgcgggcatgcgcagggagatctccttctgcgccccgaagacggcctcttcgaaggtgagccgcacctcggtctcgatgtcctcgccgcgacgctgggccccttggggctgctgcgtgaacccgccgaagacgctctggaacaggtcggagaagtccggcccgaacggcccgccgccgaaggggtctccgggcccgaacggtccgccctgaaccgatcccgtccggtcgtaggttcgacgcttgtccgggtcgctcaggacgtcgtaggcctcggtcacgagcttgaagcgctcctcggcgcctcgatcgccgccgttcacatctgggtgcagctgacgagcgaggcgccgatacgcgcgcttgatctcctcactggaggcgttccgagacacccccaggacttcgtagtagtcgaccacgtcactcctcatcgtcgacgccgcacgcggcgttacccgaccgcctctgccacgccctcgcgcagcgcctcgaccaccaccgacgccccaccgtagtccatgcgcaccggccccaacagaccgatcgacccgacgatggtcccgtcgacctcgcacggagcgacgacgagggagcagtcgtccagagcggcgaccccgctctcgttcccgatcgagaccggctcaccttcgtcgatgaggcggcgcagcacctcgacgagcgacagtcgttgctcgatcgtttcgagcacaccggcgaccttcgagagctgatcgagtgcgctcgcggtcttggcgacctctcgaacccgaagttccggccgctcgcgcacgcggctctcgtcgatcgcggcgagggccgcgaagacgaccgcgtccatctccgcattcccgctcgggaggacggctagtcgctccgacattcggtgcccgcgcaaccgagacgcgaggaagttccctgccgcgacgacgaccgactccggcggggtcggctcgatctcgaacatcgcacgctcgagcgcaccccgcgagccgacgacgaccccaaggatcgtcggtggatccaagggcacgagatggacggcacgcaccacctcgacctccgaggaccacaccgcgatcacggccgtgtactgcgagtgctcgaccgcgagatccagcgtcagctcgaggacgtcgtcccactcaccacgggcagcacgcaggcgacccacaatctctcggcgcagccgctcgatgagcgtcgtatcgacacgcatgagacgatcgacgaagtatcggtagcccttcacgagtgggatccgccccgacgagacgtggggctgtgccaggaagccctcctgctcgagctgggccatctgcgcgcgcacggacgccggcgagagaccgaggtgggtcacatcgagcacgtgcttgctcccgaccgggacaccggtccggacgtactcggccacgaccgccatcaagatggcttcttggcgcggactcagctgctcttcgaccacgatgtgcgcgaacctcccgtgaggatgctcgccctcagtctagccgcgcacgcgcccacgctgggattgcgcccttcggcctggtctcgaggcccaggtcgctcagcctcagtggctaggcctcggtggcgctgcgctctcgattgacggctcgcatgaggcgcgacttgcgacgcgcagcctggttcggatggatgatgcccttcttcgcggccttgtcgagtcgctggatcgcggcacggagatactgctcgccgtcgtccgcggtggcgttctggagcgcacgcttgacgcgcgtcttcaactcgctccgaaccgccttgttccgctcgcgccggcgctcgtcttggcggatgcgcttcagttgtcccttgatgttggccatgactccctctcggcgacgacgctctcgaatccctgcttcgaaatcctgcttcgaatccctgcgctcgcggcgttcccgcgacaccaacccacgagcacacccgcgtacgctcgagagcggtgcagcgcaagccgcagcactcggacgacgaagtctagccgtgaggccagcgcatcctcgcacctaggctggagcgaccatggtggacccggcctcgatccgcaacatctcgatcatcgcacacatcgaccacggcaagtcgacgctctccgatcgcatcctcgaactcaccggcgcggtggacgcccgcaacatgcgcgagcagttcctcgactccctcgagatcgagcgcgagcgtggcatcacgatcaaggctcagaacgtgcgagttcgatggggtggaaccaccatccatctgatcgacacgcccggccacgtcgacttcggctacgaggtgtcgcgttcgctcgccgcctgcgagggggtcgtgctgctcgtggacgcctcgcaaggcatcgaggcacagacgctccacaactgctaccttgcccttgagcacgacctcaccatcgtcgccgccctcaacaagatcgacctgcccgcagccgaccccgatcgaacggccctcgagatcgagacggtgctcggcattcccgcctccgagatcctgcgcatctccgccaagaccggcgaaggcgtccctgcgctcctcgacgccgtcgtggagcgcgtcccagcaccgacgggggacccggatgccccgcttgccgccctcatcttcgactcggtctacgaccaatatcgaggggtcgtcagctcgttgcgggtcgtcaacggcaccgcgcgcgcgggcgcccagattcgcctcatgcaggccggcaccgtgcacaccgccgaggagatcggggtgcggctgcccgcctcgacaccggtcgccgatctcgggccgggcgaggtcggctacctgatcgctgggatcaaggacgtcggcgaggcacgctcgggcgagacggtgacccaggcggatcgtccagccgatgcacccctgccgggctacgagcatcccaagccgatggtgttctgtggtctctacccggtcgacggcgacgacttcgaggacctgcgcgactccctcgagaaactccggctcaacgacgcgagcttcacctacgagccggagacctcggccgctctcggcttcggctttcgctgtggcttcctcggcctcttgcacatggagatcgtgcgagagcggctcgaacgcgagttcgggctcagcctcatcgcaaccgcgcccagcgtgaactaccgcatcaccttgacctccgctacgacgatcgagatcgcaagccccgcagccatgccgccaccgaaccaggtcgctgagatcgccgagccgatgctgcgcatctcgatcatctctcccagcgagtacatcggcacgctcatggatctcgcgtcgacgcgtcgagggtcgctcgtcacgatgacgtacctctctcccgagcgcgtcgagctcatctaccgcattccgctcgccgaggtcgtgatcgacttctacgaccagttgaagagccggacgcgcggctatgcctccctcgactacgagcccgacggctaccaggtcgccgacctcgtcaagctggacatcctcatcaaccaagagcccgtcgacgccttcaccgcgatcgtccaccgcgaccacgcctacgactacggtcgccagctggtgacccgcctccgcgagctcatcccccgtcagctgtttgacgtcccgatccaagcagcgattgggtcgcgcatcatcgcccgcgagacggtcaaggctcgtcgcaaggacgtactcgccaagtgctacgggggtgacatcacgcgcaagcgcaaactcctcgagaagcagaaggaaggaaagaagcgcatgaagcagatcggccgcgtcgaggtaccccaagaggccttcatctccgccctgcgcatcgaccgctaaggcgacacccttcgcccaggtgcgcgagcgtcgctgcatgaggaggggcacgcgcaccatcgccatcgccgcggtcgtcgtgctcgtcggtggagggaccgcattggccatcggcgtgcggagcagccctcccacggtgccccggtcgcgctcccatccctcggcgagcaccgcggcggcgcggacgactcagggggtagcgatcactggcgcgccgacaccggaccacgtctcgacggtgcaagacgtcatctgttcgggggcgacctgcgtcgccgtcggcagctcaccctccggcgaccccctcatgtggtggtcgagcgacggcggcgccaccttccagcccagcgaggccacaatccccgccgacgtcaccctcaacggcgtcacgtgccaagaacagacctgcgtcgcgaccggcctcgcgagcgccccgccccccgcggggacgccggtggcgttcgcctcgaccgatggggggcgctccttcacacccaccacgctgcccgagggcgcgggaggggacgggctcgcctgctcgcgctccctctgcgtgctcgccgagctaccgctcgggacgggcggcgtggggtcagtcctcgtcgcgtcgcatcccctcggaccctggacgcagctctacctgtcgttcgcccctgccgcatcacccacagcaccgaccacgaacatcctgcggtcgagcggcctcgccgcctgtgccgaggacggcccctgcctcgtcgccaacgaggtcaccacgatcatggcccttcgtacgtccccaccgtgtggacactgactggaccacgttcggcacgcgtcgtcgtcgcgacaccctctgccccgctcggcggtggagggctctggtcagggatcacgacctgcgcgatcctcgcgcctcgctcgggcaccacgtactccctcgtcgtcgcgacgacgagggcgagcacgcgcgacgtcgtcaccgatccctcgggatccgcatcctcggaccaggacccattcctcgatccccgcgtcctcacctgcatcaatcgctcctgcatcatcgcatccccgtcgaagttcgcgcccgcagccctgtgggccgagcgcgacgggcgtctcacgaggcttcctaactccctccccgcctggatccagctcggcctctccgggaccgccgagccctcgcgaggcacgctcctcgtccccgcaccggcccacgacggctccatggacgcgacgctcctgcgactctcggtctcgccgacgggcgtcacgcccaagggattcgtcacgctccctccgtcgtagtgggtcagcgtgctgtcgcgccgtacgaagccgagccaaccacgacgaggaccgcggctcacaatgcctcgatgccgatcacacccgcatgaaccgccagccccgaagcaggcatgcacggtgacggtacgcgaggaccgaagctcgccacctctccccgtcatgccgaagcgagcacctcgatcgcaccaccccaacgacgctcgccgccgcgtgtgaccacgtaccaccccaccccggggatggccgagagcgccgccgcgagcgcctcacctgcgacgaggagggccgtcgccaaaccgtcggcgagccacagggtgggcgcgcacacggtggcttggctgagcgcgagctgacccccgggggcacgcacgtgatcgcctcgctccagcgtgccggacgttgcgacgccgccatcttcgacccgaagcacggccacgagggcacctcggacctggggatgtgccaccccgacccgatgatccccgcggagccagacgtccccgcctgccgccaccgaaactcgtgcaccgggcgcgagatcggcgaacgcctcgagcgcggcacgctcgacgatccaccccttggccacgccgtcgagatcgaggccgagcgggccgtggggatcgaacgcaccgtgagtgagcacccgaaggacctcagcgagtgcctcgacctcgcgcagcgccggatcgtcgaccacctcgccgcggcgccgccgtaggagtgccgagtcgtcccgccaggccgacagggatcgctcgagtgcctcgacacgggcgacgagccgctcgcaccgactctccgccgatccatcctccacgccttcgatggcgacgctcacgaccgttcccatcgcctcgaaggtgacctggctcacgtccgagcgcgctcccggtcgagcgcagcctgcaccgaggtcgcgtaggcctccgaggtgtaggtcgcgccggtgacgacctcgatcgggaggccttgtgccgcgagcacctcgtggtcgaggatgccgacggccgcttgctcaagcgcggctgagtagctatcggcggcgacgaagtggatcacttgaatcgattcgagccggtgccgtgcgaacgtcacggcggtctggagttcgccgtagccgtagttgatggtggcgccatcgaccgtggtgggagcgacgggcgcatacgtcgcaacggcgcggtgggccttcgtcgacgacgacgccgtgtgagcggcggcagaggagccgaagacgtcggccgcgagcgcatggagcgatcggagtccaccaccggcaccgacgacgatggcaaagctcgcgaccgccgaggtcaccgagagcgcagctcgccgcatcgcacctcctcagatcgtgtaggggtcaccatggatggcccgtcgcctcgcaccacgctggagtgccaccgcaccgacggcggtgacgaaggcaggcggccccgcgatccacacgtcggcgctccgcagctcgcccaccccctcgaagatggcagacaaaggcacctcgcgtcgcgagcccaccagcacccgcacgctgccgtggcgctcggccaccaacctgcggatctcgtcgccgagcacgagatccgcctcgtcgctcacgcgcacgatgacctgggggcgtgccgctgcatcgaggtcagccaacagggcgagggtcgccgtctgacccgcgcccccggcgacgaggatggcgcgtcgctcgctgcgctcggcgacggtgaacgacccgtagggaccctcgatcctgacacggctcccgaggcccacgttggcgaggtcgtcggtgaagtccccgatccgacgcgcaacgaggcgaagcccaccgggctcacgcccgtgaaggaccgtgaagggatgggcctcgagacgacgcccgggcacatcgagcctccagaggcagtactgaccgccacggaacgagagcggcctcgcgacggcgacctcgacctcgacgtagcgaccgtctccgagggtgcgcacacctgcgactcgcaggtcgagcgcgcgcgagaggcgccacggcttgatgagtcgaaacacgatcacgccgagcgccgcgaggacccacgcaacgatccagacggcacgggccaggggatggcggatgaaggtgggtccgagcgcaagttcgtgggcgacggcgagcacgagcgcgccatagagcgcgagatgcaccgcccaccagcgctctcgggggatccgagagcgcacccacggcacggagatcgcaccgaccacgacgagcaccacggcggcgatggtggcctcgacgaggcccacggacgaggtcaccacctggcccgtcgctccgaagaacgacgtgtgggtcgcgaccgcggccgcaccgatcgcgaggatgacgtgggctgtgatgagtccgatcgcccacggcgccacctggcggtgccagcgcatgacccgaggctgcccgatggcctggtcgagccatggcatccgcgacgcgagcaccaccatgatccaggcgagaaccgaccccacgagtccggtcagcgtggacgctgcaagcagcgaccctccaggggcgtgcacctccgcgagggtcccatcgaccaccggggccgcaagggcgacgccgacggccacaccaaagacgacggcaagcacgtcagcgccggcacgccgaggacgctcacttgcccaggtcgacgactccaccgcagcgctcacgcccacctccttgctgaggagcctacgggcgcgcggctcgcgatggctcgccggcgacggcgagcgatgctgggctagcctcagctccgtgcgcgtgctctggctccgaggcgacctacgctcctacgaccacgccggctggtctgagctcggcatcggcgacgcagcggtcttcgtcctcgacccgggccttgcccgacatgcgtcgcccattcgccgcgcatggctcgccggtgcgctcggcgagatcgacgactggaccgaccaccgactctcgctcctccacgcgcgccacggcgacgagctcgctgcgatctttgccgcgtggggcgcgacggaggtcctcacccatcaaggcgtcgcgccggggatccgccgtcggatcgacgccacccgccgctcgcttgaggcacggggaatcgcactgcgcgtcgtcgacagcgcctacgccgttgcgcccgggtccctgacgcgacccgagggtggcgcctggagggtcttcggcgccttctggcgccagtggcgcccggccgtccacggcctcggccccttcgaggcgaccgcaccgccttcgctcgcggtgaccgagcgccacttcgaacccgccgacctgcgaccccccgatcagccgctgctcaccccgcaacgcacggccctcgagcggctcgagcgcttcgtcgactcgcgacttgcgcactatgccgccgaccgcgaccgacccgccgtggcagccaccagcgagctctctcctgcccttcacatcggcgcgatccatccgcgcaccatcctcgccgccctcggcgacctcgatcgcgcggaccggttcgtccgcgaactcgcctggcgcgagttctacgcgcacgcgctgtggcaccatcccgacctcgtcgatctcgagctggacccgaccctgcgccagatcgcctgggacgagggcgacgaggccgacgctcgattccgggcctggtgcgacggtcgcaccgggttccccatcgtcgacgccgggatgcgcgaactcgccgccaccggctggctccacaaccgcgtccgcatgatcgtcgcctcgctcctggtcaaggacctccacctcgactggcgtcgaggggcggcgtggttcgaagccacgctcgccgacgcggacatcgcttccaatcgtggcaattggcagtgggtggccggcaccggtctcgacgcagctccctacttccgcgtcttcaacccgacactccagggcaagaagttcgaccccgacggccactacgtccgccggtgggtccccgagctccgtgcgtgcccgaccagcctcatccacgagccgtggcgctgggtgggacgagagaacgcgggctaccccctccctatcgtcgaccacgaccgggagcgacgcgaggccctggcgcgctacgacgctgcgcgcgcctcggcaccaggctcgccgcgcgcgcgacgagcaacctgagggtcgtctcgtcgggggcaacggagtcacctcgaagatcgcgtgcagcggtggcgacgagacgcacgagccgacccgcgcgctctggaccgatggcggcagcgagctcgcccagcgctcgcgcggcaaagtctgggcgcggtcgcaggcctgcttcccgcagcgctgcgttcacgccagcaccgtcgcgcgcgcccgtccccgcaaccgcgaagagctcgagaacacgccgctcgatgagcgtgagcagcagcaccgtgggcatctgcgcagcgagcatggcgtcgaggacctcgagcgctcgcgggagatcgccagcctcgatcgcgtcggtgagctcccagggcggacgggcgccgacctcgagcgcgaccgcacccagcgcctcctcgtcgacgcgaccgccctcaccaacgaccccgacgagcgaacgggcgatggatccggctcgcgagacctcctctccgagcgcccaggcgagctgatcgacgaccgctggttctgcactcagaccgacctcacgaaaggcgtcctcgatcgccgcacgccttcgatcactgcgcaggcggcgccgatcttcgacgtggttgtcgacgtgcgcgacgaccgacttcgccggctcccccacgacgacgaagacgacttcgttgggtccaggagcctcgctcgcggccttcacgagctctccggcctcgcgtgccgcgagcgcgccaagcccggtgacgacgatgcgccgacgatcggcgaacatcggcagctgcgagaacgacgttgcgagctcatggacggctgccgcatcgaccatggcgtgcaggaactccacctctgccgccacgccgcgctcgcgttcgacgacccgctggacttcgacctcgtcatcgcaggccacgaggcgaacggaggccatcgctaggcgctcgccgagatcgccgccaatgtgtcgagcgcacgacgcgctccacgcacgtcgtgcatccggaacaggcgcgcgccccgtaggtaggcgatcgcggctgcagcgatggacgcctcgcgtcgctccccgacctcgagcccaagtgtctcgccgacgaagcccttgttcgaggtggcgaccagcaccggatagccgagctcgacgaggcgatcggtggcggcgaggagggcgagcgactgcgacgtggtcttgccgaggtcgaaaccagcgtcgaggatcacctgggatgggccgaggcccgcggcgagcgcccgctccgcccgctcggcaaggaacccaacgaccgtctcgacgagatcgtcgtagtgcggatcggggtcgtcgacgcgtggggcgagacgaatgtgagtcgcgacgacggcggcatcgcccgccgcagcgacttcgagataggcagggtcgccaaagccagagatgtcgttgccgatgtgggcgcccgcctcgagtgacgcccggagcacctcactgtgccacgtgtcgacggagatggtcacgtcaaaacgacgagccacggcctccaccgcaggtaccacccgatcgagttcctcggagaggctcacctcggggccagcgcccgccttgactccaccgatgtccacgatgtccgccccggcctcgacgagcccctccacgtgggcgaggaagcgatcgaaggcgaagtaggacccgtggtcgaagaacgagtcaggggtgcgattggcgatccccatcacgaggggacggctcgcatcgagcacgcgaccgcgtgccacgagcgacggcgccggggcgacggtcatgcctagaacagcgctgaggtcagtcgccggcgccaggtcgagacccgtgggtccccctccggcaagagccggagcaggtcgaggaactcctggcgcgcctcctcgtcgcccttcacacgcccgagcaggtcttcgaggcgcgactcgatggtcgcctcgtcgagggcagcctcgccacgagccgcgagacgcgcccgagccttgagcgcagcgatcggctcggtatcggggaagcgcgcgaggatcgcttcggcctcctcgagctcgccgcggacgagcagcagctccacgagtccgaccgcagcacgctcgttcccgggctcgagctcgagcgcctgacgcagcgagggttcggtaccctcggcgatcagcacgtcgacgaccgtttcggccggggcgagcttcgtcacgaagtcgcgcacggcctgctccggataggcgccgacgaaggagtccacgaccttgccgtcacggatggcgaacaccgccggaatgccctgcacgcgaaaggcctgcgcgatcccggggttctcgtcgacgttgaccttggcgagcaccactcgcccctcggtctcggccaccaccttctcgatgatcgggctcagcgtgcgacacgggccacaccagggcgcccacaggtcgacgaccacaggccgctccttcgacgcctcgagcacgtcgcgttcgaacgtcgcatcggtgacatccatgcactccagtctaggagccacgcccagagggctcgtgagcccaagccctcggcacgaatggcctaggctaccggcatggaacagcgcatgttgggccgcaccggccacgcgtccagcgtggcgatcctcggatgctgcgccttcggcgacggcgacgtcgacgccaccggccactccctcgaggccgcactcgccgctggcgtcaaccacctcgacatcgcaccgtcgtatgggcaggcggaactcgccgtcggggcacacctcccctcgttccgcgaccaggtcttcctcgccgccaagaccatggagcgcaccgccgacggcgcgcgccgcgaactcgagcgcacgctcgagcgcctacgcaccgaccacctcgacctctaccagttccacgccgtgaccagcgacgaggagctcgaccagatcacggctcctggcggggcgctcgagacgttcctcgccgcgcgcgacgagggcacgacgcgcttcctcggcatcaccggccacttcctcgacgccccacgcgtcttccgacgtgccctcgatcgcatgcccctggacaccgtcatgctgcccctcggcatcgcacacttcgtcgacccggcctatcgccgcgacgccgaggccctcctcgaggcggcaaccgagcgcggcgtcggggtcatggccatcaaggcgctcgcacgccgcccgtggcccaagtccacccacgcctacgagacctggtacgagccgttggacgagccctcgcgcgtgcaggtcgccgtcgacttcaccctcagcttgccggtcaccgggttcgcgaccccgtgtgaccgacgcctgctgtccctggcgctgcgtgccgccgaggcctcccagcccctcgacgaggccgagcgggaggcggtcctactcagccaggatctcgcgccgctcggacgggatgcgggcctgtgagcacgacgagccgtcacgtcgagctgcgcgggccgagcgacgcgccggccatcgtcctcttgccctccctcggcacgcaggccgccctctgggacctggtggcgaccgtgctcgaggagcggtggcgcctcgtgctcatcgagcacccggggcatcgacccggcgccggcccgacgccggtcgcggcctcggtggaggcctacggccgcgaggtgctcgaggttctcgacgcactcgggatcgaacgcgcccacgtcgtcggggtctcgatcggtggcgccatcgccctcgccctcgcacgtgaccaccccgaacgcatccggcgcctcggcgtggtcggcgcaccgcgccgcttcggctcggccgaggcctggcacgagcgcgcagctgccgtccgcgccaacggcacagcgagtctcgtcgacggtctgctcgagcgctgggtgccaacgggctggtcggatgccaatccgagcgagcgtgaccaggtcgccgactgggtccgcgcgtgcgacgacgaggcctacgcacgccactgcgaggcgctcgccaagttcttgttcgcccccgaccgtaccgtcgaaacgcccacccttctcgtgacggggcgcgacgatccggtcgcaccgcccgcagccgtgctcgatctcgcggcctcgttcgccgccgccacggtggtcgtgctcgggcgatcacgacacctgccgtgcctgagtgagcctcgcgccctggcgaccctcctcgacgaccacctgagcggccggctcgacgactaggtcgccagagggtgcctcagcgcggcacgcaacctctcgcggccaagtccgaggtcgccgcgcaccaatgggcggttcggctcggcgaggagcggccgcagcaacgcccgcgcctcggccctcgcgaccgcctcgaagccaagcaaggctaggtgggccgtcatccactgtccatcgatgacgccgtagcccgcgtccttggcagcgacgacgagccccaggaacgccactttcgatgcgttcggcaccagcgagaccatggactcaccgacgaagcagcgtccgagcccgagtccgaacaagccgccgacgagacgacctcccagccagcactcgaccgagtgcgcgaggcctcgtgcgtgcagctcgcggtagaagcgccgaaaggtggcgtcgatccacgcacctggtcgagccggatccgcgcacgcctcgagcacggcatcgaaggcggtgtcgatgcgcacggatgcccgatcgacctcgcggagcaccgagcggtgggcaatgcgcgagagatctccctcgaggcgaagaagcgcgcgccacctgggctcgaaccagccgagcaccccttcgtccagccacatgggaaaccgagcgttgcggtagccctcgaggaccctgtccggttcgaagccgaactggacgtccacgaggtcgtcctcgtggggcccgaccacctcggcgagcgtcggcacgcgccctcgctcaggcgaggccgggcccgtcgtcgcgagcgaccaggcgacggaccgacacgggcaccgcgacaccgaacgcgagatccggggcgggctccgcccagcgcgtcggcgccccgacgtggatcacccctgcccatgcgttgcccgtgaggtcatcgggctcgtcgctcggccaaccagcggacaccttgagcgaccactccacgatcggcacgcggagcaccatggtggcgaggagctctcgacggaggggacgacgaacttccgccgttcgaccggggaggagcttgtcggtgatccgatcgagcgcgcgctctcgctccttgccctcgagcaccgtccccgtaccgaagagcaccgcggaacggtagcgaaggctcgagtggaacgcactgcgcgccacgatgagcccgtcgaggtgcgcgacactgatcgcgagcgccccgcccgccttggcatgtcgcatccaccccgacccgaccgacccgtggagcacgagcgcgtcaccgtcgcgagcgaacgccgtcggcaccacgaccggtccgtggtcgcgaacgacggcaacgtgtgcgatcagctcctcgtcgaggagctgatcgagggcggctcgatcgtcggagcgccgatcgcgttcacgggtgaggtcggtacgcaccacgcgctcacgctaccaaggtgcggccagaacgcagcgagactcaaccagccgtcgtcggctcgcccgagggcccgcgctgtccgtcggcgcgctcggcaaccgtgccatggtcgatgacgagcctgcgccgagcgcgaccggcgacggtcgagtcgtgcgtcaccacgatcagcgtgatccctcgatcccgccacaggccctccaagagcgcgacgatgtcgtcgcgcgtctgctcgtcgaggttgccggtcggctcgtcagcgagcagcacctcggggtccttgacaagcgcacgcgcgatcgccacgcgctgctgttggccacccgagagctccgtaggcaggtgctgagcccgatcagcgagtcccagctcttcgagtacccgtgctgcccgcttgtgccgttcctcggtctcgacgtgcagcggcacgagcgccgtctcgacgttctcctgcgccgtcagtgtcggtatgaggttgaaggtctggaagacgaacccgagcgcggtagcgcggagctcggcaagctcggcttcgccgaggtgcgcgagatcgcggccctcgaagcgcaactcaccggcgtctggccgatcgagtgctcccagcagcgtcaagagcgtggtcttgccctggccggtcgggccctgaatggccacgaactccccgcgctcgatcacgagatcgacaccgtcgagtgcgttgacgacggcgccgtggcgtcgaaacgacttacgaacaccacgtagctcgtacagcggctccatgtctcgaatctgtccttcggtcatgctcgactccttctcgtcctgacgcacgcttactgcacactccgaagcgcgtccgccggccggagcgaggaagctcgccaggcaccaaggccaccggccaccagcccgccgatgatggccaggccgaccgcaagtgcaatggtgtcagcctgcaagggggcactcagatgcacgaggacggttcgtacgcccgctgcctggcgcagcccagctcgcacacccgcgaagccgccgccgaagccaccaccgccaaaaccaccaccgaaggccaccgatcgaccgacggtcgctcgaagtgtcggtgacgccgccgagagagcttcggccccagcgatgccgagaacaaggccagcgatgccgccaccgacgccaaggacgagtccttcgctcatgacctgggcaacgatccggcgcgttcgccacccaatcgccttcaaggtgccgaactcacgggtgcgcctcgacacggcagccatcatcaacaaccctgcgaccagcaccgccatcaccagcgccgcgacggagatccacttcccgagacttgagagcagactgctcgtactggccagcgaccccgagacgtcgctggcaagactcgccgaggtcgacaccgtcacacctgggaggatcttggccacctcgcttgcgagcgtgctgacgttgctcgcgctctgcgcgctcacgtagatcgtcgagatgttgcccgcctcgcccgagagctgctgcgcggtggcgagcggcaggaacacgtcggccgtgctcgttggcgtcgtcgcgatgccgatgaccttcaccgacgcgcctccgacgtcgagggtcgagccgacggagagctgctgggacgtcgcatacccgctgctcacgatggcgacgtccttggtggcgtccgccgcggtgaagtacgcgcccttcgtgacctcggaaggagtgagagggccgacgccgctcgacgagatctggactccatccacgctgaaggagttgatactgaacgaaccgccgccaccactgccaaaggtcggaacagtccccgagaacgacgtgtccgtgagctggagaccgccggtcgcacccgcgacgccgcgcaaccgagcaaccttcgagacgtcagcggccggcaacgcggcctgaccacgagtcagatgcaatcggttacctgcgagacgcgcactcctcgcagctcgggggttgaaggctcccgatccaaagccaaagcgctcacccccgaagctcccgggcgttgcggtcttcgagacgatcatgtccgtaccgacgccgtacaagctgtggagcacctcgccatcggccgaacgcacgccagccgttgcagccgagaccgtcacaacgaggccgattcctacagcaagcccggccgacacgaggacggcctgtcgactgcgccgacgcagttcacgcctcacgtaggttgtgatcatcgagagctcctcgtaaccaagcgatcggtgtcaatgctgctggagcgtacggagcatggttggggcacgtctgaggaactggtgtgagcaggcttccgcttcgccggatgccgtgacacatcgctcacatctgcaacgaatcgccctcgaagcccccacgacgacccgttggcgtggcaaaggcccatttcgacgcccggttgcgcccggggattggtggagtggacagtgcccttcccccattcgaggttgacacctgcttgaggaggaagggatgagtcagacaccacgcctacccccggccgccgggaccgaatgacaacacgcagccgcgatcacctcccaccgagcggtgtcactgcactgcctggctggcctcagcccaccacgcaaggctcttcctcggcgggcgaggccagcacgcgagcagcgcggaggggccgagacgtcttcgaggtgcccgccgtgtgtcgtcactcgtggcagtttcgagctcgaccatggactcctctgacaggtcgtgtggctcgaagacgccccatgtgccgtgctggccgagcacgacagcggtgatgaggcgcacgaagccacttcgcgcccgaagaccccgacacgtggtgcgccgctcgatctcatgatgggcccgaccagagcgggttcgtgacgagatcgtgcgcgaggagctctcgggaagctgtgcagacctcctctgtggcctcggcgaccatggcgcgagccgctgggagcctcgtgggtaagcgagtcgatgacctcgtcgtactgggtcgggagtgctgccggggaggcttcgagcaaagatcgtgcggatcttgagccaggaccatctccgtagctccccttctgcgatgcgagcgagcacgtcgcgcatgctgcacgcagcagcgctcacgagttcgcccgacgaaggagctggcgatggcttggtgagcccgccctcgcccatcggagttgcacaggtgcacaccaccgagacacacgatcgctgggctccctcgagcactcgccccgcaaactctcgctctgcccatcgccgacacagcacttccgaagacctcgcacaccccggcgctgtggatgcccgtgatggccacccggatactagagatgacctggtgctcgaggcggcccatgacgccaggtggcatgggcgaagggggagcagaactcgagcgatggcccagcctgtggtgatggaaccttgccatctcctcgtcgagggatgcgacgatgcgggagacctcgccctttgcgatctccgtccgaccgcaggccgcgatgaggtcatcgacgcttcgggtgctgagcccccgagacgttggcctccagaaccacgcacgtgagagagcacgatcgacccggcggcggcgctcgccgatggctgggacgagctccccacacggagctgtgcggattgcggagctccacgtgccgcccttggtgacgagcagacggtcgcgctaaccgttgcgcttcgcgtctggcgtctctcgcctcgttcgtctcggcaagcgccgatgaccgctgctgtctcttccccgatgagggcttggaggatgagctggccccctctcgggagaagtcgatgtctccgcctgctctgatggcgccagggcacgccgggagcgtcggagggggtcagggccacctgagtggctcctctggccatctgttgtctgacacgccagagatcgctcagtggcccgccctcctcgcgtgcaggccgcccggcaatgacaccacgtggtgggatggcactgcgtccagcgcgtcgagcgcgatcctcgcgagcgggatcgaacggcggctccgctgcgtcttgacggcccctcgatgatgtgagaacctgcgacgtggcgcgaagtgcggacgtggagcgtgtcgccctcgacgtcccccagcgcagcccgagcagttcagctcggcgtagtcccgtcacgagcgcgagcacgaacaggtttccgagccgttcggacttcgcctcagcgaggaacctggctacctgctcgggggacagcgggggcagctcgacgcgaggcgcagagcgaatgggttccaccccttgcgtcggatcgttcgcgaggagccctcttgccatgccccagcgcgcagcttggccgagcacgtccctgaagagcttcagggtgcgcggggagaggttggggttgtgcgcgaggagcttttcgacgtggcggaagttcagcccgtcgagcctcacgtggccgatgatgggtgagatcgcgcccacggcgtagggatactgcgcaagcgttgcctcgcgaacgttgcgggaagcgagccaggcatcgagcaagtcggcaaccgtcttgatgcctcgctcgggggcaagcatgcgatcccgctcggctcggaacgcagcgagggtggcttcagcttcgtagcaagtgtcgcagagcttcgaccggtacacctggcggccgtcgagcgtggagcacaacgccgctcggtgcttcccatacgcgggtgtgatggtcccgtaccctcgcgtccgtcgccgtgccatgtcgtccgacgtcgcacgctcgagacgataggtcgcacgataagggcaaaaataaagcccccgagcctctgcactcggtcgtatatggcctctgagctgggcttttggagtggaggtgatgggactcgaacccacgaacctcttgactgccagtcaagcgctctaccagctgagctacacccccgtgctgtcggtagtgtagtgggtggcgtcatgccgctcgtcgatggcccgctgccggtgacggttgctgtcgtggccagcagggcgactgcgatgggggaggcgatggatctctgggtggcgaacacggatcgaaggtggttcgactttctgcgccaggcgggactcgaggaggtgaacttctggtcaccctcaccgtcccctccgagttcggcgatcgcggtcggaaccccgtggatcttccgcctgaagaagcctgattacgcacttgccggattcggatacttcgctcgcttcgagcaactttcggccaggttggcatgggatcggttcggacagggaaacggtttcgcctcgttcgaggagttcctcgatcaggtcgtacggctccgacgcctgctgaggacttcgtatcccgatcgcgacaccaagatcggctgcacgacgctcgtcggcgcctgcttcctcgaggaggatcgttggcttgcgccagtccctgggttcgagcccaatgtcgtgaggggcaagggttactacgtcaactccagtgaaggtgatgcgatctccgaatggctcgcccaacagcaggcggctgcagcactgccggagtcggttgccgcactgcccgtggctgggtacagggaggcgctgactcgcgtgcggctgggtcagtatggcttccaggcgctcgtgcgctcggcttacggggggcgctgcgccatcaccggagaatcgaccgctatcgcgctggaggccgcccacatcgttcccttcgcgctcgagcagcgccacgacgtgcggaatgggttgttgctccgagccgacttccaccgactcttcgacgccgggctcatcggggtggatcccagcgaatggacggttcgcgttagccctgcgatcgcggacccggacgagaatggccagctctacccgacctaccaaggacaactggccttcccccctccaggttgacacctgctataggaggaagggatgagccagacaccgaacccaccaccgggcgacggccccgctggacgacgacgcggccgctacccgagccagttccgcaaggacgcggcagcgttggttctcgaccagcgccgcaccatcgctgacgtcgcccgtgagcttggcatcaacgagcagacccttggtaactgggtccgtcaggaacgcatcgaccgaggtgagcgagagggcctgacgagcgccgagcgcgaggagctgacacggctgcgccgccaggtcaagcagctcaccgtggaacgcgagctgctcaagcgagcgatggccttctgggtgaaggaggggggacagtgagccgctaccactggatctcccgccaggaggccaagggcttctctgtagcggcagcagcacgagtcatcggggtctctcgccaggcctactacgcctggcgacaccgtcgggaccgaggcgaggatcccgagcacctggtgctcgcgagcgagcttcgcgccatctggcacgagagcgacggcacctacggcagcccccgcatcacccacgagctgcgacggcgcgggttctgcgtgaaccacaagcgggtggaacgcctgatgcgcgagctcgagatggcagcgggcccacgccggcgcttcgtagtcacgacgaggcggggagaggacgcagcgctcccggacctcgtccgtcaggacttcgctcctggtgagccgaagcgcaggtatgtgagcgacatcacctacgtccgcaccgatgaggggttctgctatctcgccacggtggcagatcttggctcgaggcgcatcgtgggctggtcacttgggcgtcacatgcccgatgacctggtggtcgaggcgatccgcgaagcactcgggactcggggcagcctggctggggcgatctttcacagcgatcgcggcagccagtacctctcccggaaggtacggagcctgctcgcgacccttggcattcgccagtcggtggggagggtcgcgacctgctacgacaacgccgtggccgagtccttcttcgggagcttgaagcgcgagctggtggctcgctaccgcttcgcgaacctctcaggggctcgctctgccatcgctagctggattcaccgttacaacacggtccgcctgcactcaagcctcgggtacctaccgcccgtcgagtacgagctctcctgggcctgccgggaggtggccgtggcctaaattcagactgtcaagcaaatggggggaagcccaaacctctgaaagtcgttcctcgcgaccggcagtaccagcctgacccggagcgactccgctggcacctctcgcacgtcttcaagggctagcggccctccccgagactcagggccgagatagacgcctcctgcgacacttcgacgcggacggtcgacttcatgtggccttcccccatttgcttagcagtctgaatgtaggccgcggccacctcctcgcatgcccaggagagctcgtactcgacgggcggtaggtacccgaggctcgagtgcagccggaccgtgttgtgacggtggatgtaggcagcgatggctgagcgagcctcagcggattcaacgacatctacggcctcatccaggccgtggaggacggcgcgacggtgcgggtctactacgaggcgaggcttgcgaaggtcgagctgcccgacgaagcacggggagcgctcgatgcggagttcgacgaggtcgccgaggcaatggagacggagtccagggagcgtctcaagacccgttgggcgcgcatcgaggccatcgtgggcgccgagaagcgcatcgccgccgtcgcggccgacatcgtcgagcactgggagaagcgccgcgccgccttgaccggcaagggactcatcgtgtgggcttccccccatttgcttgacagtctgaatttaggccacggccgcctcctcccgggcccaggtgagctcgtactcgattggcggtcggtacccgaggctcgagtgcagccggacggtgttgtagcgatggatccaggctgcgatggctgagcgggcctcggcgaggttcgcgaagcggtagcgagccaccagctcgcgcttcaggctcccgaagaaagactcggccacggcgttgtcgtagcaagtagccaccctgcccaccgactggcgaacgccgagggtcgcgagcaggctccgaaccttccgggagaggtactgattggcgcgatcgctgtggaagatggccccagcgaggctgccccgagtccgctgggctccctcaatcgcctcgatcacctgttttcctggcatgcgacgctggatcgaccagcccacgatgcgcctcgagccaaggtctgccaccgtggcgagggagcagaagccctcgtcggttcggacataggtgatgtcgctcacgtaccggcgcgctggctcacgaggagcgaagtcctgacagacgagatctgggagcggtgtgtcttccccacgcctcgtggtacgcacgaagcgccggggtgggcacgctgccagccccagctcgcgcatcatgcgctccacccgcttgtggttcacgcagtaaccacgtcgtcgcagctcgtgggttactctggggctgccgtaggtgctgtcgctcgcctgccagatggtgcgaagctcgctcgcgagcaccaggtgctctgggtcagggcctcggtcccgacggtgtcgccaggcgtagtaggcctggcgggagaccccgatgactcgcgctggcaccgccacgggcaagccgttggcctcctggctggcaacccagtggtagcggctcactggttgccctccttcaccgagtgggccatcgctcgctttgccagctcgcgttccatcgtgagctgcttgacctgccgacgcagccgggtcagctcctcgcgctcggcgctggtgagaccttcgcgctcgccgcggtcgatgcgttcggagcgcacccagttgccaagggtctgctcgatgaaggcgagctcgcgggcgacgtcggcgatggttcgccgctgatcgaggaccaacgctgcggcgtccttacggaactggctcgggtagcgacctcgtcgacgtcgagctggcccgtcggccggtggtgggttcggtgtctggctcatcccttcctcctatagcaggtgtcaacctggaggggggaaggccagtgtgcatgagtcgccgtatctgcgtagagctctacgaccagatcgtcaagctccgcgccgactggcatgccgacgatgacgccgccggcacgatcaaggtcgtcatcacgggttctgcctcggacggtcctgagctcaactaccacgtgcggagcaaggagcggctcgcagcactcaagcagcgcgcgaaggatcctgacgatcccctcgagctcgtcatcgtgcgcgacatgtggctcacggggttcgactcgccatcgctccacgcgatatacggcgacaagccgatgcgcggagccggtctcatgcaggccatcgctcgcgtcaaccggacctttcgcgacaagcccggagggctcgtcgtcgactacatcggcatcaccgagagcctccgggcggcccttgcggagtacaccgagcgcgatcgagctcgccaggaggtcggcgcacccatcgacgaggccctggccgttcttgaagagcaccacgaggtctgctgcgagctgctctttgggtgcccgtggcgagaggcgctcgagtccgggagcgacaaggcgcgcatcgaggcgatcatggcagctctcgaacacctcctcgccggcgctgacatggagctaccggagcgcttcctgcgccacgtccgcgcagccactcagagcttcgccattgccgtagcctctcccgaggcggcccgctaccgcggcgaccttgccttcttccaagcggtggccgtcgagctgcggcgagcgcgggctgaggagcgggcaaagagcgatgaggtcgagctcgagacggcaatccgtcaggtcgtctccgacgccgtgacggcctccggcgtcatcgacatctacgccgcctctggtttcggcctccgcaccccggctgatgtccactatgacgtgctgaggggctccgagcacgccgggccgaggcgctggaagctgcctggcgtgctcaccccgagcgcttcgtgcgcatgcggcccgaaccaccccggctccctacagccgtctggatcaacccaccggaggaggtgagcacgacgacacagtggaactgaaccggacgtgtcactcagaggttgacaggctccgagaacgccgaagggatcaccaccgagcgcctcgaggatgcgtgccaggtcgtcatcggggatcgccttaccggttgcccgctccccgcgagctggacgggacgcagccgcgacgttgcgctcgacgagccgcgaggtctccacgtaggcaagcatggctcgcaacgtggtgcgcacgaggcgaaccgacgacgtgctgagcccctcgagcgaggcgaggaacctatcgacgtcaggggtcgtgacggcggcgagctcgcgccctccgagcgcctcgacgatccgctccgtggcccatcggtactgcgcgagcgtcgaggggcgcacctcggtcgccttgagcgtgagccaggcttccgcgagctgacccagggtacggatcgtctggcgcgacgcgagcccagcttgggccgtcttgcgaagccccgcgagggcgagcacagcttcggccttggtgtcggccactcgcgagacgtagcgcaagcgcccgttcgggagacgttcggggagcgggtacctcgccatccaccgatccccgtagcggtgaaccgcgccctcacccttggccctgcgcgccttgcccgtccgcacgtgtccaggcaagttcgccaaacccatagccgcaacgatggacgcgatcttagggggttatagtggcgtgcatactgatgcacagatatctaccaggggttttgagtggaggtgatgggactcaaacccacgaacctcttgactgccatcaagcgccctaccagctgagctacacccccatgctgggtcctcatactggggcgcgcccgagtcccgcaggacgccgagcgccctcaaggcgcgccgtaggctggtgggcatggccgaggagtacgacccacccgcgctggagcgctcttggcaggagcgctgggacaacgacgagacctactacgtctccgccgacgatccgcgtcccaagtcgtacgtcctgtgcatgtatccgtacccgtcaggatctgctcatcaaggacacgtacgcaactacgccttcggcgacctcaacgtccgctaccgcaccatgcgcgggcatgcggtgctctctcccttcgggttcgactccttcggactccccgctgagaacgccgcgatcaagactggggtccaccctcgcctgttcacagaggaacggatcgctgaactcaaggcctccgtcaagcgactcggtaccgcctacgactggcgccgcgagatcaagagccatgaccccagctacatccgatggacgcagtatctgttcctgaagctctacgaagctggactcgcctaccaggccgatgcaccagtgaactggtgcccgggttgtcagaccgtgctcgccaacgagcaggtgctccccgacgggacatgcgagcgcagcggtgacgtcgtcgtcaggcgcaatctccgtcagtggttcttcgcgatcacgcgctacgccaatgagctgctcgacaccctcgacgaactggcctggccggaacgtgtcaaggtcatgcagcgcaactggatcggcagaagcgagggggccgagatcgacttcccactcgcggacgatcccacgcgctccatcacggtcttcaccacacgaccggacaccattttcggggtgacctttctcgttctcgcgcccgaacatcccctcgtcgagtcgatcacaccaccagagcgtcgcgacgaggtcgaagcgttccgagccgacgtggcgacacgctccgaactcgaacgccagagcgatgtcgcaagcctcgacaagcgcggactcgcactcggcatctcggtgcgcaaccccatcaccggtgacgaagtgcccgtcttccttgccgactacgtcctcgctcactacgggacgggcgccgtcatgggcgttcccggcgaagacgaacgcgacttccgcttcgccaccgcatacggactgccggtcgtcgaaacggtgacgcgcccgagcgaccatcccggcggcgcatggtcgggtgatggcaccaagatcaactcgggacccttcgatggcctgagcgtagcggcggccaagcgggccgtcatcgaagcgctggagcagcaaggggcgggccggagtcgaaccgtctaccgccttcgcgactggctgatttcccgtcagcgctactggggctgtccaatcccgatcgttcactgctcggcgtgtgggaccgtcccagtacccgaggaccagctacccgtcctcgctcccgacgacgtcgagttcctccccaccggcgagtcgccgcttgctcgccacgcgggcttcgtgaacaccacctgcccacaatgcggcggcccggcacgccgcgagaccgacaccatggacaccttcgtcgactcctcgtggtacttcctgcggttctgcgaccccttcagtgaagatcgcccgttcgatatcgccgcggtcgaagcgtggatgcccgtcgatcagtacatcggaggcatcgagcacgcgatcctccacctgctctacgcacgcttcttcaccaaggccctcagcgatctcggcctcatccccgcgacgcttcgagagcccttccgacagctcttcacccaaggcatgatccgcttccatggctcgaagatgtccaagtcgaagggcaacctcgtcacgccgcagcagtacttcgacaccgtcggtgccgatgcgctccggctgtatcacttcttcgtcggtccgcctgcggacgacgtcgactggaccgaccagaccgacgagatcatcgagggctgcgcccgatacctccaacgcgtctggcggctggccgagcgcattggggtcacggacacaccgacgagcgccccggtggcaaacgacctcgccatcgccatcgagcgcctcacccaacgggtcacggatgcgatcgagcgctggtcctacaacgccgcggtcgcagcgctcatggagctcgcgaacctcctcggcgacgagcgcctcctcgcccagcccgacctcgccgacttcggccttgcgcgcctcctcacgatgctggcgccgttcacaccgcacatcacagcagagctcttcgagcgccgctatgggcgcaacgtgcatcgcgagccctggccaaccgtggatcacgaactcctcgcgagcgcccggactaccctggcggtccaggtgaacggcaagctccgcggcaccatcgaggtcgacccttccatcgaggagtccgaagccatcgacctcgctcgcgccctcccgtccgtcgacgcagcgctcgcaggtcgcgagcccgagcgctgcatcgtacgactccctcgaatcgtcaacttcgtggtccgctaggagtcccctgaacaactcctccacgtagggcggctacgggaagcgcttccctccgcctgtcaagcgccatttgcccagctcagctagactttttgcatgctgggcaccgaatcagaccaggcacacctcaccgcgacggaggccttctgctcctcgctcatcgagccagggtccatctacgccttcctcgccgagcaccgcagagagctcttccccgacgagcgcttccgccatctctacccctccacgaccggcagaccctccatccccgcctcgagggtgctcgcggtcatggtgctccaggtgctcgaggggctctcggacaccgaggcgacagagcaggtccgctacaacctccgctggaagtacgcccttggtcttgatctcgaggacccaggctttcaccccacggtgctcacctactggcgcaggcgcatcgccacctccgagaccccaagactcatcggcgagctcgtggccgaggtgatcggtgccacgggggtgctcaagggcaagacgaagcgcgtcgtcgactccaccgtgctcgccgatgcggttgccacccaagacaccatgacccaacttgtcgcccagatcaaccgggtacgcaggctgatccccgaactacgcgacattcctctgtcaccagcgatcgactacacccgcgcaaagcctgccatcgactatcgggacgaagaggcagtggtgcgcacggtgagtgccctcgtcgccgatgccactgcccacctcgcccatgcagagaagctcgcatccctcaccgagccacagaccgaagcccttggtctccttgggctcgtggcgggccaagacgtggagtgtgtcgatgccaaggaaggtcgctggcgcatcgcgaggcgggtagccacagacagggtcatctccaccgtggaccctgacgctcgccacgtccacaagtcccgtgcccgtgccatcgatggctacaagggccacgtggccgtcgagccagacagtggcatcgtcaccgctgcgaccatcacgaagggcaccgtgccggacgcagcagtggcgagcgagctccttcgtgacgaggacggcccgcgcacggtctatggcgacagcgcctatgccacgagcgaggtctccaacgagctcgccgctcgtggccacgacgaggtgatcaagcctcggccccttgccatggcggtccctggtggctttaccatcgatgacttcgtcgtcgaggagggatgggtcagctgtccccaaggacaccgagtacccatctccgccaagggtcgtgcttcctttgtcaagcactgcaccggctgtccgctccgggatcgctgcacgcgctcgaagcgaggacgggtcctcaccttcacccctgccacctggcacgcaatcagccagcgggcgcactttggggaccctgccgttcgtctcgactatcagcgcacccgaccgaacgtcgagcggatccacgcacagctcaaacgcaagctctccggcgcgaggctgcgctacctggggctcgtgcgcaaccgactccacttcgagctgctctgtgccacctggaacctgaaggtgctccttcgcctggggctcacccgggtgggtggtggctgggtgcttgccacctgagaggcgctcgggtcctctcctcctcgccccacaggaggggcgaggaggagagggtgaggagcgagatgggaacgggtcagctgggctcgttcccgggctgggtgggcgtgctcagccaccaccagggaggggcttgttcagagggctcctagcgcgacccgctctgctcgtgtcgccgaggtgcactcggcttgcgttccggcgtcgatgctgcgctgcgtagacgtcatacgcgcgagcggcccgatccggaggtcatgccacgacggagctgggccgggccgagacgagcggatctccgagcgatccggcaccccgacccaccccggtggcgtgccgtcggggagcacacgaccacggcgctcaccggtctggagcgagcaggccacaccaagcgagcggcctgcctggcccgtgagccgcaggccccaccgctatactgggaggcccgcgcgcctctagctcaacggcagagcaacggactcttaatccgcaggttctgggttcgaatcccagggggcgcaccggccggttgcacgcacgagaggcgtctcgtggccgcgccacacgtgtgctgggctcagctgtgccgagatctcagctgtgccgagatctcagatgtgccgagatctcagatgtgccgagatctcagatgtgccgagatcaagtgtgcagaactcaagtgtgcagagctcggtccgcaccgtgaggcggcctcctccattcgggttccacactcccccgtcggatgtgcccgtccgctgcagtctcggcccagctccccaggcgtcaagggctcggagcgtcactcgccgtgccatcgtcagcggtcgatcacgccgtagcgagcctcacccgcaccggtcatgagtccccagtactgatccccccacgaccagtgccaccactccgtcgggtagttgacgagccccaccgccacgagcaccgagcgcagcacgctccgcatgcgtcgtgcctctcggccaatggtctcggcgtcgaagaagcatcgacctgcgctctcctccggactcgcgttcaccgccgatcccatgtccacttccgcgccgtcggctccgacgagcgtcaggtcgacagccgccccgcagcaatgcggcgggaatccgtccggaggcgctacatagcggctcgccagcagacgagtccgctcgggatctgctccccgattcgcctccaggagctctgcgtagtactcctcgaagtagcgccgctgcagctcgcgggaccggaagccttcgacgaccgcgaggcgcagtccctcgggcagtgcacgcgccgcacgcaccaggcgctccgccaatccctcgcgcacgaaccgatggttgccggtcccatcgtcgagccgatcgtcgatcacgatgagatcgcgctcgccgaggtccaccagcggctcgccgcactcactgacgggaacttgctgcaccgcctggtcgccgatcaagaccacaccaggtggcacgaggctcatcgcacccacctcgagaggacttcttcgtcgtctcccagcaccgtgtgcatcgtggccaccctcatgcgtgatcctcaggcatcggcaggtccgcgaccggcgcgcctccaagcgtgctcgcaccccgacgcgccagtgtgacgacaaccccgacgaccacgatgaccgccgtgatgatgaggtcgcccttcgactgctgactcaacgcgagcacgacgcccccgatcgcaacgacagcaggaactggccacagaggcatacggaagacgccactcgagcgccgctcgcgcaccctggcgacgagtgccgacaccgcaaccagcaggtagatcgtcacgatgatcacgccggtgaaggtgatgaggttgttgagcgacgtgaagatcgcaaggatgccgttgccgacgaagagcaccagaaacccccaagtcggaaccttggtgcgcggtgagacgtgggcaaagaagcggttcagcgccgcaagcggccacatctcgtcacgtccagaggcgtagtagatgcgcgcataggcaaggttacccgcgagaccagtatcgaacatggcgatgatcaccccgacgagcaggatcttcgcccccgtcggacccatgacgcgatcggcaatcaacgagagtggtgacgcgctctgtgccgtgtgcgccagaccgtggatggccaaggtagcagccaccaccgcggcgagttcgaagagcacgctgatgcccacggcaagcagcacggctcgaggcagggcgcgacgatccgtggtctcctcggcaaagtagagcggccagtcatagccgttgtaagcgaacagggccggaacgacggcgatcagcacggcagagagcccgaccgttccgagcacgcccttcgaaccgatcggaacgacgggatggacgagcaggcgccccgggagcgccgggtgcgcaaaggccgcgatcgcaaagacggtgatcaccgcgagctcgagcaccagcatggcggccgtcatccagctggtcggtgagattcgatcgagcgacaagagggtgatgatcgccatcatggcgaacgccgtccagttcaccggcagcgccggtgccaacgattgaagatacgtcgccgcagcaacgaggatcgacgcggtgacgacaaccccgagcacgaggaagagcacgttgaccacgccgccgccgatcgggccgagggctcggcgaacgatcgtgtaggcgccccccgcagagggaaacagcgagcctacctccgcatagcacaacgccatcgcgatggcgatgaccgcgccgatggcgaacgccgcgaccacgccggtacccgcagtcgcgataccggctccgaacaccaagaacaccgacgtcgtcggcgagatcgccgccaccgcgatggcaagcacgttcatgggacgcagtgcacctcgagccaagccctgcccgccccccgtgcgctccctcgtcatcactccccctccttcgtggcacgtgggacgatggtagcaaagcgatggcagaatggtctgacctttcgtccattgttcacgctgccgtgatctgtcaggtgccacgagggcgccgcccgatacgatgatgcgacgtgggccgagagcatcagggggcggttcctcccatcgccgacgtccggggccacctcgatctctcgcgaatcctgcgacctcagagcgcaccagaccagatcgccgatcggatcctcgccgccatcgccgtcggcattctctaccccggcgaccggttgccgcccgaacgcgagctcacctcgcgcctcggcgtctcgcgggccacgctgcgcgaagccatcggccgcctcgccgccttcggtgttctcgagacccgacgagggcgcgggggcgggaccttcgtgactggcgtgcatcgcgagagcgaggaacgcgcagcgctcgaacgagccctcgcgccgatcaagtcaacgctcgaggcactcctcgattaccgcaacgtcgtcgagcaggcgctggcccgtgccgctgccgagcggcgcaccgatgacgatgtggctgcgatgcgcagcgccctcgccgcgtacgaggacgcagcgagcgcccaggcttctcgcgcagccgatcgcgcgctgcacgaggccatcgctcgagcgacccacaaccctctcctcgaacgcgccaacgcagaactgttcgaggggacgaacctgggctttgactcccatccgtactcgccacagctccatgcgaaggctcgccagcaacatcgcgccatcgtggacgcgatcgcacgacgcgacgtcatcgcggcgggcaccctgacacacgagcacttcctcgtgaccggaacgtacccgctcatcgatccggacgagcccgatcacaccgctgcgcgagcctcgacggcctgaggcgctcacctcggggcgcggccaaccccacgctcgcgcgacagccttcccgcgcggcaccgccagcacgggccgtcacgaaggccaacgcgcaccgatcgccccgcgccaacgcgcgcgcgtcacggacacgaccgcgatcgcgcccgagcgcgacgaaggccggctcacccgatggcggcagcgctcgcgggatcgaagaagtagaggcgctcaggatcgatgccgatcccgacctgctgaccgctcttcaccgactggtcggcatcgatcctcgcaatggcctccgcccctccaccgacgagacccgccgcgggttcgagatcttcctcgtcgacctcgaggcgatagggggtcgcgtctacccgaacgtgcacgagctgttcgttcccgagctcctcgaccagctcgaccgttgccgcgagtgagttcggctcgccgacgctgccgaaacggccgagcgcgtcgggtcgcaccccgacgatcaccgcaccaccgacgtgcgccgcgatggccggatgggcggcgagaaaccgttcgtcgaggccgatgcgctgcgaaccgagcatgagagcgacaccgtcgtcacggacgagggatccctgaaagaggttcatcgcgggcgagccgatgaagcccgcgacgaacaggttcgccgggcgctggtagagggtttggggatccgcgtactgctggagctggccgcggtgcaagaccgcgacccgatcgcccatcgtcatcgcctccacctggtcgtgggtgacatagagcgcggcgacaccgatcctgcgctggatgcgaaggacctcggcgcgcatctggacgcgaagcttcgcatccaggttggagagcggctcgtccatgaggaacacattcggctcacgcacgatcgctcgccccatcgcgacgcgctggcgctgaccgcccgacagctgcgacggcttgcggtcgagcaacggctcgagtccgaggacatgcgcggcctcgcgcactcgccgctcacgctcgccgctcggaaccttggccagcttcagtgcgaagccgatgttctcctccaccgtcatatggggatagagcgcgtagttctggaagaccatggcgacatcgcgctccttcggcgacagatcgttgacgacccgatcgccgaagcggatggtgcccgaactcacctcctcgaggcccgccaccatgcgcagcgtcgtggtcttgccacaccccgaggggccgacgagcaccacgaactcgccgtcctcgatcgccagtgacagatcatcgaccgccacgacaccgttcgcatagcgcttcgtgacaccgtcgatcgtgatgcttgccatggaccctcctacgacgcggacgactcgtccagatcgaccacaaccacctcgctcgaggcgagctggagcgtgccccccacgcgctcgctcccgcgtcgccgagttccaacgagcacacgcccgccatccacgtcgacggtccggtcgccgtcggcaaggttgacgtagacctccgtctgcgttcctcgtcgaaagcgaaggacaccctcgggcgcatcgaggaaacgaatcccgccaacgacgaggtcctcacgtgcacgccgcgacgcgatgatcgccttcgtgcgcgcaagcaccgaggtcggatcggcgagctgctcctcgacgctcggatcgtcaccgaagggcagccacggctcgaccgagggcgccgtgaacccggcgccaggtcctggttgccatcggataggggtgcggcaagggtcgcgcgagacgttgccaccatcggcatgctggcccatggggtcgcggacgcgctcgggcggcaccgagccatcgcgcatgccaagttcgtcaccggcgtagagcaacgccgcgcccggcaggaggaggatcagggcgaccagcgcgagcgctcgctctcggtcgccatgagcccagcgggttgcgagcctggagacgtcgtgattcgaacccgtccagagcgggatcgctcccaccggcagcgcggcgatcgtcgtctcgatcacccgacgcagcgaagatgcatctggctcggacgccatgaaccccacgttcaggcacagatcgagttcgggcgcctccgccgagccgtagtagcgagcgagttcgatgggatcgaggacccaggtttcgccgagcaacacgcgggccggttcccacttggccaccagctcatgccaccgacggtagatctcgtgcacctccgggcgattggccgagtagcgcttcagcttccctgcccaggcgatccacggatgcgtgccgggaggggccggaggatcgtcgcgccccaaggcgtccttcacgagcccgtgcgccacgtcgatgcgaaacccgccgacgcctcgctccagccactcctcgaggatcgcttcgaaggcggcgcgtacctcggggttccaccagttgagatcgggctgggtcgggaggaagttgtggaggtagtactggccagaggcgggatcgagcgtccacgcggacgaccctgtggcatcgacccagttgttcggcggcccaccatcggcgcgcggctcggcgaacacgtaccacgcacgtctcgggctcgacggatcagcaagcgcctcttggaaccacggatgctgatcgctggtgtggttcggcacgagatcgatgagcacccgcagacctcctgcctcggcatcggccatgagtccccgaaaggccgcctcaccgccgagtgccgggtcgaccacgtcgtagtcggcgacgtcgtagccccagtcggtccgtgggctcggcatgatcggtgacagccagatcgcatcgaccccgagcgtccggaggtagtcgagtcgctggcgtagaccgccgaggtctccgagaccgtcgccgtcgctgtcggcaaacgaccacacgtacacctgatagagcaggcccccggcccaccagcgtcctccggcccgcgctgccgcgagcgtcgcaccaagttcgtccaccgagtccattcgcgccgatgcctcctaacccttcaccgcgccagccgtcaaccctgagaccacccacttacgaaagacgaacacgaggatcccgatcggtacgatcgccacgacagcggccgcgaagatcgtaccgaagggaatcaccgtcggcgatccgaagagcgcgatgcccaccggaatggtccgatagctgttggagctatcgaaggtgagcgccatgaggaactccgtccagcaggccgtgaaggtgaagatccctgcggtgaagacccctgggagcgcctgcggcaggatcaccgaccagacggtgcgcagcgtggatgcgccgtcgacccgggcagcctcttccatctcatgggggatgccgaggaagtagttccgcaagatccacaccgcaaagggaaggttgaacgccgtgtaggggacgatgagggcctgatagctgttcagccaattgagctggcgcagcaccagatacagcggcggcaccaccgcgatctcggggaagaccgagatcatgagcaggaccacgagcaccaccgcgaccccgcgcatgggcagccgaccgaacgcgtagcccgcgagcgtcccgagcaccagcacgagcgcggtggctcccagcgtgacgatgaccgaattgagcacgtaacgcccgaagccgtagtggacgaacgcactctggtagttcgccagcgagatcggattcgggatgtactgcgtaggcgaagccccgatgttcacgggggtcttcaacgacgatgcgagcagccagtacagcggtgccgcgatcaagaccacgacgagtgccacggtagcccaccgcccgacccgggcgaggggacgttggcgacgagcacccatcacgcctccttcgccgcgccgacttgggcgcggaagactcgcaggaacacgatgcaaccagccagcacgagcgcggtcgtcgtggtcgcaatggccgcacccggtccgaaactcacatcctcgaacatcaccttgtagccgagcagcgcgagcgacgtcgtcgacgtcccaggtcccccgccggtcagcacgaagggaaggtcgaacagcccgaaggcctggagtatacgaaacagcgtcgcgatcgcgagcgtcggccgcaggagcgggaaggtgatgcgccagaacgtcgtccagcccgaagcgccgtcgatctgggccgcctcgaagacgtcctccggcagcatcacgagacccgcgagcacgatgatcccgacgaacggcgtcgtcttccagatgtccgccaccatcatcgagatgatcgcaggagtcggcgtcccgaggaacagcggatggccaagcccgaccgcctggaacaaggcgtcggccacgccgtaagtcccctggtagatgtagccccacagctcggccgagatcaccgtgatcatcgaccagggcaggagcaagagggccatgaagagccctcggcccttcgtcaaccgcgccgccacgagtgcgatcagcgtgccgagcacgacctcgacgaagaccgtgatcacggtgtagccgaccgtgaactcgagggcgtagcgccatacggcagcgtggacgatctcgctgtagttggcgcccgtcgcgccgccgagctggaagcccgcgccggtcacgttgacgttggagagactgagcacgatggagaacacgatcgggaagaccgtgaccgcgccgatgacgacgagcgccggagcagacagccaccaccctgctcgagccaggcctcgacgagcacgatggtcgtccgaccgttgtgcgggtgcggtccgaggcgggaccgcgataccagcgaccatagaactacctccccggcggcaccgatggccgacgatcgacctcacaaacctcgacagcctggcgtcggatgcgccagcgcggatggagctcgcccgggaggcccgagcaacgggaccctcccgggcgaggagcgacgactagatgccgccagcgagcgccgtgttgatctgcgacgccgcagtcttcaaggcagcgctcgggctcatcgaccccgccagggccgcgttcacgttggtgtaaatcgccgaggacacctgcgggtagttcggcgtgcccgcgggccgcggcacgagccgcgtctcggcagccaccttgatcgggggtgcgatcgacgggtccttcgcgagcgcgagccgcaccgactcgaccgtcgggatctccgagtaggtcttgccgaggatgtcctgagcctgtgtcgaggacatccacttgatgaagaccaggtcggcggcgaggttcttcgagtgcgggttgatgtagaggttccagccgccgatgttcgagtacccgggataggactcgccctggaaggtcggcaacggggcgacacccacatcaccgacgaccttcgagtccgatggggtctgggagttggcccacgcatagtcccagttgcgcaggaaggccgcctgacccgagtcgaagaccgccatcgcctgaggctcttcgaaggtcgtgacggccgcaggcgacgcgcccgaggtgatcaagctgcgcatgaacgtgagcgcgcgcaacgccgccggcgagtcgatggtggccttcgtataggagctgttcacgacgctgccgccagcgctcgtgaggtactccatgaagtcacaggtcaacccctcgtagctgttgccctcccagacgaagccgtacttgaccgcgttgtcatggaccagcgtcacagcatcgctctcgagctgctcccaggtcttcgggaccgggagatgatacttggcgagcaggtccttgcggtagtagaggaagccctcgtcctcgaacagtggcgatccgtacaccttgcccttgtaggtcgcgccttgcacgagaccgggggcgaacttcgcccagtagctcgacggcaaatagttcgacagtgggacggcgaagccatgcgccccgaactcggccggccagatgacgtcacccatgaacacgtcgggcgtcgacgcaccaccggaaatggtgttgacgagatccgcacggttggtgtcggtgttggtgggtgcactcaccaagttgacgtgaatcttgggataggccttctcgaaggcgcggatcagcgcggcgcggattcctacctgcgcaatggggctcgcccaccaggtgatcgtgccgtgcgcactggatagattgacgccagacgtcgtcgacgaggtcgacgaggtcgtcgacgacgacccgcaggcagcgagcagcgccatcgaccctgcgagaacgacaccgacggcaccggagcgccgcagtcgccgccgactccgtgtcgtctgctggccctcggtcgccctcgcgaactcgtgtcggttggttccgtgactcatacgtatccccctgtctcactcccggcgcgcggtcgtggccgcgcgccatcctgacacgtcttcctacgtcctcgaaccgctcgtcaccgctcgacgcggcgcggtctgcacacctgcacctcctctccgattgccgttgcgatcgccccggacccgacgatccgcgctcaaccccgacgactcgtcaggcgacacctggcgtcgtactggccccgtcgttccgcgaacgatgacctcgagcggcagccatacacggccgccgtcgacgggctcgccatggagccatgcggcaagtacccctgctgcccaggcaccactcccctcgagcggctgacgaaccgtcgtgagtccgatcacctcggcgagctcgatgtcgtcgaaacccacgatggagaggtcgtcgggcacgcgcaggccgagctccgccgccgtacgaaggacccccatcgcctggacgtccgaggcaaccgagaccgccgtcggcggcgagccgctcgcgagcagcgaccgcacgctcgccgcagcttcggcgacgccgaagggaggatggcgaacccaagcacgccgcaaggtcaagcccgcctcattgaggacctgccgcacgcctcgctcgcgctccgcgctcgcagagaagcccatgccgacggccggccgatccccgacgaagccgatgcgctcgtgaccgagcgagacgaggtgcgaggcagcgagtcgtccaccgagcacgttgtcgatgacgaccgacggccaaccaggggcatcgtggtcgacgctcacgacgagtccaccgcgctcacgcagtcgcgatgaccacgcatcaggcacctcgatcgagatcgccacgatcgcgtcggcgacaccctctccgaccaggaccgcaagggcgcgttcgcgctggtgaggatcggcaacgtccacgaggacggggtcgaggccgagcggtgcgagcgccttgatgaggccacgcacacgctcgacgaccgatgcctgggtcacgccgctcaccagcacgcccacgacgttcgactcacggcgccgcagcgaacgagcggctcgactgggccgaaacccgaggtcacggatcgcgtcctcgacgtggcgacgggtgacgtcggccaccgggccggaaccgttgaccacgcgtgagaccgtcgcgatgccaacgcccgcctgacgggcgacatcgcgaatggtcacgcgatgattccgcgccccgagacgcccaccgcgagcggtggaaccgtttccacgcacacccagattgtgcgtcgcagccatcgcgccgtcaaggaattgcctggctccgcctcaggctgtgctcaggaatcgagccaggcacctgcctcgttcgcccacgcgcccaagtccacggatctgggcgcgcgctgcgcgacaccgaggcgcgaggcctcatccggcctcgccgccaccagagctcgcgacgacgcatgccccacgcgctgcacgacgagtggtgctcgcgcgccgtcgcgcatcggccctctcgacgcaccgggtgcgcgagcacagccgaaccgctttcgcagccgccgatgccccgaccgacgatcaacgatcggccgacaggcccgagatgacgctacccccggtacctcgtggtagcgggggtagccatgcatccgagagggaatggagaaggactagcgccggaagaatccccggccgccggaggaggagccgcattggcaccgatcttccggcggaatgtgtccgagaacctgctcaacatgctggccgcagccagaccaggtcggacgcttgcactgtggacaggtcaccgctctgcacatacccaatagggtatcacgtcttcgaggacatccggccccgataccgcacgattcgcccgcgcggtcgtctcggcgtcagcgcccctcgagcttggccagcacgcgacgcgcacgctcgcgtgccccgatcgagctcacgaccgcgacggacgcgacgagcaccatcacgaccccgagcacgacgaacgcgatgctcggccagcgagcaaggatcacgccggccgcaaccagcacggtgcccacagcagcgccgaaaggcacgggttgcgcgacgacgcgataggcctgctcacgcaccaggggctcgagctcgcgcggcacgggcccacggcgcagcgcaaggagcacggcagctcgctgcgagcggtcgagttgacggaacgactgcagcgccgtccgcagacgcagatcgcggcgagatgtcgtccggagccggacgagatcgacgacgatgcctgcgaagccgacgatggtgaggaccagcccaacgaaaccgacgacccccgtcgccgcgcgagcgaccgctgcgaccatgagcacctcccgttgcgcgaggctagcgctgcggatcgccgcagcactcctacactcacggcgtggcccgggcgaggagaccgtgacgaccgcagcgaccgcactggtcgtcctcgatcttgctcaactcatcgccatctccgtcgtggccgtcaccgcgcgtcccctcggcaacgtgggccgacgggctctcatgctctggcgtgggttcgcctggatcgccctcgccgccgccaccgccatcgccacggcttcactcctcgcgtcgcaccatcgagcagccccgatcggcgtcccgacgctcgccgtcgacgagacgttcgtcgccgcggcgctcgtcgccaccgcaactggtctcgcgccgaaccttcgacggagcgcgacctggctcgccgcactcggagcggctgcaagcgcgggcggcatcctcgccctcgtccctatcccgctacttgtcatctggccggtcgtcaccttcccggtcgccgtcgcgatcgccgcgctctggcgtcttccgcgccgctggccccgaccgctccggggagcgctcgtcgccgtggcggcgatcggcctcgtggtcagcttcctcctgcatccgccccccgtctccctcgagatcgccggaacgccccaacacaccttcacgatcgccgcacccgctgcgcaacgtgcctccatcgagacgctgtcgagcggggtgctgaccgacaccgagcacaccgcccagcgatcggtgacgctgtcgctcgcgggcgtcttcgacgcttctcgaccgaacttccaccaggtcgtgaacgtcgctatccgactcgtcggccgacccgccctgcatctcgtcgtcgacgcagcgggcatcccccaacccaacggcgcactcgcgctcgtgcactcgcgcatctcgctccagaccgggcgccggttcctccgcggcgtcggacacctcacgaccttcgcccccgatgccctcatcggcacactcggcatcgatcatcatgcctggtcgatactcgtcagcctggatcccatcggcgacggtaccactcgagcaaccgtgacgctgtggccctcggtcggcctgcacctctcctgagcgccgccaggtaggctatcgcccactcggtgaccgtagctcagctggttagagcgccagattgtggctctggaggtcgggggttcgaatcccctcggtcaccccatctcgcccgccgacacgatcccccaggacctgcgacgactcacggcgacgtggtcgcgtcgcgcatgccgcaaccgcgggacggcgctcctgcacggggggcgctggtgtgaggcgtcgtctactcccagagcatgtcgctcccagaggatattgttcccagcggatattgttcccagcggatattgttcccagcggatattgttcccagcggatattgttcccagcggatattgttcccagcggatattgttcccagcggatattgttcccagcggatattgttcccagcggatattgcccccagaacgtagggccccgaggcgatgtagcagtcggaccgtgccgcgtgagacaactattgggccgacgttggagcctctctgtgccgatgtccccgaaccgacgaccctcacaagtcgctgcacggtcgcgagcactctcgcgacaccgacctcacccgcgttctggccgcatcgtcctcgggcgctcacgccacacgatctcgagggcgtcagggagctgcgccagctcgaggggacgagctcaaatggagaagtcgatgacgctctcggactgctcggcgagtcccgggagcaccgtgatggtaccctcgggggtcgttccctcgatcgtggaacacaggcgggggtcgcgacggacgacccgcgccggcgcaccgacgacgacggcgtgtgacggcatcgactcgaggaccacggcgtttgcaccgacgtgggtgtcgtggccgatctcgaccggcccgaggatcttcgcgcccgcaccgacgaccacgcgatcgcccagggtcggatgacgcttgccgtgctcgagactacgacccccgagcgtcacaccgtgatacagcgtgacgtcctcgccgacctcggccgtctccccgatgacgacaccggtcgcgtgatcgatgaagaggcctgcaccgatgcgagctgcagggtgaatctcgacacctgtgcgccgccgcagccagtaggacaaccaccgggctccgaaccgatggccgcgctcccagagtcgatgggccaggcgatacccccacaccgcatggacgcctggatagagcaacgcgacttcgatgcgcgaacgagccgcagggtcccggtggagcgccgcgtcgaggtcgcggcgcatctcgttcagcatcacgcgtccgccaagtcggcgaagagcggcgtcgagaggtaccgctccccgaaggacgggatgatgacggcgatgagcttgcccgccgactcgggccgctgtgctacgcgccgcgccgcagccacggctgcgccggacgagatcccgacgagcaggccctcttcgcgcgccatccgccgagccatctcgaaggcctcatcgttcgtcacctggacgacttcgtcgacgaccgttgcgtcataggtcccggggacaaaaccggccccgatcccctggatcgggtgcggtcccttctggccacccgagagcacgggagaagccgcgggttcgacggcgatcagctgcagcgagggtcgccgtggcttgagcgcctgaccgatgccggagatcgttccacccgtgccaacgcccccgaccaccacgtcgatcgcgccgtcagtgtcccgccagagctcctcggcggtcgtggctcgatggatcgcgggattcgccggattctcgaattgctggagcatgacgtagtcagggtgctccttgacgagctgttccgccctggcgatggcgccgcccataccttcgggacccggcgtgagcaccagttcggcgccgaaggcacgcagcagcatcctgcgctcgcgactcatcgtctcgggcatggtcaagatgcaccggtaaccgcgtgcggcggcgaccatggcgagcgcgataccggtattgccactcgtcggctcgacgatggtcgacccgggcttgaggcgcccctcgcgctcggccgcgtcgatcatggccacgccgatgcgatctttcacgctgttggcagggttgtagaactcgagctttgcgacgacggtggcccccgccccgtcgatcacgcggttgagtcgtacgagcggagtattgccgaccagcttggtgacgtcctcagcgatacgcacgcgtccctcctatcgcagagcctgcacatgctctaacgccaagcctagccaataattccgatctgttctatcgactttgtgcgcggtgggtcagcgaggtcgctccgggacccaccaccgttcctgtccgtcggtctcgacgaggccatcggcacgcagccctcgcagcgccgcttcgaggcgatggtcgtcgacacccgagtgtcgctcgaggtcgcgcaggctctggggaccggcgaggagtgctcgcaggacacgggcccgggcctcacgaagcgaaccgacatacggaccctgccgatgccgcgacacccacggatcagtgagtccctctcggtgggttcgacacgaccggcgtagctcgcacgcatcgcactgtggcgccgctcggcaccgcaacgcgccgacgtcgaagactgcctgcgtcagccgatcggcgtcgcatccgttcaccagctcgcacccgacctgctcgaggatcgagtcggatgcgggcgcgccgaggagcgcgcgcaccaggacccgacgcgcgttcgtgtcgatcgggagagcggcgagcccaccgcactgaaccgcaacggcgcgggcgacgtagcgccccaccccaggcaacgcccgcagcgcgtcctctccgacggggcaggcgccggcccacgtctccacgatcaccacggcggcgcgccacaggcgctcggcccgccggtagtagccaagtcgtccccacgactcgagcgcagcgacgagtccgccgtctgcaagcgcgcgtggcgtcgggaagcgctcgatgaaggcgacgaaggtctcttcgaccctcgcaacttgggtctgcaccaacatggtctccgcaaccaagacgtgccacggatcgcacggtcgcgcccgccagggcagcgggcgcaggtcgacctgcccgaggtcccgacgcagggcttcgagccgtgactcgtcgaggctgtctccaggcacaccaaccacggtagaagaagcacggacccgacacgagctcgcacgcgcccgctgacgggtcctcgaggcgcgccgtgtcgctacccgcacggcaggcgtgcctggtgtcctcgatgcacgacgaccgggcctcgtgatggacccgaccccgaaccgagcgacgacgggggcagttcgtcgatccgtcgccggccccgccccaggcccaatccactgcacgctgacagagggcgcgcgtttgggagctcctcgatggcacaacgccccccgcaccgagatttcgcaaggaatctttcgcaaattttgttgcgcaaggattccttcgtaactagcatgggagccatgaccgatgccgccgcgaccccacgacacctccgcgacccacgcgcgttgcgcgcactcgcacacccgttgcgcatcaagctcctcgaagccctggtcacccatggcacgctcaccgcgacgcaagccagtgagctgttctcgacgacgcctgcgagctgctcgttccaccttcgtgaactcgcacgcttcggcttcgtcgagcgcgctgacggtggtcacggacgagaacggccctggagggccgtcgccgcccccctgcacttcgacccccacgccgacgacccggacgaagccatcgcggcgagcgagcttgctcgcgtcctccagggccgctggatcgagcgtttcgaaggctggtcgcaggtggcccacacgtatgcagcaccgtggcgccacgcgctctcgacatctcagttcgtcgtctggctcacccccactgagaccaccgacctgctcgccgaactcgctcgcctgatccaggagcgctacccagaccggctcagcgatccctcgacccgtccccctgacgccatggctgtcgagatcatcctcgatgcgcaccccttcgacctcgaggctggcggagcccagcaccaatgagaccggcggttcccccggcccttcgcgagccgggctttcggctcctcgtcgccggacaactcgcatccacgctcggcgacctcgcctacgcagtcgctctgccttggtacgtcctggcccagcacgacggtccaatcctccttgcggcggtcctcgccgcctacggggtgcctcgcaccgcgttcgtcgcggtgggcggcttcatcgccgaccgagtgcggccctggaccgccatgctcatcgcagacggcacgagaaccgcagccgccgggctgcttgccgccgtcgcactccacggaccggcacaaccagccgtgctcatccccatcgccctcgtcctcggcgcctgcgaggggatctttctcccggcgtccttctcgatcatcccagcgctcatcgcagccgaccaactccaaggagccaacgcgacttcaaccgcggccacccagctcgccacgctgcttggcccggcgttcggcggcctcatcgtggggatcgcaggcccaggtaccggcttcggcatcgatgctgcgacctttgccgtctcggcaggatcgctcgcgctcatcgctcaccatcgcaccgacgacgcggtccactcacacggtccggcctcgacgagcacacggcaagcgggccccgccccctctcctccactcacgcttcggcgcctcctcgtgcacgagccggtgctgctcctcatgatcgcaaccacggtggctgccaatctcggcctcggcggcctcagcgaggtcgctctgcccgtctttgcgcgcaccacgctccacgccgatgccactggctacggcgtcatccttgccagcttcggcgccgggggcctcgtcggtgcgctcgcggcagcgcgcctccctcggctacaccgaccgctcgtcgtcggcggcaccctcctcacaagcgcgaccgtgctcctgcttctcatgcccgcaaccgcatcgctccccatcgccgcgatcgaccttgcgggcttcagcgctctcctcgccgttgcgaacatcgtcatggtgacggccgttcaactctgggccgatccgcgcctgctcgggcgcatcatgagcatgatggtgctcgcctcggtggggctctttccagtctcagttgccatcgccggtttcgcggtacgcgccatcggcgcgtcacgcttcgtcgacgtggccgggctcgccttgctcctcgctgcgctcgccgtgctcgcaacaccagcctcgcgtcgcttcgcttcaccaccagcggcgcccgcgcctgagcttgcggagcccgccgactagcgcgccttggttcacgcgcgccgccacgcctttcccccgcacgcagcctcgacctcagcgcgttccacgcgagcgaacgcgacccgtcgtggcgcctggcaacagcgcctgtccgacacgcgtagctgccacagtctgcactggcgccacggaaacccccgagacggcgagttgcgcctcagaagactgcggcgagacctagcagacgtgacccgcgggcgcgctgcaaccagcaagcacctcgaggtgggcggcggactcgaacgcactcggcgtgccgacgggttcgcctaccacgagccaggagaagtgaccggccaaggggtcgccgaagaaacgaccctcgtagatcagatagtcgcccgctggcaccaccccgccgacgaggtctgtcggctggatcaaccagtagcccttcgcatcgactaccggccacacccgcactggatccggtcggccgccgggaacggccgcttcggccacctgggccgacgctgggaactgaccctgctgggcttgaccgttcaaggcagtcaggtcgggttctgcgcttccaagagcgaagtactccgcggcgaccgccggcatcgaggcaccccagaccagccacggacgccaaaggggactcgtcggcaagctcacctcctcggccacggaaccgtgtctcgtcgtcaccgttacgttgacgccggccgaggagaaggcctcggcctctgcgctactcgtgtacggcaccgagaacacgatgtgctgatcagaccactgtcgcagcgtgccgccgctcgtcgccccgccgaggatcgccgacgcaagatcttgtccgttggctcgagcaaccgtgaacgagtccgcgttcggcgtgtctcccagcctgctcccctcgaccgacaccaccacccccgtcggcaagctcccgtccgggctcggaacgaaggagagctcgatccccgcgatgtccggcggagcagcgctactacttgccgacggtgtcggagttacgacaggagtggtcgtcgagtggctcgcacgctgcggtgcagaggcgtgatgaccgcttgagacgaccgcaccgcacccggccattcccacccccgcgagcacgagcaaggaagaccatcgcgaacgttcgaaccgcactgtcatgcctgccccctctcactcgacccacacgcccacgaccggacggcaggtcttcgggtccacaaccccggtcatctccaacctgcgcgcatcgtgcgacgctgtcaagcgctgcccagggtaggcaccggccttcttgtgacccggggtcagcggtcagagccgacccgcttgcggcacagctgtcgacggtgccggtagagtcatgacactcggcgtcacctcgaccgagcacctgctcgctgacgccgagctcgcgggcgaactcggcgatgttgcggtgctggccgaggacgagcacggccgcgtctctacggaactggtcgaggtcgtggcctcttcccaggcgagcgggtccgttagcgagggctggtggcggtgtccagttcatcccttcccccgtaacaagtgtcaacccatttgggaaggcaatcctcgccggatgcgtggtcgtgccgtacgtcgcccggtcaggcaaacggaggaaagctcgcgcgtcccttgtctggccctgggagacgggtcaataaccgagccgctactcccctgagcaccggggcgtcctctcgagcgacggtccacacgcgctcgacgtttacgtcggcgtaggcgtgaatgaggacgttacgaagggccttgaggcggccccaagggatctcggtgttgctgcggcggaaggcttcgctcagccgacccgccgcctccccgatgatctccaactgtcggatgaccgcactttgcttctcgtcattcgcaaggaaggcgtcgtacgacactccagccaagtaccggtcaatccggtcgcaagcgaccacgatgtggtcaagatacacgctgtctgtgtggcgtgacatagatcgtgcgccgatcggccagcacttgttcccggatgaatcggtgcagcaggtgaggttccacgagatcgacacgccggcgcaacagcgccccgagttcctgctggacctcgatcaggtcgagcaggctccgcaccgggctgtcgggctcgaacgtcacgagcatgtccacgtcgctcgttggcatgaagtcgtcgcgcagcaccgacccgaacagagccagttcttcgatgccgaagcgatcggccaaggccgccaacgcggcgtcgtcgacgctcagcctgggatgctcgcgaatgatcacgctccgcgcctcctgatgcaaggctaccacggcgcgaccgcctcgcctcgaaggcgacaccagctcgtaacgcgatgaccggctccttgtccccgcgcgaaggggccagccagcctcttggcgtcgcttggtggcgcacgcacgacaaggggccttgccgagcacgtcgacccaccgcagctgagcacggtaaccgtcgcgatagcgggtggtcgaacccatccctctggtaggccgcgtgccaacctacccaagagcgtcccacctcagtgggttgggccataggttgctttctaggtagcaggagcacccaagtctgaactatgcagcttcgcacctagcgcctcagtgaggagtgatgctggtcgggctggccggatttgaaccggcgacctcttgacccccagtcaagcgcgctaaccaagctgcgccacagcccgttgccagcgagtctaccgagcgagagtccgggggcctcctagccttggcggccgtcgtcgagaccaaagcgacgagcggcgctcacgacctcacggcgatcagggcgttctcgatcaagcccatgagagcggacgatgtcgtggagccggccggagatctctccgacggcctcttgctgctgatcggtggccgttgcgatctcacccacgcgaccttgcaccgatgcgagcccgtccacgatccccgccacggcagcccgagccgaacccccaagttcgacgctgcgctccgactcttcgagaccttcgctgatcactcgcacggcctcgctgacgccatcgcgcacttcagcgatgccgaccccaatctggtgcgctagctcgcccgcacgacctgccagctgtcgaacctcgtcggcgacgaccgcaaacccccgtcccgcagtccccgcacgagatgcctcgatggcggcgttcagggcgagcagattggtctggtccgcgatccccccgatggccccggcaacggcatcgagcgaacgggtgcgctcggcaagggcggtcagcgcctcggaggtgctccggattcgctccgacaggaccccgaccgcgtcgatcactcgaccgaccgtggcgtccccgtcgcgagcagcctccgatgcgctcgtcgcgagctgtcgcaggtcccctgatgcgcgcgcaacctcggccgcagaggcgcgcagctcctcgaccgcggccgcgatctgggcgacgcccgacgagagctcaccgaacctcgcctcggcacgaaccgcctcctcgcgcgccagttgttcgatcgccgtccggtcgaaccagtgagccaggtaacccacgagccgaccccgatcgtgcaccggacgtacgtgggtctcgaggatgcgatcaccaatccgaatctgggcgctgtgactcccgccgcgcgcccgcagttctccgagcacgcgtcggacgcgctccggatcgcggtggaaccgatggatgctccccccgaatgcatggcgcacgtcggcgccttgcaagccggcgttcagctcgacagcgtgctcggcgaagagggcctcggctgccgggttgacgtagacgatggtctgctctccctccggttcggcgatcatcaccgggatctcgaccgcgtccagtgcagcagcccggagctcgagagaacgaagtgtggacggagcgacgacgcgaagagccatgcacgaggtatcggcccgagatctgattccagttgaggacggggtcacgaccctctgtcgtcctgctcaggcgtggcaggtcagcgggcgtccgccgttgtaggcgatcatatcgccgaaggcagcgagcacatcgacctcgcgcccatcgagctcggcgatcgctcgatgcacgttgccgacgaggcgctctgggtccaaccacgcagcgaactcgccgagatcgacggagcgcgccgcctcgagcgggggcaccccggcctcgtgtgcttcgtgcgcgaggtgccacacgaagcggagatagcgctcgacggcgtcgagatcagccgtcgtcgcaagtgggccgtgccccggcacgatgacgtcggcgtcgaaggttcggagccacgcgatgacctcgatccagccctgcaccgacccgcccagcgcaaagggggtgccgccgacgaacaggaggtcgccagcgaagagcacgcggctctcgggcaaccagaccaccgcgtcgcctcgtgtgtgcgcaggccgacccgccgccctcacctcgatctcgtgatcgtcgaaccgcagggtaagaccgtcgtcgaagagcacgtccggcatgcgcacgtcgatctccccccactccaccggcgtgaacacgcccggcggcggcacgacgatcccggtcgcgagctcctcgggcaccgagcgctgagcgatcatcacctcaggatcgagggttgcggtgccgttcgtgtgatcgccatggtggtgcgtcgccaccagcaggcggcgcgatggtgctccgacgcgtcgagctgcctcgaggagcgcctgggtacgacgcacggttgcggtggtatcgacgtggacgctacgctccccagcgagcacgattcctgcgttcgacaggaaccaggagccatcgggttggaggtaggcgaacacccccggggccagctcctcgagtacgccgtctcgacgcggcgtccatgacgacgagctagacgagctagaggacatggtgcagccacatgatgagctggatgaggcgataggtcaggtagatcaccgtcgcgaccagcagcagcttgaagtgccacggggttcgcttcggcggtgcgatgacggtaccacagctcgggcagtgcccttccttgtccagctccgtggcatcctggaagcgctcgcagctctcgcaccagggcatgcctcaagcctagtggcagcgctcaccgaagtgcggtgctacaccggtggtaccccgtgtcgacgctccgagaaatggcgatccttgaccgccgcacggctgagtcgagcgatcagctccgagcggaggtcctcgggttggacgatggcatccacgacgaggtctgcggcgagccgaacgaggtcgacgtcgcgctcgtactcctcacgacgagcggcgacgaagcgctcacgctcggccggatcgtcgatctcctggatcttgcgatagtaaaccgcgttcactgcaggctctgggcccatgaccgcgatcgacgcccctggcagggcgatcgtcgcctcggggtcaaaggctggaccgcacatcgcatagagccccgcaccgtaggccttgcgaacgatcacgctcaccttcggcaccgtcgcctcggcgaccgcagtgatcatcttggcgccgtgacggatgatcccctggcgctcgacctcggagccgatcatgaaccccggcacgtccgcgaggaacacgagcgggatattgaacgcatcgcagagccaaatgaagcgagcagccttgtccgcggagtccacgaagaggacgccccccttgaccgcagggttgttcgccacgatcccgatgctctggccgtcgaggcgtgcgaagccgatcacgagctccggggcgaacagcggcttgagctcgaagaagctccccgcgtccaccagaccctcgatcacgcgatggatgtcgtagccttgctgtggagcgtctgggatcagtgaccgcacgagcggcacgagcggctctcgaggctcctcacggggaggatcgccctcgaagtcgctcggcagatacgacaggaatgctcgagccgcctcgatcgccccacgatcgtcgacgacgaggttgtccccgcatccagagatcgtcgcgtgcatgcgcgcgccgcccatctcctcgagcgtcacgcgctcaccgatcaccacctctgccatgcggggagagccgaggtacatcgaggcgtgtccctccaccatgaagaccacgtcgcagaaggccgggatgtaggcccctcccgccgccgatgggccaaacagacagcacacctgcgggaccctgcccgagagacgaacctggttcgcaaagatgcgccccgcaccccgtcggcccgggaacagctcgacctgatcggtgatgcgagctcccgccgaatcgaccaggtagatgatcgggagtcgatggcggtaggcgagctcagtgatacgaacgatcttctcgacggtgcgcgcaccccaggagccggccttgacggtctggtcgttcgccatgatcgccaccggacggccgtcgacggtgcccgtaccggtcacgaccccgtcggccgggagcgaggggtcggtggcgttcgcgaacagaccgtcctctcgaaaactgcccgcatcgacgagcagaccgatgcgctcacgcgcgtgcaacttgcccgaggccacgagacgctcctcgaccgagctcggccaggcgtacttcgtggtctcggcgagctcaccgatgcgctcgtactgatccacgcgaccctcctccactcacgccccgcggcgacgcaccctgagcttgatcggcgtcgcatccatctcgaaggcctctcggatccggtgctcgaggaatcgcaggtacggcggcgggaggctgcggttcgcaaagagtgtgaaggtcggcggccgcgtcgccccctgtaccgcgtagaggatgcgcccggcgggcggggggtgctccgactggagctcgttcaagaagcgattgagctggcccgtcggcacgcgacgctcgtagtcggcccgagccgcgaagatcgccggcagcactcgatgcacgccgcggcccgtgagtgccgagatccgaaccggatcgagccccgtcacgaaagccagtcggtcctcgacgtcacgctcgatgcggtccttggcctcggcgtcgagctggtcccacttgttcagcacgacgacgaccggtgagcccgcggcgtcgatgcgctcgacgaggcgctgatcccatccggtgacgccctcggtcgcgtcgatcacgagcagcgacacgtcggccgcatcgatcgccgccagcgtgcgcaccatcgagaagtactcagtgcccgactcgtagcggctgcggcgccggagcccagcggtgtcaacgaagcggatgcgaccctcgtcggtctcgacgaccgtatccaaggtgtcgacggtcgtgcccggctggtcatagacgatggcccgcggctcgccaaccagtcggttgaacaggctcgacttgccgacgttcggccgccccacgatcgcgacggcaacgtcggctgccggcgccgcctccggctcctccgccgcggtgaggtcgagtcgccgtgcaacgagatcgagcagctcgaagacaccacgaccgtgcatcgccgacaccggcaccggctcgccgaccccgagcgccaagtgctcccagatggccggctcatgcccagggctgtccaccttgttcgcgacgaggatcgagggcaccttggcgcggcgcaccacgcgggcgatggctgcgtcctcctcggtggggggcacacgcgcatcgacgaccacgagcgcgagatccgcccgccggagcgccgcctccaccgcagccgacaccgcagcatcgagaccgtctgcgcccgcgaggtagccgccggtgtcgacgatcgccagcggcgccccctcccagtcgatggtcgcctccttcgcatcccgcgtcaccttgggccgttcctcgaccaccgcctctcgtcgtcccaccacgcggttgaacaggctggacttgccgacgttcgggcgcccgacgatcacgacgcgcttcatgctgctctccccacgcggatcgcccaccgcagcgcgctcccgttcgtcgcgacgacctcgagccgcgggtcgagttcatcgagagcgacgccgtcgatgaaccgacccccggacagacacacgtccggcagcaggagccgatcctcaggggcgtctgcgaccgctcgagccacgtcgctgcccgcgaggaggcctgcgacccccacgttgccgccgaaatactcgttcgccacctcgacgacacgaacatcgccgtagccatggcgctcgaggagcgggcgcagcacggctgctccatagctggatgtgacgacggccgttgctgggcctgggcgccgccgacccgagagctcgacgcgcgtcgctcggtagccgagggccggggctccctcgatcgcccgaaagaacccgctcgcgggctccgtcgacggcgacctggcgccgaggaactcggcctcgaaggccctcgcgagcccgataccgttctcgagctgaggcagaccggcgtagtcctcgagcggcgggaactcgacccccccgaccaggtagagctcgtcggcggcccaggcacggggcgcacgccgatcgcgggcccagcggtcgtagcgctcgatgatctcgaccgcccggcgtgcctcgtcgggggtgtgggcacgcaggtgctcgcggctgaagcgcgacacgccgtagggcacgaccccgatgctcgcaaggcccggtgcgaggagcgccagctcggccaaggtcgcctcgagctcgtccgcgtcgttgcgctccggcacgagcacgacctgcgcatgcacctcgacgcccgcctcgacgagcgcgaccagccagcgcagcgacaccgcgccacgcgggttacgcagcatcgacgcccgcagcgcggggttcgtggcatgcaccgagacgtagaggggccccaggcgttcggtgacgacccgttcgaagtccgcctcggtgaaacgcgtgagcgtcgtgaagttgccgtagaggaacgagaggcgatagtcgtcgtccttgacgtacagcgtccgtcgcaagcccttcggcagttggtagatgaagcagaactcgcagtggttgtcgcaggtggtcaccccgtcgaacacggcgtcagagagctccgccccgagcggcatgcccgccgccttgtcgacggccacctcgagcgacacaccgcctcgctcgacctcgagcaccgggtctgcgtcgtcgatgagctggcggtactcgatgacgtcccgaggctccacgccgttcaccgcgaccagcacgtcgccgggcgcgagaccggcgcggcccgcaggcgagtcaggctcgacgaagagcaggtgaggacgaggcacaccgagagcctagtgagcacccagagggcgccttctcgagcgccctagactcacgaaccatggccgtcgacaaggtcctgctcgccgctcctcgtggtttttgtgccggggtcgagcgggccatcggcgccctcggctggatgctgcgcatcttcgaaccgcccgtgtactgctaccacgagatcgtgcacaaccgcctcgtggtcgaggcgttcgaagcagcaggcgtcgtcttcgtcgacgacgtcgagagcgtcccccctggtcgcccggtcatgctgtctgcccacgggaccgcccccgaggtcctcgaggcggcgcgccaacgctgtcccatcgtcgtcgatgccgtctgtccgctcgtcacgaaggtccaccacgagatccgaacgcgagcccagcgcggctaccagatcgtctacgtcggtcatcgtggccacgaggaggccatcggcgccaccgccgaagctcccgaagccgtcaccttcgtcgagacgccagaggaggctcgcgccatcaccctcggcgacgggccggtcgcgctgctcgcccagaccacgctcgccgtgcccgaatgggaggcgatcgccgccatcgtcgccagccagacgcccaacctctggcagccgggccgctccgacctgtgctacgccaccacgaaccgacaggcggccgttcgggcgcttgcagagcgtgtcgacgccatggtcgtggtcggatctgcgaactcctcgaacacccgcgctctcgagcgcgtcgccacgagcgccggcgtgggccacgtcgagcgcgtcaaccgcccgagcgagctcgtcggcccgttcgagggcatcgtgggcgtcaccgccggggcatcggctgcggagtccgtcgtcaaagatgtggtggccgcactcgcgccgcggctgggcgtcgaggagatcagcgtcctcgaggaggacgagttcttcccactccctcccgatctgcgcgacctcatcggtgcgctcgcgggcgtcgtcgcggttgcaacaggcgtctccccagagggcgcactgcccgagcgagagtccgccgaggcgatactcgccgcactcgacactcgccaccgctagtcacgcctacgtcggtcgatccgtcagatcgcctgcgtcccgtcgagacggatcgaacgctcatggaccggagggagcttcggcagctgcgtcggatcagacgccacccgccgcccggaggcgacgatgagggctcgcgagcgtcgagccgcagcgaggagccgattgagctcggactcgagcatctcgctgagctggcggatctcctggcgccgaacgcgcccggcccaggatgcgcgaacttcgccgggccagagggctcgaccaacctcgatcgccacgggagccgggaggatcagtgcagatccagggcgcatcgcccgctccgacccggcgatggccgccggcacgaccggcacgcccgcccgcaaggcgaggtaggccgctccctcctcgatgccctccacgcgctcgccgcgacggcgcgtcccttcggggaacaccacgagcgagcgcccgctgccgagcgccgcgagcgcgagctcgatcgcctcccgatcggtcgcttcgcggtgcaccgggaatccaccgagcagccgcagaagcgcgccgaaacccggtgcctccatgacgccggacttggccatgtaggtcatcggctcgcccgtgatcgagccgatgaagggcgtgtcgagattcgagcgatgcgtcggcgcgaggatgtagggcgccgggggcagcgcctcctcgaacccgaccgcgacagcgaacatggcccgattggccagccggacgagctcgcgcgcgccgcggtagaaggcccgctgggccaacgagccgacctcgatcacgcaggcacctccgagagcgccgccacgagttcgcccacccgcacggcgagtgctgcaacggagacgtccgacgtgtcgacgacgatcgcatcggcggcaggcaacgccggcgccacagcgcggcgtgcgttgacccgatcccgcgcgagcaccgcgacaccctcgtcgtgtctcctcgccacacgcaccgcgtcccgcgcgacgaggaacagcttgagctcggcgtcgggaacgacgaccgtcccgatgtcacgaccctcgacgaccgccgaaccgagcgcgtggatgtcggctcgctcgagcgcgaggacggcgtcacgaaccaggcgatcttgcgtcagcacggcaagcacctcggtgagtgtgggatcgcgcaggcgcgcgccgagcgcttcggcctcgcggtagcgagcgagcgggtcgccgacgcgccggagctcttcggccacctccgccggtgccaacccctcggcctcggcgaggtgcgcagcgaaacggaagtagagccccgtgttgatacaggcaatcttgagatcgtcggcgagccgcaccgcgagagtcgacttaccggtccctgagaggccgtcgatcgcgatcacgagacggcggcgctgggctacggccccatcgtgccgagatctcgcctccacggccaggtaggctagtgaggagcaaccgacgggacgtgcgggtgcgctccgtgcgaattcgagttctgggctcaggtcattctcggattgtccggacacactcacaatgactaggtcggcgtcggatgaaggagttgggtgtgagcagaacgactcgctttgccaaggatcgcgggttgacggcacggatgaccttcaccatcttcctcctcgggctggtgtacgtcctgttcttcggactgctcatcgccgtcggcgtcggcgcgctcaccgtggtcgtcatcgcggcgatcttcctcttcgtgcagtacttctacgccgacaagatcgcgctcttcggcatgcgtggccacctcgtcaccgaggaccaggagccgcagctctaccagatcgtcgagcgactcgccgccctcgctgacatgcccatgccgaagatcgccgtgtcggaactcgacatcccgaacgccttcgccaccggccggagcccgtcgaaggcggtcgtgtgtgtgacgcgcggcctccagcgccgcctctccccccaagagctcgaggcggtcctctcccacgagctcagccacgtcgcccatcgagacgtcgccgtcatgaccatcgcatcgttcatcggcgtgctcgccggcctgctgatccgggtgatgttctactccgagctcttctcgggtgggttgggctacggcgggggacgtggtcgtggggggcagatgcaaggcggcggccaactcgtcgccgtcgagatgctgatcatgctcgtctcggcgatcgtgtacgccatcagcttcctcctcatccgcgcgctcagccgctaccgcgaactggctgccgatcgctccggcgcgatcctcatcgggcgtcccgcgctcctgaagtcggcgctcttgcgcatctcgggcgccatgggacagatcccgacgcgggacctccgaagcgcccaggcgttcaacgcgttcttcttcaccccggcgatcgcacctcgcggtggcatcggcctcggcgagctgttctcgacccatccctcgctcgagaagcgcatcgcccaactggatgcgctcgagcgccaactcggtacggcggagtaggcgtggggttcttcgacaccctcttcggccgcaccaaggtggcccagcccaaggtggacgccctcttcgcgctcccgggggcagcgatcacgctcgaggtcgccgccaacctcacgagcgacggatggggcgcggtggtcttcaagcccgcctcgggagccgccttcgcgaacaccgagcacgagttccgcgacgtgctcgccgagctgaccgacacgacggtcacgcaggccaccgatggcttcggctatcgctgggtcctccttcgcgccgcggatctcgagaccctggtcacggccgtgcacgccgtgaaccggagcctcgaggaccatggattcggccctcagctcctctgctcactgttcgccttccatgacaccacaggcgcccagcccgtcttctgggtctacctctacaagcgcggcaccttctacccattcgtccccaccggccacgaacaacgtgacaacgagcgcgaactgtcactgaaggcggtggtgggctccgatctccccgtcgaagaggacctgacgcgctggttccccctgtgggacatccccgacccgccacctgccgccgcccaagacggcacgggctcgacgacctaatcctcggttcggacgacggcctcgcacaaccgcacgaaatcgtcgacgaagccggggtagctggtcgcgacccactcggcgtcgcgaatgcgcgccccgatgccctgggtggccgcccagacggccgcactcatcgcgatccgatggtcacgcaccgaatccacgaggacgggcccgctggggctcgtcgggccctcgaccacgaagccgtcgtgcgaggtctcgaccgtcgcaccgaaggcctcgagcatccgagccgtcgtctcgatgcggtcggactccttgacgcgtagctccgcagctccctcgatgcgactcgtgccccgagcggcagcaaaggcgacggcgagcacggggacctcgtcgatcaggctcggcacctcgtcggcgacgatcgtcgtcgcgccgagcgcggcgccgcgcacgatcaccgtgtcgcgtccgagcacctcgatctcggcgcccatacgccgcagcacgtcgagatagcccgtcctcgtcggccccaggtaggcaccacgaacctcgagccgtgctcccggggtcgctgccgcggccaccacgaagaaggccgcagccgaggggtcacgcgcgaccacgatgcgctcgacggggcgcggtgtgccgggcaccacgctcacccgatgtcgcccatcggcgagctcctcctcgtcgacctcgagaccgagcagaccgaggagttcttccgtgtgcggacgggtcgcgaccggctcgacgacgctcaccgccgacgccgccccaaggccagccaacagcagggccgacttgacctgggccgaggcgacacgcagctcgatggtcccgcccgcaagccgcgcgccgcgcacggcagcaggcagccagcgagccccccctcgcgcgtcgatcaccgcgccgaggctccgcagcggctcgatcacgcgtgccatcggccgccggcgcaccgacgcatccccgtcgatgaccacgaggccaggcacgagcgtcgcgaccccgagtccgagccgcgcgagggttcccgagttgccgacgtcgatcacgccttcgggctcgacgaggccctcgatgccggggccgtcgatctcgagggtgccgttcgcacgctccgacacgacggccccgaaggcacggatcgcctcgagcgtggcggtgacgtcgagcgcgcgcgagaggccctcgacgatcgtcgttccccgcgcgaggagcgcgccgaggagcgctcgatggctgatggatttgtcgggcggcggctcgagcacgccagagggggcatgtgcacccggccggatgacgaggtccacgctcgtgacctaggccggcaggtcgtctcgcagaccgaccgcgccatggaggtagacgtggtggaaggcgctccggggtcgctcgtcttcgaggtgcatcagcacgcgcacgcaccgctgggttccccccacgatgtcgagctcgcgcgcgcagatcaacggcacgtcaccaaggccgatctcgcgggctgcggtggcaggaaagagcgagtgcagatcgtcggtcgcggtgaagaggatcgagacgagctgctccttgccgatgccgttcgccgccagcatgcggctcacgagctcctggacacgctcgcgcatcgcctcgggcgtgtcctcgtcaagcgtcgtcgctccccgcaacccccgtagcgccatgggccgacaggctagcggccccgatcgcacgacgcaggcgtgcgagctcacgcggctcgagtcggcgcgcgacccccggagggaggtgagggtcgacgagcggaccgatccgcacccgcaccaaccgctcaacgctgagtccgaccgcgcccaccatccgacggatctggcggttgcggccttcggtgaggacgatgcgcaccagcctcggaccgaccgtaccgacggatgaggcacgaaggagctcaccgtcgacctcgaccccttcgcgcagttcccgcccgaggcgtctcggcacgggccgatcgacccacacgaggtattccttgggcacgtgaaaccgcggatgggtcagctggtaggtgagcgggccgtcgttcgtgaggatcaacagaccctcgctgtcgacgtcgagacgccccaccggatacaccctcgacgtggtcgccaccagcgagcgtacggtcgggcgcccctcgggatcgaccaccgacgacaccacgccgcgcggcttgttgaggagccagtactcgcgctgctcctcggtcgcgatctcgaggccatcgaactccacacggtcgacgcccggacgcacccgcgcaccgatcgtggcaacctcgccgttgatccgcacccgaccgtcgcgaatcgcgtcctcgaggacccgacgcgaaccgcagccagctcgcgcgagcaggacgtgcaccttgaccgactcggcgctcacgactggccgcgcacctcggtctcgagctcggccacctcggccgcgctcggcacgtagcgaccgagcggcggcagctcctcgatggagccgagccccgcacgcaccaggaacgccgtcgtcgttcgaaaggcgacagggtcactcgaggggacctcttcgatgaggccacgctcgaggagcgtccgcacgactccgtccgagacgacgccgcggacctcgctcacctgcgcgcgcgtcaccggctgcagatacgcgacgacggcgagcgcctcgagcgcagctcgcgagaggcgccggtccgcgaccccgagcgcccgacgagcgagcgccgcgtactccggcactacctcgaagaccgcaaacccatcccgaacgcgcacgcgtaccccccgagcgggggcggcctcggcggccgcgatctgcgcctcgatctcggcgacgtcgcgctcgaggagctcggcgagttcgccgatcgcgacggacccgcaggcgccgaccaccgcctcgatcgctgcgccgagctcggccggatcggcggcgccaggcgcgcgctcgtcagtcatgcgacgccacgccgatcccaaccaacgcccgtgccgcgtcgtcgtcgacgagtcccacccacagctcgtcgccgacgacctcgagggtgagtgcgccgagcgcgtagccctcgagcacgatcacgaagcccacgacgacctcgagtgctcgccacccgcgtacgacgtcgcggaaggtcgtacgacgacgtgcgcgtaccgaagcgagtacccgctcggcgaccacctcgatccgtaccatctgactcggcagcgtgacggtgccaacggcccgtcgcccgcgaccttccaacccgacgagtgctgcccggagcgacgctggatcgatcggtgcgagcggcggctcgggcaccggaaccgctcgcgcgagcaccgcgtcctgatcgccgagtcgctgcgcgagctgccctgcggcccgcgagatcgcccgctgcagcgcgagcgcgacgagcacccgctcacgacgttcgtcagcgagctcgagcacctcctcgtccggctccgtggtgagcgcgcccaaccatctcgcgagcaaccaactcgcagccaccaacgccccaccgagcacctcggggtcgtcgatgccgacgagggcgctctcgacgagcgcgccgagctcgagcgagctcggatcgagccgttgggccctgacggcctcgaccgcctcagcgaggctcgttggccccatcgaacctcatcaccatcatgacgtgcggaccgacgccgggaacctcgaacgacgccccgacgcccgtgaaaccaagacgttcgtagaagccgagcacccacgctctcgcgtgcaggaacatcccgcgggggccgcgctcctcggccgtcaaccgctccagcgcctcggagacgagcatgcgaccgatcccgcgacgctgcgccgactcgaccaccgccatgccccgcaggcgccaggcccgtccctcaggatcgagcgtccccgcgagcacgtctgccgcagcagggccaggggcctcgaggaccacagtcacgacgccgatggtcgaaccatccgcacgcgaggccgcgaggtggaggctccgaggatcctcgtccccccgaaagcgcgcagcatcggcgggcttgcccggccgcagcacggccgcgcgcacctcgagcacgtcgtcgatcccgacactgcggatcgtgacgtcgctcacctctgcctcctcgccctctccgccgagctcacggcactccggtagcgtaccgtcaccgacgtggcgtcgcgcctcgacgagcagcctcgatcgagcgggcgaccagcgtcaccggatgcacgacgtcgacctctggtccgagcagcgcccgcagctgcagtgtgcagcccgggttcgggcttgcgaccacgctggcggccgtctcggtcaccgcgcgtgccttgcgctcaccgacctgcgtcgagagctcgggctcgaggaggctgtagagtccgccagccccacagcagcgcggcccgccgacgtccaccagctcgagaccggggatctggcggagcagcgcccggggggcatcgacgatcccctgtgcgaaggcgagatggcacgcgtcgtgcaccgcgacacgagcctcgatggctccgcggggggctcggggtgcgtcctcggtgagcaactccgtgatgtcgatggtggcgcgcgcgaccgccgcgccctcctcccccacgatccactcgtagcgacgcaggtgcgccccgcacccagcagaggtcaccacaagccgcaccgactcgtcacgatcggcgagtgctgccatgatgcgccgcgcatgacggcgagcagccgcctcgtcgccagcgtgctcagacagcgcaccacagcacacgctctcgagcacctcgaccgagtagccctcggcctcgagcacgctcaccgcgtcgtcgttcgtggacccgagcgcagccgaggcgacgcatccagcgagcagcaggacgcgtcgacgaggcgatcgggccgaggacgtgatgcgaggttgcccaccgtggcgtcgatcggcgacacggccctcgtcgagcgcgcgcgcaacgcgtcgtccgaacccacccccccgcgccagtgccggacgaagggcgaacaacggccgaccgagcgcgagtgcggctgcgctcgcacgagccgaggggaagagccgggcgagcgaccgacgccacgttcgatcggcgagcggccgccccggctcgacgagtccacgcgcgagatggatgatctcgtcgtagcgcacgccggaagggcacgcaggcacgcaggcttcacagccgatgcagcgatcgatgtgcagtcgaaccctgtcggcgacgacggggccgctcctggtggcctcctcggcgagcaaccagatacgaccacggggcgaatccgcctctgcgcgtgtgaccgcataggtggggcacgcggagaggcagaacccacagtggacgcacgtcgcggcgagctcggcgatccgtgcgcgagacgtcgtgtgggtcgccgtcatcggaaccgcctctcaggatcgagttcgtcggcgagtcgcgtcacgagcggatgtgcgaagcggtcgacgagaccgaaacccaccgcgtcgtccaccccctcggctcggcgcacctcgccgacggcaccctcgcggcgcgcatcgtcgagcagtgccgggagcgcttctgccccgcccggatcggcgacgacgtcgacgagaccggcacccggatagctcgcaaacgagatcccaggaggagccgtcgtgcgctcgagccacgcgagcatccgcgaggcacggccggcgagccgcagcaccacgccctcacgaggcacccggaacgcggcccgcgccgtccgctccgcgtcgagacgcgcagcatcgagctccgtggcggcgatcccgtgtgcacgaagcacccgctcgagccgctcggactgcgcctcgaccccgcgctcggtgccctcgaacaccacgagcgcctcggtcgaggctgcgagccagtcgatcgcgaccggctcaacccgctccgcgagcgacacctcgaggagcgtgcggagctcggcaggaccggacgccaccagcacaccacgctcggcctggggtcgagggtgggcgcgcaacaccacctcgccgacgagtgcgatccgaccccgtgccccgcacacgagcttggcgaggtcgtagcccgcgacgttcttgatcacgtgcccgcccgaatgcgcgacggtaccgtcagccagcagcaacgtcgcgccgatgacgaggtcgcgcaccccgccatagcgccacaccatggcgccgtgagcactcgtcgcgaccatggcgccgacggtaccgtcggccacgggatcgagcgcgatccgcaggcgcgcctcggcgaggacggcgttgagctcggagaggcgtaccccggcaccgacggcgacggtgaggtcgtccacacgggcgtcgatccagtcgagtccggtggtccgaagctcgagggagcccgctacgacaggctcttggttcgttccctcaccgacgatgcgaacgggctgctcgggctcgaggccggcgagcagtcggctcgcctcctcgatcgaggtgggcgccgctaccatcgagtcgccaccccggcctcctcgagcggatgcggccggtaccgacccgcctgctccccgcacaggcgaggggtcggcaacagcttgcccgggttggcgaggccacggggatcgagggcagtcctcacgcgtgcgaagacggacaggtccgtcgcactgaacatctcgggcatcttgcagaccttgtcgaccccgatgccgtgctcgccggtgagcgagccgccctcggcgagacagaggctgaggatcgcggccgcgacctcctcggcgcgcgcctcctcgccggggacggatgggtcgtaggtgacgagagggtgcaggttgccgtcgccggcgtggaagacgttgaggatctcgagccccgactcccgggcgaggtcgccgatggccgccagcacccgcgggagcgacgtgcgcgggatgacgccatcttggacgatgtaggcgggcgcgacgcgaccggccgccgcaaacgccgccttgcgcgcacgccacatgcgctcgcgctcggcctccgtcgtcgcgacccacaccgaacgtgcccccgcggccgcgagcgcctccctgaccgcgacgaagccctcgtccacctcctccgcggggccatcgagctcgacgagcagggcggctccccagtcgagctcgagtccggcgtgcgtcgccgcctcacaggccacgagtgccgggcgatccatcatctcgatcgcggcaggcacgaggccagcccccacgatctccgacaccgcatcccctgcttgcaccgcgtcgtcgaagtaggcgaccagcgtccgacgaagggacggttggttgatgaggcgacagacgatggtcgtggcgatgccgagggtgccctcggatccgatgatgagaccgcggacgtccggccctggcgactcgagggactgcccacccacgaagaccagctcacccgtcgggtcgatgagctcgagaccgagcacgtggttcgtggtgaagccgtacttgaagcagtgggcaccgccggagttctcggcgatgttgccgccgatggtgcaggcgatctgcgaggaggggtcaggggcgaacagcaacccctccccagcgaccgctgccgacaggtcgaggttgacgactcctggctcgaccacggccacccgcgagatgggatcgatctcgagcacacgggtgagccgcgcgagcacgacgaggacgccgtccgtctccggcaacgcgccccccgaaaggccggtaccggcccctctcgctacgaagggaaggccgagacggatgatctcgcgaaccccgacgatgagctcgtcacgactcgagggcacgaagacgagacccggagtggcgcgatggctggtgaggccgtcacagctgtaggcttgccgctcgcgaggatcgtcgatcaccgcatccggaccagcgacggatcgcgcgaacgctgcaaagcgcgcgagcgctgtcgacccgctcatggcggcaagtgtagcccgggtgggtgatccgcccgaggaggaaggagcaacgatgacacagaaggtcgtcatcacgggcgcaacggcggggatcgggctcgccaccgcccgcaccctgcacgcagccggctgggagatcatcgccatcggtcgacgcgacgatcgcctgcgagacctcgccgacgagttcggcggggagcgcatccacaccgtcgcgatggacgtccgcgacggtcaggcgatcggccgtctacgcgccatcgtgggtgtgcccgacgccatcgtcaacaacgccggcggcgcacgaggcctcgaacgggccgacgccgcgcagctcgacgactggctgtggatgatcgagacgaacgtcatcgggctcgtacggctcacgcacctcttcctccccgacatggtggcgcgcgggagcggcacgatcgtgaacgtcggctccgtggcgggcgagtttccctatccgggtgggaacgtctacggcgcgaccaaggcgttcgtgcgccagttcaccttgaacctccgggccgacctcgccgggacgggcgtgcgcgtgaccgacgtcgaaccagggatggtcggtggcaccgagttctcgctcacgcgcttcggcggcgacgagtcccgtgccgcggaggtctacgaaggcatgacacccctcggtcccgacgacgtcgccgaggtcatcgcgttcgtgctctcgcgacctgcgcacgtgaacatcaacacggtcgcgttcatgccgaccgaccagggtttcggacccttcaaggtggcccgccacgacgacgtctgagcgtccacctacgctcgaggccatgacctcgaccctcgggcgtagcgacctcgcagccccttcaccgagccgaagtagccggcgtcgggagggatggctcgcgaccagtggcgggacgctccacccagagggtgtcgtgagcgcccacccagagccgacacgactcgagcgccccgcccctcacgaacgcacggcccgcgaggacctcgaggcgatcagcctcgctccgggcgcgacccgcgccgagggggcgggacgacgagccgtcccagaggctcccgacccgttgcgaacctgcttcgaacgcgaccgcgaccgcatcgtgcactcgagcgcgttccgccgccttgccggcaagacacaggtcttcatcttcccccgcgaccaccagcgcactcgcctcacgcacgcgctcgaggtcgcccaagtcgcacgcgcgatcgcgcgtgggctccgcctgaacgagacgctcgtcgaggccatcgcgctcggccacgactgcggtcacggaccaggagggcacccgagcgagacggcgctcgacccctacctccctgaaggctatgaccacgccgtccagggtgcccgcatggcgctcggctcgctcaacctgtgcgtcgagacgctcgacggcatcgagaaccactcgtggtcacggccgcgacccatgacccccgagggggaggtcgtctccctcgccgaccggatcgcctacctcgcccacgacctcgaagacgccgtccacgcaggcatcgtgaagggagacgagctgccagcgagcgtacgagagctgctcggcgcgcaccgaggcgaccagctcgacgccctcattcgcgacgtgatcgaccagacggtcacgaagggggtgatcgggttctcccccgccgtggctgaagccatggccgacttgcgacgcttcaactacgagcgcatctatgaccgacctgcctcacgccgccaggcggccttcgtcgtcgccctcctgcgctcgctcatggactacctgctcgcgaacccgaccgcagttcccgaggtcgcagcctcgccggagccgacgagggctgccgtcgcctgggtggcaggcatgaccgatcgattcgcgctcgacgtcgccaagacctggctgggctggcgcaccgagccacccagtgcacgaggcgagggcctctaacgatatactcgatatatcgttagaaaggaggatggcatgtgtcacggacaccatcaccatccaggtgaaggagccttcggcgaaggaccgcatcgtggagctcgcggacccttcggcggcggacccttcggaggcgggccattcggcggcgggatgcgacgcggaggacgtgcaccgcgcggacgcattcgagctgagatcctgcggctcctcctcgatgggcccaagcacggctacgagctgatgaacctcatcgccgagcagagtggaggcgcatggcagccgagccccggctccatctaccccacgctccagctcctcgaggatcaaggactcgtggcgagcgccagcgatggcgatcgtcgcgtctaccagctcaccgacgcaggccgtgaggaagccgaacgactccagcacgagcccgggccacacgcaggtccggctggcgcccgactcggtcccgagatcgctcaggtcatgggcgcgctgcgcacgatcgcgatgtcggggacgccagagcagcgtgacgctgcccagagcgccatcgcggagtttcgccgaacgctctaccagatcctcgcgcagtagcgcgagtgctcgagcgcgttcgggcccgagggacgtgaggcccggtcatgagccgggcctcacgcgcgactctgatcgcgctcggacttagacgccgacgacctgatagccggcctcgacgagctcgacgaggacctcgccggccggacgcagaccgactccttgtgcctccaccacggcgtgatccagcccgagctgatcgacgttggcaggacaggcctgaacctcgacctcgccttcgcgaagctcggcgagcaccgcactcacctcggtgtgcgtcccgtcggcgagcgcgacacccggtccgaagaggtacaccttgacgtcctcaccacggcgcgtcttgagacgctccgcaagtcggagtccgctcatcgccttcccgacctgatcgggccctgctgtgatccagaatgcaatcttcgccatggcatcaggctaccccgagcacccccttttcgtgcacatcattacagttgcacgtgcaccgaaatttgccgaccacgtcgctctgggagcagtgctcactcgctccgagcgcgtgcccgagatgaccgggcgcgagaggcgcctctgctcggtcgacgacacgaaaccgttgcgcgagcacaccgtgggtcgctaggctcctgccaaccgaccggtcggtcgggacggacgctgtggttgccaaggggggacatgcacaccgtacgcgatccgctcatgcgcgccgagctcatcgctcgtgacggcaccgccgtcgtgtgtggcgccacgacgctcacctaccgcgacctcgccgaccgcgttcgacgcctcgccaacggcctcgcgggccttggccttgcgtccggcgatcgcgtggcgatcatcgccgacaactgccaccgctacgtggaggcctacctcgcggtaccgggtgcgggtttcgtgctcgtgccactcaacacgcgatcgagcccagccgagatcagcttcgccctcgaggacgccggcgtgcgcatcctgctcaccgatcgcgatccggccgcctacgaccacagcgtcgaacgagtcgtccgcatgcccgacgactacgaggacctcctcgagcgcacccctcctggtccgcttccgaacgcccccaccgagaacgacgtcgccgggctcttctacaccggcggcaccaccggccggtcgaagggcgtcatgcttacgcaccgcaatctcatcgcgaacgccgtcactgcgctcgagtggacgaggatgcgcgccgacgaccgttggctcgtcatggcaccgatgttccacgccgcgggcacctgctgcgtgctgacgtgctgctgggtcggcgcttcgcaggccatgctcccgagctttgacgccgccagcgccctcgatctcatcgaacagactcgagccaccggcaccctggccgtgccgaccatgctgaacgcgatgaacgatctccaggccaccgagccccgtgacgtctcgagcctccgcctcctcagccacggcgcgtcgccggctcccctcgagatcctgaagcgagcccacgtgctgttcccgcaggcagaactgctccatctctatggcaccaccgagaccgcgccgatcgcgacgaccttcgcccacgaggagctccatctcgacgatcgcctcgcaggttcggcgggccagcctgccttcggtgtcaccgtcgtcgcgctcgaccccgacggtcgccccgtgccgccgggcgagatcggggagatcgccgtccgaggcaacaacgtgatggctggctactggcaactccccgaccaatcagccgaggcgctccgaggcggctggtaccacaccggcgatctcggcttcctcaccgacgacggctacctcttcttggtcgatcggctcaaggacatggtcgtcaccggtggcgagaacgtctacaccgtcgaggtcgaagatgcgctctatcgacatccagccgtcgccgaggctgccgtcttcggcatccccgacgaacgctggggcgaagcggtctacgccgtcgtcgtgccccgctcgcctgtgaccgaggacgaactgcgctcgtacctgcgcaccctcatcgcgtcctacaaggtcccgaagcgcatccagttccagagcgacccactcccgaagtcaggcgccggcaagatcttgaagcgcaccctccgcgagcccttctgggcaggacgctcgacgcggatcggctcctagcctacgacccgttgtcatcagtcacctcggcgccgcacgccagcgctccaccgagccagaagggaggggtgcgtgatcatcagcaccatgaacgacctgccgggctacgacgtcaccgccgtcctgggcgaggtcttcggactcacggtacgctcgcgcaatgcagtctcccagtggggggcaggactcaagtcactcgtcggcggtgagctgaagggcatgaccaagaatctcgcgcgaagtcgcgaggaggccacccggcgcttggtagaagaggcggaggcgaagggggccaacgccatcctcgctttccgcttcgacaccagcgagctcggcgacatctggaccgagatctgcgcctacggcaccgccgtcacggtcgtcgcgaagagctgaaccctcgtccccgacgccgtcgggcgacccaccgcgggcattggggccggccgtggccccaacgccggacggacccgcaaacctaacgtgcgttgagcgagcgcgcgcgtcggccactcagtggccccccgagcagcgcggagaacgcgcagatgttgatgaggccggccaggatcggcacgagaccgacgatcgccaccacggttcgcgcggtgccatgggcgagggtaagcgcgagggcgatgatgacgagcccggcgacgacccgacccgcacgccccgctgggcgcgccatctggcatgccatctgggttccaaccttggttgccatgactcctccttgggttcgcctggccatcaaccaggctcacccatccttcggagccgtccacgtccgcggatggatcccgacgccacaccatcgccctagcgtcggcgaacatgccagcgcgcgaggcgagcgtcctcctcgcacggcacgacgtcaggggcgccggagcagggctgcgaccccctggccaacccccacgcacatcgtgacgagggcgtagcgaccgtcgcgagcacggagctcgtgtgccgccgtcagggccagacgagcaccgctcgcgcccagaggatggccgagggcaatggctccaccgttcggattgacgagatcgtcgtcgggatcggtcggcaagccaagttcaccgaggcaagccagcgactgcgccgcgaacgcctcgttcaactccaccacgtcgaggtcggcgacaccgaggccgaagcgctcgagcaagcgcctcgacgcagggaccgggccgatgcccatgatcctcggcggcacgccggccgtctggccgccgacgatctcgcaccacggctcgagtccgtaacgcgcgagggcggcgtcgctcgccacgaccacggcactcgcgccgtcgttgacgccactcgcgttgccggcggtcaccgtgccaccgacacgaaatgccggccgcagtcgtgcgagcgcctcgagcgatgtctcacgcggatgctcgtcgagctcgacgacctcctcggatcgaccgcgcaccacccgtaccggcacgatctcggccgcaaagcgaccagaacgctgcgccgcgagcgcgcgcgtgtgcgaccgcagcgcgaagcggtcttggtcctcgcgggtgaccttgaactcctcggcaacgttctccgccgtctcacccatggagtcgacaccgaagcgctcggcgaggcgcgggttgacgaagcgccacccgatggtggtgtcgtagaccgtggcagagcgggcaaaggccgcctcggccttgggcatcacgaacggtgcccgactcatcgactcgacaccgccagcgaccaccacgtcggcctctccgaccgcgatccgtcgcgccgcatccacgatcgcctcgaggcccgaggcgcagaggcgattgacggtgacggccggcacgccctcgccgaaacccgcgagcagcgtcgacatgcgcgcgacgttgcggttgtcctcacctgcttggttcgcacaccccgccacgacctcgtcgatcgcctcgaccggaatgccgacgcgctcgacggcccccgcgagaacagtcgcgagaaggtcgtccggtcggacggacgccaactgaccgccgtaacgaccaaagggggtacggaccccaccgaccaaccaggcactcattggacacctccacgtcgctcgaggagcggccgacccagcgaacgcgatcgaccccgaaacaccgccacgaccgagccatcacgcgtcacggtgacgtcgtagacaccgctacgccctcgacgcacgacctctcgagcctcggcaacgagacgatcaccgacgtaggcaggttccacgaaactgatgtccgcgccttgcgcgacggtgacgtcgtcgtaggtgttgcacgcgaacgcgaacgccgtgtcggcgagcaggaacaccacgccgccgtgggcgatcccgtgaccattcgtcatggcctcgtcgatctcgagcacgagccgcgcgtaccccggagccaccgcttcgagcgccatcccggccgagcgcgaggcggtgtcgtgctcccacagataggccgcacaggcctcggcgagctcgactggactcacgacctctcctccctgccatcggacccgctcgcgagatgcgccgtcccttggtgcgagcgcagaccggcgaggacgaagtccgccacccagttgccgtactcggcgcgtccgagacgaccatcggcttccttgaaccacgtggggtaccagttcacgatgccgaacacgctcatcgccgcgacgggaagctcgagggggtccatctcgggtgccagctcggcgacgagccgttccatgactcgcacgacgcgccgctcggcgtcgcgcaccgctcgacgctctgcgtcgtcgagacgctcgagatcgttgagctgcacccggtggacgtccgcctcgacctggtagcgctcgacgagccgacagatgagcgcacggaggcgggcctcggccgtaccttccttcgcgccgatcgcctcgacctcctcggcgagatcgagtgcgtagtccagcaggatcgccgcgaggatcgactccttcgtggagaagtaatggtagagcgccggcttggacagcccgaccgccttcgcgagcatcgccatggaggtgccacgaaaaccctcgcgcgcaaagaggatgctcgccgcacgcacgatctcactgcggcgatgctcgtcactcggcaccgtcatcgaccgatgaacctcggatcgcgtcgctcctggaacgcgcgcatcccctcatggaagtcatcggtgccggcgagctggccttgcaggtgcgcctcggcagccaagcctcggcggcgaccttcgccgccgagctcctcgaacagcgcccgggatgccagcagtgcctgcgtcgggccgctggcaacccgtgctgcgaggtcggcgacggcgcgctcgaaggtttcgtcgtcgaccacgagcgacacgagcggcgcaaccctcggatcgtcagccgggaggagttcgccggtcgcgatcaaccacatcgcccgccaacgtccgagcacgcgccagagcgcctcgtgcgcgccagagtcgggcgcggccccgagacgagcgaagggcgacccgaggcgacaggagcgagccgctacgaccaggtcacaggcgagcgcgatcccaagacccgtaccgagcgcagccccatgaatcgccgcgatggtcggtgccgagagtgagcgcagctgttcgaagagcggatggtacgtccctgccagcacaccctcggcatcgtcatggtccgggtcgatctcggtgagatcacgaccggccgagaacgtgcggccgacccctccgatcacgacggctctggccccctccgtccgtcggagcgcctcgccgagcgcctccacgagaggtcccgtggtcgcgttgcgctggcccgggcggttcagccacacccacgcaacgccgtcacggcgttcgtcgacgacgagctcctcgcgcccctcggccacagccggccatcgctcgaccacgacgctcacctcccccccggatcacccgcgccagggcccgtcgatccccgtcgctgtcgttgctcgaggaacgcccccatgcgcgcacgcttctcatcgctctcgaagagcaccgcctgtgcgaggatgtccaccgttcgcgtcgagggccgctcgacgctggcgaggaccagcttcgtgaactcgagtgcgcgcagcgactgggacgccatcgacctcgccagagcgacggcgctccccaccggatcgtcgtcgacgacgtcgacaaggccccactcgtaggcctcggccgcctcgacacgaacgcccgccaggagcatccggcgcgcgcgaccgagcccgacgagatcgaccagacgtcggtgcgcgcccgcaccggcgacaataccgagtccaacctcgggctgacgaaaccagcttcgcgtggaagcgacgcgaaggtcacaggccatcgccagctccaggccgccgccgaccgcagggccgtcgatggcggcgaccgtgggccaacgccacctggcgatccgatcgaacagatcgacgttgatggcccgaagggcatcctcctcgccgcgagcgaggagttctgcgatgtcggcccccgccacgaaccgaccgggcacggcgctcgtcaccacgagcaggtgcggggcatcacgcagatcatcgagcgcacgatggacctcgttgaccagctcgagcgagagggcgttcgccgcctctggtcgatcgatcgccagcgtggccacgagaccgtcgaccgcgacgtgcaggtgcgggtagtcccctaccactcgaagaacccgcgaccactcttacgcccgagctccccgcgcgccaccttgtcgatgaggatctgcggcggctcgaagcgcgaaccgaggtggaccgcaaggtagcgcgcgatctgcagccgcacgtcgaggccgacgaggtcgctgagccggagcggaccgacgggatggcggtagccgagctgcatgcctcgatcgatgtcctcggcgctcgcgacctcctcctcgagcatccgagcagcctcgaggccgagcaagaccccgagccgtgaggtcgcaaaacccggccgatcgcggaccacgatgggctccttcccgaagccccttgcggccgcgacgagggcgtccgtcgttgcctccgaagtcgcgccaccgacgacgacttcgatgagttggctcggcaagacggggttgaagaagtggagccccccgaaccgactcggatcctggacgctggaagcgagatcggcgacctggatcgaggacgtgttcgtcgcgaagatcgcatcgcgacgcgcgatcttcgatgcactgtggaggacctcgcgcttgagctcgacgacctccgggaccgactcgatcacgagatcggcagccacgaccgcatcgagacccgaacgagccgcaaccgcaccgaacgcgctccgctcggcgccatgagcgaccgcctggtcgaggagcctctcgacacgctcgaccgtctggcgagcagctgcgtcagagacctcgacgaccgtgacgtctcggcccgccacgaccgcctgggcggcgatgcccgaccccatggtgccgcccccgatcacgacgatcgtgcgaatggctggcggttgccctagaacaccgggatgatctcgtcccactcgacgtccgacacctcttcccccgtgatgcccacctccgggatcgccgggaacggaatcccgtagcgatcgagaacgcccttgacgttgagcatcgcctgccgccagttctcgcgcttctcatcgtagctcgcgatgccgagtccaccggagcgagcaacctcctcaatcacccgttggttgtcgatgaagtcggagggaagatcccagaagtcgtgcggcggttcgaacaaaacccccgagaggaacacgtaaccggcacggatctgcttcgtcacgatggcgcgatcttcgggcgcgatcttcgggtagtcgcgctccatgagcgcgaggcagatcgccatgtgacgaccctcgtcacgaccgatggcgcggaacgcctcacggaacactgggatacgcgtgtgcgtgtacatgtggtggaacagcgtcgaggaggccacctcccccatcaggaacgaactgaagagcaccgccatcgagtagcgcggtaccgccttttggtacccactccagtagcgcgctccgttgtgatagagccatgccacgttgcgcttggccaggcgcccgatctcggtcttcggctcgtagtcgagtggaccacctggggtgagccgactgatggcctcaccgcagacaatttcatggttctgctcgtcacgggtgatcgagaagaacgcacgccgcaccggatcttcctcgtggatctcgtaggcgtgaatgagcgccgtcgcgaacacgggtggtgcggaggcgtcgaagaccgacaggagcgagaaccagtacgcgatcgcctcgcgctcctcgtcgctcatgcgctcgggctggagcgtgtcccagggcagacgcgcaggatcccagtactctcgctgcgacgacgcccagatctcctcgagtttggccgtgtgacgttcccacgacaaggggaagatgttgggctgctcgatctcgggcggcatcgactgccgttcgtcggtcatggttccctccttgccaccgctggcaccgccatgctagcagatcttcgaccgaccggtcggtcggtcgtcggcctagactcacccttggtgtcgcaaaggagggaaggtggccaccatccgcctctacccgtcgggtcgtgaagtgccgtgcccagagggctcgacagtgctcgcggccctcgaggctgagggctgggccctcccgaacaactgccgcgccggcacctgcggtgagtgcaaggtcaaggtgcgccagggcgagttcgaccaaggtttcgtcctcgacatggcgctctccccggccgagcgagccgagggctacggcgccatgtgcatggccaagccgctgtccgacgtgctcgagatcgagtggggcacgatcgatgcacgtccgctcctcttcccaccccggcgcgacgttcccttcacgctcgtcgacgcgatcgagcgcacccccgccatcaccgaactcgtgctgcgacccgacgaggagccgctgcgttactggccgggccagtacgtgcacctcggcaaccccccggacgcgccgcggcgggcctactcgatcgccaacgccccgcgcgcggacggtgagctgcacttcttcgtcacgcgcgaacgcttcggccgcaccagcgcgtggctgctcgaccgtcggcccggcgacgagctccgcctcgatggaccctacggcgccttcatcggcgacccgtcgatcgccacgcccgtggtctgcctggcggccggctcgggactcgcaccgatcctcgcgctcaccgacgccgcgctccgtcgtgggttcgcccatccggtcacgctcgtgctctccgcacgcaccgaggccgacgtgtacccgcgtggcctgctcgcacacctcgagcggcgctatgggaacttccacttcgtgcgcaccttgacacgcgacgagggcccaccacctcgcggccgcatccctgccatcttggccgatctcgtcggcacgctcgccggggtcgcggtcttcatcgccggtccggaggccttcgtcgaggacacgcgccgggcatgtctcgcgctcggcgccgatccgtcgtcgctgtatcgagagccctacgtcccccaggacgacctcggttccttgtcggtccttgggccgtggtgagcacgtttggtaggctccggccatgactgtctcccaggcacgcatcgaggccatcggtcgtgagctcgcctccgtcgagggtgcgagcggtgtgttcggcatgcacggtctcgctggccggatcatggcccaagccctcgacgatcctggctttcgcgccaacctcttccaactcgtcgacgtgtttcctgccctcgccgacgccgacgacgtcgcagaccacgtccgcgattacctcgcagagcgtgcaccgatgtggatgcgcaccggacagcgcctcgccgaacgcgtcccttcgggccgctggctgctcgagcgcatcacccgcgagaacatcctccagatggcgaggcagttcatcgtggctgaagcgcccgacggcgtcgtcggcggcgtgggcgcgctcgccgccctcggctactcctcgaccgtggatctcctcggcgagaaggtgatcaccgccgaggagtcggcgcgctacctcgacaccatcggcgagatccacgaccacctcgtgcgcgcacgccccgtcctcgaagcccgcggaccgctcatcgggccgacggtctccatctcggtgaagccaagtgccctcagccctcgctggtcgccgctcgcccacgatctcgtcgtcgatgaggtcgtgagccgcctcgaaccgctcctcaagcgcgcccagaccgagggttcgctggtctttctcgacatggagcactacgacacctacgagacgacgctcgcggtcttccggcgcatcatcgccgacccagggctcgccgagctgcagatcgggatcgtcctccaggcctatctccgccgacacctcggcgagctcgagcgactgctcgccgagatcccgagcgccacgcacctgcgcgtctggatccgcctcgtcaagggcgcctactgggacaccgaggtctcccaagccgtcacggagagcgtcgagccgccggtcttcgtcgacaaggccgacaccgatcgcagctacgagcgctcggtggcgatgttgctcgacgccgccgatcgcgtccaccctgcgttcgcctcgcacaacctccgcagcctcgccgtcgtgctcgccgaggcagaggcgcgccgtctcgacccggaccgcttcgagatccagatgctctacggcatggccgaaccgctcgccaccgcggtacgccgctacggcgcagccgtgcgcatctacgctccggtcggctcgctcctgcccgggatgagctatctcgtgcgtcgcctcctcgagaacacctccaactcctcgttcgttcgccatcgcttcggcgatcgagaaggcctggacgagctgctcgctccgccgcgctcccgtccggccaccgtcgtgcccccgagcgtgccgcctggctatcgtcacaccccacagacgcagttccgtcacggcgacgtccgcgccgcccaacgagccacgctcgaagcgctcgccgcacagatcgcggcctcgccacgatcggtcccggctcgcctcggcgcagagcggctcctcggcacgcgcctcgcggggagtcgcaaccccgcccatcgggacgtggtcgtggcgcagtgggccgaccacgaccccaccatcgtcgaggctgcggtcgcaaccgcagagcgcgcggcccgggccctcggcgacctcggcctcgctgggcgcgccgccatctgcgaacgcgccgccgcctacctcgccgaccatcgacgcgagatcgtcgccaccgaagtcctcgaagcggccaagccgtgggtcgaggccgacaacgacgtgggcgaggcgatcgacttcttgcactactacgcccagatggcacggcgcctcgagcgggccgaccgcctcgactccccgccgggcgaacgcaaccgcctgcactatcgtccgcgcggcgtcaccgccgtcatcccgccgtggaactttccgctcgcgatcccgatgggcatgacggccgccgccctcgtgacgggcaacccgacgatcctgaagcccgccgaacagacgcctctcaccgccagcttcatcgccgatgccttcgaggctgcagggctgccgcccggagcgttggtcttcctccctggccgcggcgagaccatcggccaagccctcgtcgagcacccccaggtggcgaccatcgccttcaccggctccaaggccgtcggtctcgacatcgtggcgcgcgccgcaacgctgcgccccggtcagcgcgcgctgaagcgggtcatcgccgagctcggcggcaagaacgccatcatcgtcgatgccgatgcggatctcgaccaagcggttccgggcgtgctccagagcgcgttcggcttcgccggccagaagtgctcggccgcctcgcgggtcgtggtgcaccgacgcatccgtgacgcattcgtccagcgactgatcgaggccgccgcggagctccccatcggcgacccgcgctcctccgcgaccgtggtgcctcccgtgatcgacgatgaggcccaagcgcgcatccgcggcgtcatcgccgacgccgcggatgcggcgacgctcgcgtggcaggcaccgtcgaccccgagcgagggcagctacgtgccaccgaccatcttcgtcgatcccgaccaccgcgcgccgctctggagggacgagatcttcggtcccgtcctcgtcgtcgacaccgccgacgacctcgccgacgccatcgaccgcgcgaacgataccgactacgccctcacgcagggtgtctactcccgctcgccgagctccatccggcgcgtcgtcgaccacgctcgcgccggcaacgtctacgtcaaccgcccgatcaccggcgccatcccgggccgccatcccttcggcggcttcggacactcgggggtcggtttcaaggccggtggtccgagctatctgctccagttcctcgatcagcaggtggtgtcggagaacctgatccgccagggcttcagccccgacatcgcctgagggacgacccagcgcaccaatcgtcgcggtcgatcccgggggcggccggcacgggaagcttccagcggcacgagtggttgcattgtgcaactagcctgtgagcacgccccgctgcgtacgacgagaggaatgaccgtggccacgaagacccgtcagtggagcgagctcctccacaaccgagacgtggccatcatcttcatcgcacggctcgcgatgagcacgtcgcgcgcgatcgccggcatcgccgtgccgctctatctcgtcgcactcggcttcagcggcctcaaactcggtgttctctacctcgcggtcgcgctgtttgcggccatcctctcgcaagtcatcggcctgtccaccaatcgcgtcggcgccaaggtctggatgatcgtcgttcccgccatcaccgtgctggccgccgtggcctacgccgagagccacacgacctggatcttgttcgccttcgccgccgcaggatcgttcggccggggggcgggtgccggggccggcatggtcgggccctaccagccggccgaatccaagctcctcattcgcgcggtgacgccgaccgagcgcaaccgcgccttctccttcgtctccatcgcctccaccgcgggcgccctcgtcggcaccgcgctggcggcgctcctcggccacgcgcacgtcgtcgacagcgccgccaccgctctgtttcgaccatcgatgctggtcgcagcggccttcgccgccatcgcggcgatcgtcgcgctctggatccatgaacccgccacaccggtcgcgaccgaccagccacggcccaagctcttcaccttcccgcgtcgttccgcgtggctcctctggcggctctgggcaaccaacacactgaacggcctcgccgtcgggatgttcggaaccttcgtgacctactggctccatcgtcgctacggagcgagccaagtgacgatcggcgagctctacctcgtcatcaacatcatcacgctggcctccggactcgtcgcccccaggatcgctgcccggttcggcacggtacgcgcgaccgcgatcttgcgtgtcgcccagggactcctcctcgtgccgatggcgctcgcacccaccctggtgatcgcgggagccatctacctcgtccgcatgttcgcccagcgcatcgcccttccgctacgccagtcctacgcgctcgccatggccgaccccgaggagcagagccaggtcgccgcgctctcgaatctgccgagccagctcgcgatggccgccgccccgacactgacgggatacctcttcgacgaggtcagcctgtcgctgccgttcgtcatcggcggcctcatccagaccctgagcgcactcgtgttctgggcgttcttccgcaacctccatccacccgaagagcgccatgcggcgcgcacgagctcgctcccagggatgcacgatggtcctcccatgacctccacagctccgtgacgtagcgttggtcgcacccactcccccacccaccaaccaaggcccgcctctggcgggccttggttgtctgtgccgcgcattgtcgacggcgctcgttgcgtgaggccagcgtgaccaccgatcgtgacttgggcccgcgagccgtcaccatcgatggtggaccagcgccaagcgggtggtgggaggtcaccaactgttcaccatcggagcaccgaacgttctccagcgtgcgactgtcgcgtcaccttggcttcgtagcgtcctcgacgtcggatgacaacccagtcgaaagggacacgatgacacgaagcaagctcacgacgccccggctcttcgccggcgtcgctgcggccagcgccctgctcgccgcctgcggaagcgcgacgaccgcgtcgaccacctccgcccagacctcatcgcccgcctgctgggcaaccgcgaccacgattcaagcgtgcggcggcatgaacgccctcatcaaggccgcccgcgccgaagggcacctgaacgcgatcgccctgccgtcgaactgggccaactacggctcgatcatcgccgccttcgagaagcgctacggcatcaccgtgaacgtcgccaatcccgaaggatcgagcggcgaggagctcgcggcgctgaagacggagaaggggaccgcgaaggagcccgacgtcgtcgatgtcggattgtcgttcgccctccagggccaacaggagcatctcttcgcacccttcaaggtgcccacctggtccgagatcccggccaatcagaaggcagcgaacggcgactggttcgaggactacggcggcctgatcgcggttggctacaacgcaggtgccgtccctcgcccgacctcgctcgcctcgctcacgcagcctgcctacaagggcagcgtctgcctcgacggcaaccctgagagcgcaggcgccgccttctcgggcgtcttcgctgcggccctcgcgaacgggggctcctatgccaacatcgcaccgggcatcgcgtacttccagcgtctgcaccaagccggcaccttcgtgcccaccggcgccaccgccgccagcatcgaggccggccagtgccgcgtgaccctcgactggacctacctccaggcgcagtacgccagccagctggccggcaaggtcacctggaagtcgttcatcccctcgaacgcccacgtcgctgcctactacgtgcaggcgatctcggccaacgcgcccgatccagcggcagcgcgcctgtgggagacctacctctactctcccgctggccagaacggctggctcgagggctatgcctacccggtcgagctcaaggccatgatcgccaacggcacggtcaaccgcgcagcgctcgccaagctgccgccgctcccctcgaatcttgcgttcccaacggcgagcgaactcgcctcggccgcaaagacggtggtcgccgagtggccaacggtctagcggtcgcctccaccaccacccgagcagcgtcccccaccgctgctcgggtggcccgcctgacaccgctcgtcggcctcgtgccgatgatcgcctacctggccatcttcctcgtcgtgcccgctgccggcgtgctcgaaggcgccttcacgggcgcgcacggcgtgagcctggcggcgctcaagggggctaccagcggcgcctttctccacgcgctcgtcgtgagcgtcgaactctccgccaccgcgtccgtggtggccgcggtcctcggcaccgcagccgcggcggccatcgtctcgctcggctccgagcgcctcaaccgcatcaccgcctccgtcgctgcggtcctcgccaacaccggcggggtcccgctcgcgttcgcgttcgtggcgaccctcgggaacttcggggtcgtcacgctggcgctcgcccacctcggcttcgacccgtacgcgcatggcttcacgctctactcggtgacggggctcgtgatcgtctatcagtacttcctcctccccctcatggtgctgatcatggtccccgccattcgagggttgcggcgtgagtggtcggaggccacctggaccctcggcggacgtccgtcccacttctggcgccacgtcgcggccccgctgctggccccgaccgtcctcgccggcctcctcgtcctctttgccgacgcgttcgcggcctacgccaccgccgccgccctcgcaggcggcgtcatcccgctcatcccgctcgagatcggcaacctcatcgacgggaacgtcgtcgcgaaccaggccaacgtcggtgacgccctcggcctcgagatgatcgtgctcgtcgcgctggtctcggtggtctacgcgctcgcccaacgtcgccaaaccaggtgggcccggtgagccgcgcacgcctgctcgcgcttgccgtggtcgtgctggtcgcggcctacgtcctcgtgccactcgtcgcatcagggcgcttcagcctggacggaccccacggaaccctgaccatgtccgcgtacgcagccatcgtccgcaccggcgcattctggagctcgctctggctctccgtacgcgtgggcgtcgcgacggcgatcctcgagctgatcctcgtcacctggacctcgctctgggtgcgcctccgcgccccgcgcctcgccccgctcgtcgacacgctcgtgctgatcccgatcatggtgccggtcgtggtcatcgtgctcggtgtcacctcgtcgctgcggttcctgccgtcgctcatcaccgggaccccggcgatcctcgtcgccgagtacgtggtcctcgcgatgccctacagctaccgcatcgtcgatgcgggcgtcgccgccctcgacctgcgcaccctcaccgaggcggctggctccctcggagcgcgctggagcgcgacgatgcggctcgtcctcgtccccagccttcgagggcccctgctcgccgccgccgccatggcctttgctctctcgctcggggagtacgtcatggcgagtctgctctcgttcacgaccttccccgtgtggctccagaccatcggagccacccaagcaaccgaggcggtcgcggtgtcgacgctcgcgctggtcggcaccgtcgtcctgctcgcggtcgtcgtcgtcgccgctggccgcgagcgaacccgagtcgcggatcgacaagcctgaggagcgccatggacgttctcgaacccgttaccgacacccgcacgaccgtcgcgcgatcacacggcgtcgaggtacgcctcgagggcctcgtgcgcgcgttcggtccgacacgggcgctcgacgacgtctcgatcaccgtcaaccccggcgaactcgtcgccctcctcggcccgtcgggaagcgggaagaccaccgcactcagagtcctcgccggcctcgagcgccccgaccaggggagggtcgtcatcgacggcgaggacgtcactcgcgtgagcgcccatcgacgcggcatcggcatggtgttccaggcctacagcctcttccccaccatgaccgccctcgagaacgtcgccttcggcctccgcctccgcaggatgcgtcgccccgcccgcacggctcgcgcacacgagctcctcgagctcgtcgggctcggccaactcgccgatcgtcgaccccaccagctctcggggggtcaagcccaacgggtcgcgctcgctcgcgcactcgcgatcgagccccgcgtcctgctcctcgacgaaccgctgagcgcgctcgatgccgccgtgcgtgtgcgcctgcgcgaggagatccgtcgcattcagctcgaactcggcaccacgaccgtcttcgtcacgcacgaccaagaggaagccctcagcatcgccgaccgagtcgcggtgctgagggcgggccgactcgagcagctcgacaccccgacacagatctaccatcggccggcgacgcccttcgtcgcgtccttcatcggccgagccaatcgcatcccggcccagatgaccgagaacgggcggctcctcgtgctcggacacgagatcgacgcgcctaccgccgacctcgcccccggcacccggcacgtcgcactcatgcggcccgaatcgctcaccatcacacccgcaccggacggtacgggccgcatcctcggcctcgtgttccgaggtgcaagcaccgacgtcaccgtggcgtggccgacgctgcccgatccgctcgtcgtgaccctcgctggcgagccaaccgccgacctcgcccccggcgcccgcgtcgaggtcgtcccccgcggcacggtgctcttcgtcgagcgtgccgaggagcgtccatgacgaccgatcgcaccatcgcgacgacgggccccgagcccttcgtgacgactgctccggcgcccggtgagccgcaccgtcgcctcggcgagcgtggctccctccacgagcacgccaacggcgcaccgatcgttctcggcaccctctggcacctcaccgacctccacgtcaccgacccttcgagcccgatccgcgcgccattcctcaaccacctcggcgaaccgaacggtccgctgcgtacgcgcatcggccgcgtcggcacctatcgaccccacgaggcggcgagtgcccacgtcctcgccgcgatggtccgccaactcggatccatcacccgtgcgcccgtgttcggtggtgccgtcgacctcgtcgtcgcgagcggcgacctcgccgacaatgcccaggccaacgaggttgcagcggcgagcgcgctcctcagcggccgtgaggggacgcttagggctccgggcctcgccgatcccttcgaagggccgggcgggctcgacgacgatccgcactactggcacccagagggtgagcccttcgacgagtggcgcacgaggcgcggctttccgcagatcgaagggtggtggtcggcactggcggcgcccatcccgctcgccacgcacgatctgccggtcctcttcgtcgccggcaaccacgacctcctcctccaaggcaccgtcccagcatcgccccgccttgcccgagccgcgatgggggggctcgcacccactggcgtcgcagccgacctcgatctcgcgcacgccctcgccgaccacgagcggacggcaccggacccctggcgactcgtggtcggggctccacaccgttgcgtcgctccgctcgccgagcgcgcaccactcgccgccatcacgaacgactaccccttgcctcgcaggatcgacgtcggcgcgctccgtctgctggtactcgacacgaccaacccgtggggtggctggcaaggctcgctcgacgcggcgtcggttcgctggctcgtcgacgaactcgacagcgcccacgaacgacggctcgacgacgaaggccgctgggtacccgcaggaggctccgacgtcgcggtcgtgctcgtcacgcatcatccgatcgagactctggtcaacacgaccgtcccagaggaggagcggccacgagtcggcggatcgtccctcgctgcgctgctggatcactacccgaacgtcatcgcctggctggccgggcacacccaccgacaccgggtacggtgggtgcgatcgaggctcggcccctacgggatgctccacgtgacgacggcgtcactcatcgactggccccagcaaggcaggatcatcgaggtggccttcgaccctcgagcgcagcgcctcgtcgtcgcgacgacggtcgtcgaccacgctggtgccgtcggcataccagtgtcgacaccggcttcgatcaccgagatcgccgggatcgcccgcatgctcgccgcgaacgaccccgagcgcctcggagagcgcgaaccaccaggacgcggtaccccgaacgaccgtaacgccatctggacactcccgatccctccagggctcgcgcgccagctcgcgcgtcgcggcgacggatggaccgcgttcgccccggccacaccgagcatgccgccagcggctccctaactgccgagatctgcgaggctcgcccggagcgcgctacggagggtcgcgacgaagcgctcgtcgacggctcgagcctcctgccacaaccgatcgagtgtcgccggctcgagactcgagcgccgtcgctcgatcgccacgaggcgggtgtggagctcttcgtgcacctggcggaggagcgagcgcgcaccctcgtcaccgatcagtcgcttagcatcgctagccaaccaccgacccaggtggcagtcgtcgaggctcgcggccatccacgtcgcgccctcgtcgtcgcgctcgtcgacgacggcggcctcgaggcgacccatcagcgcgtggtggacgctgagcagcggaccgagcccagcgcgctggaagagcgggtcctctgctcgcgggcggtcgtgccaccgtgacccctcgaggtcgagccatcgggcaacggcctcggccggcatcggcctggcgagatggaagccctggagactcacctcgccgagggagcgtgccacgcgctcgaggtacgcatcctcgacgccctcgatgacgatccgacgaccgaggaacagggcggcttgcacgctggagacgacgatgccgaagtccgccgcggacgtcagcatgccgcgcacgaagctctggtcgatcttgaccgtctgcgcaggcagctcccgcaggtaccggagcgaggcatggccgaccccgaagtcgtcgatggcgatggtgagtccgagttcggcgatcgcctcgaggacgtcgtcgactgcacgggtgtcgccgagtgccgccgtctcggtgatctcgagttcgacgagcctcgtcggcaccggaccaaggcgctcgagcgcgctcgccacatcgtcgacgaagcgaggatcgagcaggtgctgcggcgagatgttcaccgagaccccgaaggtgaacccggactcgtgccacgtggcgagctgcgcgagggcctcctcgagcacccaccgaccgacacgacgcgccagcgccggatgatcgagcgccgctccgaagaccgccggcccgatacgtccacggtcggggtcgtcgatacggatgagcgcctccatcgcctccaccgccccatcggcgctcacgatgggctggtagtcgagtgagacccgtccgcgctcgagcgcgacgaccaccatggtgcgggcctcgtcggcacgccgagccgccacctccatcgccggaacgaacaccgaagctcgatcaccaccgtgggccttcgcgtcgtagagcgcgagctctgcatgacgcaccagcccctcgaccgtagcccggtcggctgggaagctcgtgatcccgacgctcccgctcagctggggcaccccgagacgatcccagtcgaggtcacggatcgcaccgatccagcgctccgcctccgccgcgagcgatgcccgacccgatcgccccggcagcaccagcgcgaactcgtcgccacccatccgcacgacgaggtcaccctcgcgcgcgacccctgcgagcgcgtgcgccaccactcgcaggacccgatcgcccgtctcgtgtccgacgaggtcgttcacctccttgaagcgatcgagatcgagcaaggcgaccgcaaccgggtcctcggtggatcgcgatgaccgacacagcgtctcgaggcgaggcgtcagcacgctgcggttcgcgagtccggtgagcagatctcgctcggcgacgtgcagcaagttcaacgcgagtacacctgcctcttggagcggttcgaagtagtcgagtccgacgcggcgcgcaaagcccgacgccgtgaccacgacaccgagaccgcgggccggacccgccgcaaaggggacgagcaccacctcgccgaacggaaggttccggacgctgtcccagcgcggtacgaggcgatcgcccacgtcgagcacgatcggctcagacgaccggcgcccctcgagcaccgactcgaggggcgcgtcgacgacggtcgtcggtagctcgcgtcgtagtgccgcagcgagcccccctcccgcggcagccagcgtccagtgcccgctcgccggatcacgcagcacataggccacgagcacgatctccctcgagcgctcagacacgagtcgacacaacgtttcgagcatcgcaccgaccagcgaattcgtctggtcgatcgcattcgcgctcccgacacgagccgcggcctccacgagcgcgtcgaagacggccacacgatctcgaaccgtcgccttggccgcgcgcgcgaagccctcgagctggagcatcagatcggcgatgacgatgcgtgccaacgcgtcgaggagggggacgcgatcggcgatgggcacctggtgttcgacgagcgtgccccagtgctgccagtagacgacgtagccggcggccaaccacgccggatcgacgtgccacgtgaagtgtcgtcggcccagctcctcggtgcctcggcgccaggcctcatcgaagcgacgatcgagaagctgggtcgcgtgttgggcctggaggtcgatgagacgctggatggtcggcaccgagaagcccgcgaagaccgcacgggtctcgggatgcgcgagcacgaggtcgtagaaagccgcagcgagtgccggagcctcggacgccaacagatcacggtagcgctcgacgagcctccaatcctcctcaccgagatcgatgagctcggtgagggtcgtgcgtcgtcgggtgtcggcgatgaaccgcctccgcgggatccgacggtcgccgagaccgccgaccacccaggcaccgtacgaacgtcgctctggcatgtaccacacctgcccgcgccgaaatccccacagcgcactcacgtgctgggggcatcgaccacctcgcggtcacccgtaccgttggcacgccccgcgccgcacgcggacgccacgcacacctcgtgctggagcctaccatgaacgtcgacgaaggctcggagacaccaccgcgcccagcgggagctgcacaatcctcggacgagcctcgtcgcaggccatggccgcaaccgacggacccgccccagcacaaccacgacggacgagaggacgggctcagcccggaacccgcagaaccgaccttcggtcgcacgccgacgacgtggcatcacgtcgcccaccgtgggccgccggggtctcgaaccccgcaccttgggattaaaagtcccctgctctaccggatgagctagcggcccatggccatcagcctacctgcgcagttgccgtgcgccaggaaccacgagcaccgcgagcgcgactcgagccctccgccaccgggccgacacgcatcgccgagatctcgaagggccgtcgcgttctcgacgtgcgagctagaatcccgtcggctcggacagaaggaacgacaccatgggcacgacgagaggacgcacgacgaccgtgcggccgagaggtaccacgatgcggatcgccgctctggcggcgaccgccgcggcgatgctcgctggctgtggtgccacgacggccacgtccacgacgtcgacggccgcatcctcgagccccaagccgcagcccatcgcggcgacgcacctccccgacccctgttcgctggtgacgaccagcgaagcgagtgcggctctccaggtgccccttcgccagacacaggacgaatccacggcgggataccgcagctgcgactgggtcaacacgacgagcagcctgagcgcgggtcgcggctcgacgatgaacctctacttctatccgggcccgacgatctcgcaggccagcgactaccgcgccctggaggcgcaagggcacttcgcccctaccgagatcgacggctatccggccatcgtggcgggcgccgagtacgaggtcgacctcggcagcgtgctcgtcaccggtgtcgcgttctcgacggtgtcgccgcaggcatcgagcggcgccgaacgcaccaccatcgcgacggcgatccgacgcctctgcacactcgtccgctgcgtggcctgagcgcgtctaggagccctctgaacaagcccctccctggtggtggctgagcacgcccacccagcccgggaacgagcccagctgacccgttcccatctcgctcctcaccctctcctcctcgcccctcctgtggggcgaggaggagaggacccgagcgcctctcaggtggcaagcacccagccaccacccacccgggtgagccccaggcgaaggagcaccttcaggttccaggtggcacagagcagctcgaagtggagtcggttgcgcacgagccccaggtagcgcagcctcgcgccggagagcttgcgtttgagctgtgcgtggatccgctcgacgttcggtcgggtgcgctgatagtcgagacgaacggcagggtccccaaagtgcgcccgctggctgattgcgtgccaggtggcaggggtgaaggtgaggacccgtcctcgcttcgagcgcgtgcagcgatcccggagcggacagccggtgcagtgcttgacaaaggaagcacgacccttggcggagatgggtactcggtgtccttggggacagctgacccatccctcctcgacgacgaagtcatcgatggtaaagccaccagggaccgccatggcaaggggccgaggcttgatcacctcgtcgtggccacgagcggcgagctcgttggagacctcgctcgtggcataggcgctgtcgccatagaccgtgcgcgggccgtcctcgtcacgaaggagctcgctcgccactgctgcgtccggcacggtgcccttcgtgatggtcgcagcggtgacgatgccactgtctggctcgacggccacgtggcccttgtagccatcgatggcacgggcacgggacttgtggacgtggcgagcgtcagggtccacggtggagatgaccctgtctgtggctacccgcctcgcgatgcgccagcgaccttccttggcatcgacacactccacgtcttggcccgccacgagcccaaggagaccaagggcttcggtctgtggctcggtgagggatgcgagcttatctgcatgggcgaggtgggcagtggcatcggcgacgagggcactcaccgtgcgcaccactgcctcttcgtcccgatagtcgatggcaggctttgcgcgggtgtagtcgatcgctggtgacagaggaatgtcgcgtagttcggggatcagcctgcgtacccggttgatctgggcgacaagttgggtcatggtgtcttgggtggcaaccgcatcggcgagcacggtggagtcgacgacgcgcttcgtcttgcccttgagcacccccgtggcaccgatcacctcggccacgagctcgccgatgagtcttggggtctcggaggtggcgatgcgcctgcgccagtaggtgagcaccgtggggtgaaagcctgggtcctcgagatcaagaccaagggcgtacttccagcggaggttgtagcggacctgctctgtcgcctcggtgtccgagagcccctcgagcacctggagcaccatgaccgcgagcaccctcgaggcggggatggagggtctgccggtcgtggaggggtagagatggcggaagcgctcgtcggggaagagctctctgcggtgctcggcgaggaaggcgtagatggaccctggctcgatgagcgaggagcagaaggcctccgtcgcggtgaggtgtgcctggtctgattcggtgcccagcatgcaaaaagtctagctgagctgggcaaatggcgcttgacaggcggagggaagcgcttcccgtagccgccctacgtggaggagttgttcaggggactcctagcagtcgcactgtcgatgtgttgatctgcttgtcgtcaacctcgagcgtccggccttcgacagcgagccctaagggcgttggcttcaggccgtagctcgacttcaccgacgcgagcgctagaacgtcgccgtgggagccgagaagaagcacggatcgggcggcggcggggaaggccctggagccgagcagacggtccagcggtgcggccccactcgccttggtcaagtgaccgatcccgacgatggttgccccggcgtcacaggcgatgctacgcaaccggccgagcaccgcccgaacgtccgcgtcacggtgcgtgtcaaccctcccaccgagcgcacccgacagcggctcgacgatgaccaagcgagcatgattgtcgagcactgtccgccgcagcctctcgaaatcggcagggaaactgacggggactgtcgtgaagccgagcatgcgcggatcgccgcccgccgccaggtaccggggccccagcacactcgtcgcgttatcttcgctggaagcgtcgagcgtgacggcgggctggccgaacagggcacccggcagttccccgcgacacagccgggccgccagctgcagcagagcctgttgcatgaacctccgcggcgatctgcaaactccctggtagcacgcgtgtgagatccaccatctcaacaggctcgatggcgaggattgggcccgtggcctacaacctgctcacctcagagcgccaccagctttacctgttgccggcgtcgatggcggactggctgcctgaggaccatttggcgtggttcgtgctggacgctttggaggagatggaccttttcgccttctacgccgattaccgagccgatggctggggcggcgcagcgcacgatacggccacgatggagacgctgttgctctacgcctactgcgtcggggtccgctcgtcgcgccaggtcgagcgtgcgtgccacgtcgacgtcgccttccgggtgatctgcgccgggctactcctcgaccacacgacgatcgcccggttctgccatcgtcacgaagaggccttggagacgatcttcaccgcctcgcttcgtctgtgtgcgaaggcagggatggcctgggtcggcctcgtggcgctcgatcggacgacgatggccgctctcgcatccctgcagcgcaacgtgatcaaggacacgatcgacgaggccgtcgagaagatgttcgccgaggcgaaggacatcgacgaagccgaagacgccacttttggcgaggcccgcggcgacgagccccctgccgttcttcgtggacgccgggaccggcgctgacgcttcaaggcggccaaggaggtcctcgacaaagaactggcagccgagcgcacggcccacgaggcccatctggccaagcgggtggacgaggaggaacgacggggcaagaagctgcggggccgaaagcccaagacgccgaaggacaaggccggcgcgaaggaggagaaggtcaacacgaccgacccgcagtccaaggtcatgtcgacgaagaacggcttcctccagggcttcaacgcgtaggcggtcgccaacaaagaccaggtcatcctcgcagcctcggtcaccgacgagcagaacgacaaggccccactccacccgatgatcgaggcgatcagcgagtcgctcgacaaggcagggatcgatgagcggcccggaaagctcctcgcggatgccagctacgcgtcggaggagaacttcgccgcccttgggccagacgaccccgacagctacgtggccgttcgcaacatgaggaagaacccaacccggcgcaccggccggcgcggaccgctcaggaggaacgcgaccttcctcgacaagatggaccccaaggtgtcgaacaactcggggcgggacctctacaagcgacgccaggcgatcatcgagccgatcttcggccagatcaaagacgtccgcaagattcgctcgttcatgcggaagggcaagtccgcagcggactcggagtaaaagctcatctgcggcacccacaacctcttgaagctctcccggcgcgcccttgccacgccgggcaccgtgccattcagccggctggcgatgacgacagccagatgaaggccaagtagcaagagctcagcggccctccgtggccatcattcccgcgttcaccaacgatcagccgtccctgccgtcgccctggtggaacctgccgaggcggagcccgccgagaggagcagagttcacgcaacagcctcatctgcccccaataggccgtttcagaaccctatgatgcgtgtcatgccttccaacaccatcacaagacgccgtgcgggggcgagccccggcggtttgcgccgtctcgtctccctccaacagcgtgttaccggcagccgccaggctgccgcggtccgcaaccagctggtcgccgagcttcacgcccaaggggtgcccacacgggtgctcgccgaacagttagggatgagcgtgccgggcgtgcagcgcatcatccacctccacacccgcgccggcggctaacctgcagcgtcggtgagcgaaaggttaccgcctgcccccccgcatggggggaacctccctgaccaagcagccccccgccgtaatggcggggggcctttccgcgtcaacagcagctcaacggcggctcaggcgtaacaccaggaacgtgacaccgaggatcacgtcgaccgccacccacaaagcgatcacgatccctgccccgatcgtcgtgcccacatcggcggcagcctggcaggtttgggtggtgagcgtcccgcagtgggtggcgtgcgaccccgagtggattcccaccaccaagcacacgatgaagatggcttagacggcgaggaacacccagcggaagattcgccgtcgccggcgcggggttgtcggcgtctcagactgttgcatcggtttgcctccccctccttcaccgggagcgtggcccccgcagcggtcactatagccccgcgacgctggcagcgcccgcatcgaggtaggatcggccctccatcgccaagcgcaaacgacgactggctctaccggtggttgcgacactccgaccatgatggtcggtggacaggtagcaaccaccggtggtgggttttagcatgccaggtcgacgcctcgggttggaagagtgggaggagatccgggtcgggttggtgcgaggcgagtcgctgcgggtgatcgcccggcggctcgggcggccggtgtcgacgatcgctcgcgcagtggaccgcaacggcggttggatacgctatgtggcggcttgtgcgcagcgtcgagcgaaacgctgtgctcgtcggcccaagccaccgcggctggtggaagacgctgcgctggctcggcgtgtcactcggcgcttggtggaggaccaggagtcgccgatgacgatcgctcgagccaaggacgtaagtcatgagacgatctaccaggcgagctacccaggagaccgcgggctcgatccagggctgtggcgtcatctgcaccaccagcgccgccctcgctggcggtgaggcttccctggggagcaaagacgcttcgtgctgggccagttccagccgatccaccagcgcccagcggccgccgctcgccgcacgcagatcgggcatctcgaaggtgacctgatcatcggcgcgaaaaacgcctcgccggtcgtcacgatcatcgaccgcaccacacgcttctgcctgcttggggcattgcccgacggctacgacgcagcatctttggcgtcgtgtgtcatacggctgctgcgctcgatccctgaggcaggccagcgcaccctcacttgggatcagggccgagagatgacgctgtgagcggacatcgaacatgttctcggcacccccctctacttcgctgatccccacgccccctggcagcgtcccgtcaacgagaacttcaacggcctcgtgcgccgctggctggcgaagagcaccgacctgtccatctactcccaagccgacgtcgacgccatcgcccgccgcatcaaccacatgccacgccgctccctcaactagggccacgcccatcgccactactacgatgccctcgtcgcgatgaccgattgaaccggccctgcgttggagcgaacgcttcactctcggataaatagatcatcaaccgaactcgctactttgtactgtgccgggttctcgcgatccttgagcgcctcgaaatgcgccttgccgcagtcaatcttcgccttttccttgccacgcaagtcgtcggcgaccacactgcccttggtctcaacgacaaagtaaaagtagaggcgctcctcgccttcctgctcgacgaccaccgcccagtcagggttgtatccgcccagcggcgtcggcacggtgaaccagcccgggagttttgcgtagaccttgatatcacggttgtactcgagctgctgggcaaacgttagctcggtgtcggagtcgtagaccacctgctcatagaccgacttcttggcctcgaagagattcttcaggtagccggtcagctcctcactttcgaacagctcccgcgcgtagtagtgctcgtcacccaggcgctggtatttgatgccatcaaccatcgccttccgcttgcagcggttaatagtctctgccgccagctcgatgaaccgctggggattgcgcttgaagtcggccagacgcctactttccgtcaggacgcggtaaatcgtgcggcgcgtgagttgggtccggtcttgaagctcggtaagcaggtccggcagatcgatgtccgtttcctcgagccctacgggcgccccacgctcgcgctcggcggctaccacgccggccttgccgatggcgatatccgcctttcgccactggaggctcaccttcgggatcgccggcatttctttgagcgctttgatgcacgcctccacgagcgcttcgttgtcgaatttcacccggtatgtggttttgtccttgatgcggtcccacagcgccttgaactcatcactgatatggacctccccgcgaacacgcacctgccgacgctcgtcggcgttcttgatctcaagccgcccggccgccttcttgaggacatccgtgatttggtcacgctgcgcggcgaactcctcgggcacttccacggtgccgtccctgagtgcccttctgagtgaatcctgcacccgtcctttggcgtcgatgtagccataggccttgaaggactcccacaacgccttcgaccgttcgatgccgagcggcgaggctttgccattcgcatcggtgaccacgatgtgagcgaactggtccgcctcgacaatgccgaaccggatgccggtatcctcctcgatttccttctgcaagttctcggcgaagtcctcgtagctctccgtagcgatcacggtcagtgtattgacatcgaagccccgcacacgctcgccgtactgattcacgcacaaacgcaagccgcgcccgatggtttgccgccgttcgcgctccgtacggatgtctcgcagggtgcagatttgaaagacgttggggttgtcccagccttcgcgcagcgccgagtgcgagaaaataaacttgatcggcgtctcgagggagaggagcttttccttgtccttcatgatgaggttgtaggcccgctcggcgttgtcgcggcccgcctcgttgttctcggcagtatccgtccagccgcctttcttgtcgatggaaaagtagccgttgtgaaccttctcggcttcgcggctcacatccacccctttgaagagcggttcatactctggcaggttggcagctcgtcggtactcttcctcgaagatgcgggcgtaatcacctttcacggggttcccggccgcgtcatactggcgatacttggcgacttcgtcgataaaaaagagcgacagcaccttgatgccctttggtagcaggcgcatctccttgtccaggtgctcgcgaatggttcggcgaatcagctggcgctgaacggccagcatgtccacgtctccccaggcctgccccggcttgaggaagtgctcgccgccggggacgcgcagctccatgtactcatttcccttttcgacccggatttcgccgatacggtagccggcgtagatcgcgcggccggcgatctcttccaggtcgtcgccgtcctgaaccttcacctcccgccgcttgaccccaccgctgtcggtcttcacgtccagctcgaccttcgctgaaatgatgccgcgcttgttcgacaccgaaaccaggcgcacgtagggcttgttgtgggcatgttcgaccgtggccgaggccacctcgatctgcttgaccagccgcttctcgtaggcgtccacagcgtccagccggtagaccatgtggtgcttatccacgtgggtggccgagtaacgcagggtgcaaagcggattcatggcgtcgagcgcttccttgccgcgcccctgaaggccgccgtccacgctctgaggctcatcgacgatcacaatgggccgggtggccttgatcaggtcgatgggcttttcaccgcctgtcttctcgctttccttgtagaggttgttgacgtctttcttgttgatggccccgacggtcatcaccatgatctggatgttcgcgctggtggcgaagttgcgcacctgcccgagtttggaggagtcgtagaggaaatagtcgaaaggcacgccggagtacaggctcttgaaatggtcttcggtgatctgaagcgtcttgtacacaccctccttgatggcaatcgacggcaccacgatgacgaacttggtaaagccgtagcgtttgttcagctcgaaaatggtgcgcagatacacataggtcttgccggtgccggtctccatctccacagtgaagtcacctgatgcgagtgattccgagggcggcaggccgttgcggagttggatgtcgttcaggttcttgagcagctcgtcgtcgagcaacatcagacggttgccgatgccaagctcgttctgcgcaacgccgaggcgcatctgggtgtccgcgggatcgcgcgtgaccgtgaactcggtgcggcagatctcctgcccgcggaacagatcgcacacagcctctatggcctgccactggtagtcgaggttcggttcaaagtgcagtttcatcacaagctccgcacgttagcgatgccgttctggttgaggatggcggcgaggttcgtcttggcctcgtcgtcggcaaaggcgctgtcccggaagacgcaggtggtctcgcccgccggggcgagttccttgcgccacccgacgatgccctggccaagcgcctccacgtcgtcgaccgcaatctcctcggacaggcaagcgatcagcacgccatagcctacggcataaaccgtgtatttcttcccttctgtcccctgactcttgacttctttctcctgtatcggcacgcacagatcgaggccaagcttgagcagcagttcgtaaaggatgtccgcctcgctgcggccttcgacaatgtgatcctggtgcgcaaacagctccgcctcaaggtcatcaggcttggggttccaggcgcggatgttggatgtgtccagcttgaacacgcgaaaaccgaggtcgcccgcaaactgcgggttctcatcctggatcttcctggcggcacggcggagacgttccttggtcagctcagcgatgttgcgcggctttccgagcttgtcgcagaagtctgcggcgaccttctgttccttgttctctgggtcgacaggctccgggagttggacaaggatatagcgacggttgccgccgtcggcggcgttctgtgccatgaccgcatggccggtggttccggagccggcgaagaaatccaggacaagttctttctccttcaccccagctgctgatgccaagtactcgattaacccccgcggctttggattgttgaagaccgttgcctcgaaaagttgctgaagctcttcagaccccttttcgttgtagcacgtattatcgtcaagaaggtcgttcagtaactttgcttgatctagctcctcagggagcattgttcgacggagccctaagttgcgcgttacaaagagcgtcctatcaagggtttcttgattgattctccacggacccctgatgcgcacatccctcgcgactctcccatccgtaaccttaaggtcgtcaagcaattcaaacgagaggctgcgggccgcgtaggtgcccgcattgtacgttccatcgccacacttggcaatagcaccggaacgtagcactcgcacgcttactgtgttgccttcgttgaacacggggcgtgtcccatcggatacttgacccgcactaagtggggcggcggcatctgagcgaacgtatgcgacaacgtaatcgcacatgtcggtcattcgcttcctcaggaaagcggtcttccttgccgcgcgacgcttgataacgccgcagaagttttccgcaccgaacacttcgtcacacagagtgcggaggtgtccgatttccccatcgtcaatgctgataaagagcactccatcttcccgcaataggttcctcgccagcttcagcctcggatacatcatgttcaaccagtcggtatgaaaccgcccgctggcttcggtgttgctgctgatcttccgcccgccctccacctgccccgtcagctcgaggtagttcttgatgctgtcctggaagttgtccggatacacgaagtccttccccgtgttgtacggcgggtcgatgtagatgagcttcaccttgcccgcgtagctcttttgcaggagcttgagcacttcgaggttgtcgccttcaatcacgaggttctgcgtggtgtcccagtccacgctgtcttcgggcgccgggcgcagcgtcccggtcgagggcgtgagcgcgagctgtcgagcctggcgtttgccgtgccagttgaggccgtacttttcatcgcagtcggtgacggtggcatcacccacgagctgcttgagcacgtcaacgttgaccgccgcgccgttgggtccctcggtgatgagctcagggaacaacgccttgagcttggcgacgttctccgccaccaggtcgtcggaacgggcttcggggtcggcgggcgtcagtttcttcattgtctcctcctttatagtctttcgcgagcggccgcgcgggccgcttcggcgcgcttgagttccaggttcagttccacccgccgggacatctgtttctccctggcggcagcagtgcccaggcgggcgatctcggcgtccagtcgggcgcattcgcgcaacgcctcctgccgcgcggcggcgtgatcggcatcagaggcaaggacgaagacgcccgtcacgcgggccgccttgagcgcgagcagggtatccatccagccctgatagagggcgtaaagggcggttctcggttgccgccccagcgccaacgcggcggaaaaggcgggccagggcccggcgtcgcgctcgggactcagttccgcgacaaccaactcgccgtcgagcaccgtcttgcccgcctcgttctgcgcccaacgcttgtgggcggcggaaaggtcggcctgcgcgccgagttcggtgatcagcagcaacggatagggcacggcccgatgcaccagctccaccaggcgctgcaccttggccccggcgcgcagggtcaagcgaagcacggcgatttccaggtactcgcgtatggcgtcccgatattcggccacgccgatggtcgcgggcttgagcgccgcaacccagaccaactcctcgatgctctcgttgatctgccgcttgtcggcgcccgtgggcgcgccgttttcaaggagcagcgtcttgggcacgcgccggtccacgcggcaactcgcgggaaggtcgagggcggccaggatcgcgtcagcgttcattcgcccgcctcgggcaagatcacaagataggccgccacctcgaagtcgttgatgccggcaaattcgcctttgagcgcgtgcgtcccgcccggagaaaaaaggctggcgacggcccgctcctcgttcttgcgcaccaccgaggcgacggcggcggccagcagccgttgcgcggagcgcatgtcttcgccttgcttggtggcccggtcgaaacgggcgcaggctccgacatcgggcagatcgcgcccggcgcagaggcgcttcagccgatcgaggatttgcttggcctgggtgtggggaagcagtacggtgccgtcctcgcccacgtgaacgaggtagtgcggagccagtggatagcccgcctcgaccgttcgcttcgccgcctcaccctcagcccgcaggcagaagatgatgccgggcggtatctcggcctcggtcgtcgtcgtgaccgcgtaggtgccgagcggcaggttctccagcacgccggggtgcgccttgcggaactccgcgaggtcgatgcgaaagtcggtcagcgtgagatcggcgatcgagacaccggtcgagaggtcctccaggtcgatgaccgcatcctggagcttgaggagctgcttgcggcggtactctaggtcgttcatctggttgccggactgctgctcgatgaggttttcctcgccggtcgccgagatgtcgaggagcaccatgcggccgctcacgcgctgctccaggttgatgtactcctctagctccatgttgggccagaagttgacgagctgaatgcgctcgttgggcgagccgatgcggtcgatccggccgaaccgctggataatgcgcaccgggttccagtggatgtcgtagttgatgagccagtcacagtcctggaggttctggccctcggagatacagtcggtggcgatcaggaggtcgagttcgccttcgtcggccaagtcttccggccgttccttggagcgcggcgaaaaggccgtgaggatggaggcgagatccttgcggagcttgggcagggtggtctggttgtagccggtgccggtgaccagggcggtgtcgatgtcgagccgctttttggcccacggggcgagctggtcgtagaggtagcgggccgtgtccgcgaaggccgtaaagacgatcaacttccggttgccggggttgatggggttttcggccttctgctcgatcattttccgaagcgcggcgagcttggcgtcacgcgaagcgtccacctgcccagcggcggtatggagtttgactagccggttgcggtcttcgatcaggtcctgcttccaacggataagatccaggtccttgaggaggaccttgaccttgcggccgaccaggagactctcgaaggcggggtcgtcgacatccaggtcttcgatgtcaatttcctccatctcctcggcgtggttctcgatccgttccagcgtcgcctccacgtctcggagctgccgctcgacggtcagggcgaacgacggcacggcgctttccatgcgcttaagtacgttcacgcgcaagagatggatcaggctctcttcgcggtccacctgccggaagaagcccgtgccacccttgacctcggtgctgtacttcttgtcgtaggcttcctgcttgtgcggaagcacgtaccgcaacggcgcgtaggcggacagattcaggcggcggatttcgaggttgatgtcgcggatgggcgggaacttgcccgccaggtccacgtcggccttgatgttgatcggcttcaagcggtccgggaatcgtcccgtctcggcgatgccgtagtatttttcgatgtgcttgcgcgaccgggcgatggtcagcaggtccaggagcgtgaagtagtcgaaacccagcatctcgatcaaccgcgacggcgtgcgctcggactcgtccaggttgagccagcggttgaactgttgctgcgccaggcgggtggtgctgtcgatgcttccgacaccgtggtcgcgcagggccgtgtcgtcgccctcggtggcaaaggcaatctggttgcgcaggtcggccatgcggttgttgaccggagtggcggaaagcatgaggacgcgggtcttcacgccctctttgatgatcttgcgcatgagtcggtcgtagcgcgtctcaccgcccttctgcggtgtgcgcttgttgcggaagttgtgcgactcgtcgatcacaacgaggtcgtagtttccccagttcacgtccgcgagatcgatatcgccggagagtccgctatcgcgcgacagatccgtgtggttcagaacgtcgtagttgaagcggtccggggccaggaagttgcggcggtcgttggccttgtagagcgtccagttgtcgcgcaggcgcttggggcagagcacgagcacgcgatcgttgcgcagctcgtggtacttgatgatcgctagtgcctcaaaggtcttcccaaggccgacactgtcggcgatgatgcagccgccgaaacggttgagcttgtcgatggctccgatcacgccgtcacgctgaaacttgaaaagcttcttccagaccaccgtgttgcggataccagtcgcggtcttgaccacgcgctcctcgtcgagttcttctcctcggtcccggaagatgtggtgcaggatcaaagcatagacgagaagcgggtcccggttcccggccagttctttcaagctgtcgatcaatgcggtcttcgaggcagggtcggccgcaagggcggaccactgtgcatcgaaccactcgcttagtaacgtggcctcttcgagtgtctcggatgcctggatcaggttcatcggattgcccggcgtcaggccgaggccgtccgtgctgaacgccagcgaaccgaggagcgcctgtacggggcggccgtttgagttgcggatgacgaacgcgccttgcgggatggggctcaacgcgcggcggacttccgccttgttctcgatccactggagcaagcgcttcgccagccagcgggattgcaggcggttgcgagcgggacggtcggcagccgtacccagcatcgcaagatcggaaccgttcggcggcaacaccaggcggcagccttccagttcccgcgcctcgcgattgacctccgcgaatgcgaagagcgacaaggcgggcgtgagcacgtcgagccgatgactgcgcccgatccccagacggatcagatcgatcacgcggtccgtgccggtgttgcggatgaacttcatgccgctcttacccctcgtccacaatagagtaactggctctaccggtggttgcgacactccgaccatgatggtcggtggacaggtagcaaccaccggtgggggttttagcatgccaggtcgacgcctcgggttggaagagtgggaggagatccgggtcgggttggtgcgaggcgagtcgctgcgggtgatcgcccggcggctcgggcggccggtgtcgacgatcgctcgcgcagtggaccgcaacggcggttggatacgctatgtggcggcttgtgcgcagcgtcgagcgaaacgctgtgctcgtcggcccaagccaccgcggctggtggaagacgctgcgctggctcggcgtgtcactcggcgcttggtggaggaccaggagtcgccgatgacgatcgctcgagccaaggacgtaagtcatgagacgatctaccaggcgagctacccaggagaccgcgggctcgatccagggctgtggcgtcatctgcaccaccagcgccgccgtcgctggcggtgaggcttccctggggagcaaagacgcttcgtgctgggccagttccagccgatccaccagcgcccagcggccgccgctcgccgcacgcagatcgggcatctcgaaggtgacctgatcatcggcgcgaaaaacgcctcggcggtcgtcacgatcatcgaccgcaccacacgcttctgcctgcttggggcattgcccgacggctacgacgcagcatctttggcgtcgtgtgtcatacggctgctgcgctcgatccctgaggcaggccagcgcaccctcacttgggatcagggccgagagatgacgttgtgagcggacatcgaacatgttctcggcacccccctctacttcgctgatccccacgccccctggcagcgtcccgtcaacgagaacttcaacggcctcgtgcgccgctggctggcgaagagcaccgacctgtccatctactcccaagccgacgtcgacgccatcgcccgccgcatcaaccacatgccacgccgctccctcaagtagggccacgcccatcgccactactacgatgccctcgtcgcaatgaccgatcgaaccggccgcctcacgcgcgttccccagcaccgcgcgcagcgctaccagcgccccctccaggcggtaaaccgtcgcagccggcgccaccagctcgccggccctgaccctcttgagcaagactgcaacctcatcggccagcttctcgacttcagccttcgtcacatcgccaccttcagggtcacttcactccaccgcggtcgtcgagtgccaacccacccccaccccagctgctacccatcagtagtcaacccaccccaccccagctgctacccatacgtagcaacacggctgaggggcgcaaaagttaccaacgagtaactatcagggtaactatcagggacgcgcttggtgcccgagatcgtgggtcgcgcgcacgggcctcgtcacggctccccggcgagggcgtggtacgcagcctggataataggagccgccccttggcccgctaccgccgccagcgggtcaggctgggcctcgcagtacggcctcggcctcatcgagcacctcgtcctcgctggcccactcgtcggggtcgaggtcccacggcgcgggctgcgggaacggctcgctcgggtcgggcggcggggccaggtcgagcacccggtcgggtacgtccggtggtccgtcgtcccacggctcggggggctccaactcgactggctcgccgccaagaggatcatccgcacttgatcctcttagagttgatcctcttagagttgatcctcttagagttgatcctcttagagttgatcctcttagagttgatcctcttagagttgcgtcagtcgcgggctcggggtcgccgccctcgccgtgaaggaccgacaaaacggggcgatcccgggcctcatcgaggccccaccaccactcgcccgcccggcggatcgagcgaacccggagggcgctcttggctcgctttaaggtgaccagcgagtaccccgcgtgcgcggccaggttggccacctcctgcgctcgcatcggcccctcggccagctggtctcggagccacatctcagccgaccgcagccggccgcccccgtgttcgccaccggccttcggcagaaggtcgaccgggtcaacgtcgaccggccctaggagccctctgaacaagcccctccctggtggtggctgagcacgcccacccagcccgggaacgagcccagctgacccgttcccatctcgctcctcaccctctcctcctcgcccctcctgtggggcgaggaggagaggacccgagcgcctctcaggtggcaagcacccagccaccacccacccgggtgagccccaggcgaaggagcaccttcaggttccaggtggcacagagcagctcgaagtggagtcggttgcgcacgagccccaggtagcgcagcctcgcgccggagagcttgcgtttgagctgtgcgtggatccgctcgacgttcggtcgggtgcgctgatagtcgagacgaacggcagggtccccaaagtgcgcccgctggctgattgcgtgccaggtggcaggggtgaaggtgaggacccgtcctcgcttcgagcgcgtgcagcgatcccggagcggacagccggtgcagtgcttgacaaaggaagcacgacccttggcggagatgggtactcggtgtccttggggacagctgacccatccctcctcgacgacgaagtcatcgatggtaaagccaccagggaccgccatggcaaggggccgaggcttgatcacctcgtcgtggccacgagcggcgagctcgttggagacctcgctcgtggcataggcgctgtcgccatagaccgtgcgcgggccgtcctcgtcacgaaggagctcgctcgccactgctgcgtccggcacggtgcccttcgtgatggtcgcagcggtgacgatgccactgtctggctcgacggccacgtggcccttgtagccatcgatggcacgggcacgggacttgtggacgtggcgagcgtcagggtccacggtggagatgaccctgtctgtggctacccgcctcgcgatgcgccagcgaccttccttggcatcgacacactccacgtcttggcccgccacgagcccaaggagaccaagggcttcggtctgtggctcggtgagggatgcgagcttctctgcatgggcgaggtgggcagtggcatcggcgacgagggcactcaccgtgcgcaccactgcctcttcgtcccgatagtcgatggcaggctttgcgcgggtgtagtcgatcgctggtgacagaggaatgtcgcgtagttcggggatcagcctgcgtacccggttgatctgggcgacaagttgggtcatggtgtcttgggtggcaaccgcatcggcgagcacggtggagtcgacgacgcgcttcgtcttgcccttgagcacccccgtggcaccgatcacctcggccacgagttcgccgatgagtcttggggtctcggaggtggcgatgcgcctgcgccagtaggtgagcaccgtggggtgaaagcctgggtcctcgagatcaagaccaagggcgtacttccagcggaggttgtagcggacctgctctgtcgcctcggtgtccgagagcccctcgagcacctggagcaccatgaccgcgagcaccctcgaggcggggatggagggtctgccggtcgtggaggggtagagatggcggaagcgctcgtcggggaagagctctctgcggtgctcggcgaggaaggcgtagatggaccctggctcgatgagcgaggagcagaaggcctccgtcgcggtgaggtgtgcctggtctgattcggtgcccagcatgcaaaaagtctagctgagctgggcaaatggcgcttgacaggcggagggaagcgcttcccgtagccgccctacgtggaggagttgttcaggggactcctagcccgctgctggtgtataggacgcgcttcccgtctgcggcaagacctccacccaggtgcggccaggatcgagcggaatgatcgatccgttcgaactccgcagcaccgtgggactcgcgagcgacgcccgcgaccacgttcctcggatcagctcgccgttgcgaaggacccagacgttgccgctcccgatgacctcggagtgaaccccgagcgagttcggaccgctctcgttgtagggccccggcaccgattgcacgaactgcaccacgacgttcgtcgcgctctgcacggcacccgacgcgccgtaggcaggtacgcctgcgtaggagcgatcgaagagcccagtcgcagcgttccacgtccactcgacaggctcgaccgccgagaacgtcaccgcgaccgacgacaccggaatgccaccgtgcggcacggtggacgagaaggtaaagatcggcgagggcgcggtcgtcggacccacgagcgaccagatccccgccgggttgccgtagaggttctcgggaggcacgcgcgtcgtggtgcgctcgaacggtgtcccgctgtagtccaaggcgtcgacgcgatgcagccaggtctgagccgccagttcctgccggtcggggatgatccctcccgcgtagacgaggatcggatggccgaactgcccgaggacgtgccagtcgacccagcgcagcgaccgaatcggacccacttcggcaggcgagccgcactggaagatggcgatgaatcgcgtgatcccaccctcggcctggacctcgtagaccatgtcggcttcgttgagaccgctctgaggacgagcgcccggatcgttgccgaccttgatcgccagtgccgcacgatcaggaacgacgccgccaggtgccgcacgaccggtcagcgggcatgtggctgacgcaggtgcggccgacgacgacaccggcgtctggctcgtgctcgtcgagtcggcgtgcgaggagggtgttcgggagtgatcgagggcgagcgccgcgcctgcgccaacgaccaccaccacgacggcggccccgagcaccacgcctcggcgtcgacggacacgcttcgaggtgcggtgcgccatcactcctcctcaaacgttgaacgcagcgagcttagggccctcatcgcccgaccccatcgtctccgagagcgtggggctcgcgtcccgaacgcgccgaggacgccggcgcatcggcgaggtcacggtagcgaacccagccgaccctgaggcgaccagcaacgacgacaccgagcgcatccggctcgacgagccccacgcggccgaagcgcgcccgcgccagtgcgagcgagctatcggcgtcgatgctcaccactggggccgcgggcggcgcgccgcgccggacgcgctcgagcaggccacccgccatcgtggcaccgagaccacgatgagccaggaagccctgccatgcatcgcagccaaggtcgcgagcccatcgaagctgatcgggccgctccacgcccaccgcgaccacgatcgcgccgagctcgtgggcggccgtcgtggtcacctcggcgatcaagcgcgcgcgctcgcgcgtcgaggcggcgacgatgctccggtcgaccttgaccacgtcgggctcgagtatcgcgaggcgctcgagaccggcgaaccccgcccccgcgtgatccagcgcgaccagcaagccagcgtgccggagcggttcgagcgcgcgcgctaccacctcgggcgatggaccgcccgcgagctcggagacctcgacgacgaggcgcgacgctcggggctccaagatgcgcagcacggcatcgaggaccaccaccgacggcgacaggttcacgctcagccgcacgcccgactcgaactccggggcgtcgagaagttcgagcacgcgagccagtgcgacgagctcgagatgcaggtcgagccccaatgcggtcgccgagctgaagagctcgtccgcctcacactcgtcgtctcgaaccaacccttcccacgcgatcggtcggttggtctcgatgccgcggatcgcctcgagacgaggggcgagccgttcagggcaccccaagacccgctcgatggcgccccgggacacgctcatcgccgatccgaacccgtgtcgtgatcgtcgaggacgacaccgaggacgtggcgccactcgtcgacgacgagcaccgcctcgaccccaccatcgagtgcgcgacgcacgccatcccagccctcgacgagatcgacctcggccgcgcgaagcggtgctcgatcctgatcggcgacccacacggctcgacccaagccgtcgacgcccactcgcagatcagtgccgagcaacgggctgcgcgcaggaacgatgcgcgcgacggccagtcgttgagcgagttcggcgccaaagagcacccgacgatccgaccgaacgactcccgcgatgcactccgggtcgacccgagggaagccctctgctggacgagccagccaatagccctgcgcggcatcgattcccaaccggacgcacgcgtcgagggtgaggcgatcctcgactccttctgcaatcacgcgggctccgagacgatgcgccgtctcgacgagcgtggtcacgacgccagctcgaccggcgtggtgagcgaggcccttgacgagtcgggcgtcgagcttgacgatgtcgggacgcacgcccatcagcagatcgagaccgccaaagcccgatcccgcgtcatccactgcgaccaacgctcccgcacatcgcaggtcagcgagtgatcgctcgagcacggcgacgtctcgcgccggcacgtgttccgtgagctcgatcacaacccgatcaagacgggcgtgcaggagcacgtcgcgcacgcagggcgcatcgatgacgctcggggcgacgttgacgtgcaggcgccagcctcgcgcaaggcgcctcgttgcagccagcgcacgctccagcacgcgagcctcgagatcggcgccgatcccgagcagctgaccatggaggaacactgcttgcgtggctcgtacaccctcgaaccgtgcgagcgcctcgtagccgacgacactgcccccgtcgagcccgacgattggctggtggaccatcgtcaagccgcgaccactccgcacgacctgcgctgcgcaggtcgtggcccgaagttcgtcgctcatcggatccacgctgatcggatccagctcggcaggatccgtcaccaccgcaatcccttcgctctccacgctcgttgacctcggcgcgttccggtcgcgacttgacgcactacgtccgatgatcgcggctcgatgcctgagccctgtcattgcgaacggtcgccggttccatgacgtggctcgagcctgcatggagagagcgaacctcggcgtgatcgacgatgcgcactctcgccagaggtgggcccgtgcgcaccacccgatgatcgacgggtgggcacaaccgcagctcggccgccggatccctgggtccaacagacgtcggtgcgcagccagcccgccacctcgccaagacccaagggttgtcgtcgccgcatcgcagttcatcgcgttcgccgcggccaacccgccaggtaacaacgacacgtcgtgaccaacgtcacctcccccagggaccattggctcctgcacgccacacgcgcccggcgtagcttcagaggtgtcgagagtctcgggcgaagggaggcacgatgaacgagacgaccatggagtcggcgggcgagaccagcgcaacgaccggcggcaagctcgccatcatcgcctacagcggcaccgcggacaagctcattccgctgggagtgctcgcgcaagcggccgcggcgatgggctttgccgtggagatcttcgtgacgggcttctcgctccttgccttcacgaaggaacgtcacgagctgccctttgccgcggagtacgcagcgatggctccccagctcgccgaaagcctctcggccaacaagatcgccccgtgggacgagatgctgcgccaggccaaggagctcggagctcgggtgcacgcatgctcgatgatgtcgacggtgatggggctcggtccggacgacttcggcgatctcgtcgatgacgtcgtcggagccgcaaccttcgttgctgcagctgaaggcgcagagacattcttcatctgagcccgttgcgaggcgaccatggcatccaaggagaccacatcgaggaggtgcacagcatgaccgaacagccatcggagcagacgacacgaacgatcgtcgattcgcggggatctgcttgccccggaccgatcacggacctcgcactcgcctaccgcaaagccaaggtcggcgacgagatcgagctgctcgcaacggatcccggcgtcaaggctgacgtgaccgcttgggcggccaagacacataacgaggttctcgctatcgaagagggggtcgatggtgtgatcacgacccggatcaagatcgtgagccggtgagatgacacgccgcgtgctgatcgtcggtggaggcgacgggggcacgatcctcgcaaactcgctcgatccccgccgcttcgacgtgaccgtgctgaccgcctcacttgaacatgtcttccagcgcggttacctcggcgtcgccttccaggggcggcgtcgcaacctcgtgcgcgacgagcacagcttgctgcgctcgcacatcacactgatccacgacaccgcagtgcgcatcgacctggttgaccacgaggtcgagaccgcgaccggcaggcgtctcggttacgacgacctcgtcatcgcgaccggtgtgcgcaccgatccgtcccagatccccggtctctgggagatcaatgagcgcatcggcgacttccactcgacgaccgcgaatgcgcgtcgcttgtggcgcaacctcaacgccttctccggaggcaccgtggcactcggacaagcgagcccgatcatcaagtgtccaccctcgcccgtggagggaatcctcggcgtcgacgcacgactacgggctcggagggtacgggaggcggcgaagctcgtgctgttcaccccgtacccacgcgcgtaccccgcagagcccatcaacgaggtgatcacgccgattctcgaggagcgaggtatcgaggtcatgccgttcttcgacgtggatcggatcgatcccgcgaccgggaccatcacttcgctcgagggcgacgaagtcaaggcagacctgcccatcgtcgtacccccgttcgttggagcgccgatcgtctacgagcccgcggacgtcgtcgacgacaatggactcgtgaagacgaacaaggagacgctcgccgtcgagggggtcgagcatgcgtggtgcatcggtgatgccaacaacgtgccgacgtccaaggcgggcgtgggcgcgcacctcgaggcgaaggtggtcgcgcggacactggcaggtcacccgacgcgcttcgatgggcgcaccaactgctccctcgagatcgtaggagatcggcgcttgaccttcgtcattggatctttcgacgctccggtcgagaagctccggccgacacgagtcaagtacctcgaggagtggttgctcggcgagacgttcttctggggccttcggggctggctggacccggtcttcgacgcctacttccgactgaccgagccaaaacctcggcgagtcgccgcctgagagccccgaggtctcgtcactcaccttctctcgtcaagggttactcctcggtctcgtcgtcgagccccttgacaggcccggctcgtgcattggcctgggacacacccgtcgaggaacgattggagaccacgatggtgcacgacctcggcatcgagacgagcaacgcctccgcggtcaccgaggatcgtgtgcgatcgatgtcgccccgacgcgcgagcggacaacaccacgaccatgcgtcgtcgcaggccacgggacccgggttcgtcgctgctcgggcgagaggccgatggcgcacggcacctgctcgagaggacttcagccaactgccacaccagtccacgatcgtcgtggcgacgaggggcagaggcgcatgacgctcaggacccagtcatcggccatgcgtcatctcatgccatcggtcgtgtcgggagcgccctgacaccggaaacttcagtcaggggccttccgtctcgaggaggccggtccacgaggaacccccgtcaaggaactccgccaaggcagccgtgcgcacggaggaccggatgcctcgaccgcgagccgctgggcgctcgcgcactcctcgaccgtgcgcagcatgcaatcccaactccacaggagacgaacccagcgggtgctcaacctggtgtgcactcgagcgcgatcgaagccccgtccgcgggtcgtacgccctcaccttgcgcgagctcagacagacgcttccacccggaggtcaccgcgccgagagcgactagggtgctccgcaccaggggcgcttagctcagtcggttagagcgcagccttcacacggctgaggtcggaggttcgagtcctctagcgcccaccggaaccgcgacgccgtggacccgacgcgatagacccgacgcgatggacagcgccaaggggctcggaccgcgctcgtccttcgcaaccacgacacggagcgcaacatcgaggcccgtctcgcccgcgcatcgcgacgcacggcctgacacgaccgcgtccctttggagcgagtgatcgagtccgcaacggaggcggtcgacaggcctgaccagacgaacacgtcgccactcgccgaccccactatcagctcgatcgatgcccagtgatcgatgcccagttcgggcgggggccatgttgactggcgctcggccacgcggaccgcactaccccgacggtggctcttggctgcagcacccgacgcgcacgcatcagcgtcgtgccctgtcacctcgaccaccaccactcgcacccgctcgcgtcgccgacgcacgaaggatgcgaggaactaccagtctcgtcaggactcacccgtcccggttcggccggaccaccacagtcgtcccgaccgcgtcggccaccaccgaagcgaggactgacgcgccagagcgctcgacgtcacgcgtcgcggtcaacacgaccagctcgtcatcgaccgcccaccggacgaggtcggcgaactgcgtgcccgtcatctgatgctcgagttcggccagatagcgacggcgaaactcgggccagcgctccggctcgtgaccgtaccaccgccgcagctcgtcggtgggagcgagctcgcggcaccagcaggcgaacggagcatccgcacgccggagcccacggggccagaggcggtcgacgagcacccaatggccaggcggccatgggcgctcgtagacacgccagagcacgactcccacgagagacccccgcgagcgggtctagccgtggtgatgacgctggcggatcatgttgagtgcgctccctgcgcggaaccaggcgatctggtcctccgagaacgtgtgacgcagttcgagatcgaagctggtgccgtctggtcgatggaccactgcgcgaatgggttggtcaggcgcgagctcatcgagaccgacgaggtccactcggtcatcacgctcgatgcgctcgtagtcggcaggatcggtgaacgtcagcgggagcatcccttgcttcttcagattggtctcgtggatcctcgcgaacgaacgcgcgatgatcgcacgggcgccgaggtagcgaggctccatcgccgcgtgctccctcgacgaaccctcgccgtagttctcgtctccgatcatgacccatccctggccggcgtctcggtagtggcgtgcgatctcgggcaacggctcgtcagcctggtggatctggcaccaaccatggccgggctccgcggcgaaggcgttctggaccccgaggaacaggttgcgtgagatgttgtcgaggtgaccgcggtagcggagccagggaccggccgccgaaatgtggtcggtggtgcacttgccgaccgccttggccaacacgacgagcccgacgagatcaccaccctcgaagggctcgaacggagtcagcacctggagacgctccgacgccggatcgatgcggacctcgatcgcagaaccgtcggcgggcggtgcgacgaagccgcgaacttcgcgcgcgaggccagcactcgggagttcgagcccctccggctccgggagccgctccccggcgagctcgtcggtgagggggttgaagtcgagggtacccgcgagcgcgtaggcaacgacgacctcgggcgaggcgatgaacgccaacgtcgccgcgttgccgtcgttacgacgcggaaagttgcggttgtaggacgtgatgatggagttggtcgtcccaggctcgatatccgtgcgatgccactgcccgatgcacggaccgcaggcgttcgcgagcacggtcgccccgatcgcctcgaggtcacgcaacaatccgtcacgctcgatggtcgcacggatgcgctcggagcccggggtcacgaggagcggcgtgcgcacccgtagacctctggcgctcgcccaacgagcgacgctcgccgcacgtgcgatgtcctcataggaggagttggtgcacgaaccgacgagggcgctcgagagctcgagcggccacccatgctcgcgcgcctctcgaccgatcgacccgaccccacgtccgagatccggagtcgcaggcccgacgatctggggctcgagcgtgtcgagatcgatctcgatcacctggtcgaagtagcgagccggatcctcctcgacctcggggtcggcctcgagcgacccgaggcgggcttcgacgagcgcagcgatctcgtcgcgacccgtggcccgaaggtaggcaaccgcatggtcgtcggcagggaacaacgagcacgtcgcgccgatctcggctcccatgttgcagatcgtcgctttgccggtcgtcgagagcgcacgggcgcctgggccgaagtactcgaccaccgcgcccgtaccgcccttcacggtgaggatctcggccacccggagaatcacgtccttcgcgctcgtccagccgttcgggcgtccggtgagccgcaccccgatgagacgcggcatgcgaaccgtgaacgggtcgccgaccatcacgtcaacggcgtcggcccctccgacgccgatcgcgaccatgccgagacctccggcgttcggggtgtgcgagtcggtcccgatgatcatgccgcccggaaacgcgtactgctcgagcacgacctgatggatgatgccggcaccaggctcccagaagccgatgccgtagcgagccgacaccgacgacaggaagtcgtagacctcacggttcgtgacgcgagcggccgcgaggtcgtcatcggcgccgcgctccgcctggatgagatggtcgcagtggaccgtcgtcggcacccgaacctcggggaggtcggcaaccatgaactgcagcagcgccatctgcgcggtcgcgtcctgcatggccacccgatccgggtcgagctcgatccagctcacaccgcgctcgagttcggcgcgctcagggtggcgtaggtgcgcgtagagcaccttctcggcgaaggtgagcggtcggcccaaccgctctcgcaggaccgacgcaacctcctcgtagcgtgcgagcgccttggcgacgagcgccgccggcgttgtatcgcgaacctctgccatggtggtacctctctccctctcgaatcccccgaagaggaccgatcgttgtcacgcagcgctagcgtagacaagcataggacaagttcgcattccccgctacctcgccatcgcagagcgcctccgcgcttcgatcggcgatggccgcacgagcgaaggtgacctccttccttcggaggccgagctgtgcgcacgctacggcgcgtcacgcatcaccattcgccgtgccctcgagacgctccgagacgaggggctcgtcgagtctcgccagggccttggctggatcgtgacgagggtgcccgtcgcgcagtcgctcgggcgctttacgaccatcgaacagcagctccgagaactcggacgcacacccgaacggcggatcctgtcgtcgatcatcaagcccgcgaccgggccgatcgaagccgttctcgggggcggtgacgtccgcgaagtccgacgtttgaacctcgccgaccaggagcccttcgcgaccgtgaccgtgtggatccccgcgcacctcgcagagcgcttcacggtcaccgaactcgaacgttcgtcgttctacgagctcctgtccgcgagcggccagctgctcagaccgctcgcctgggcgcaccaagtgatccgagcggccgctatcgacgagcacgacgctgcggtcctcaacgtgcccgcggaatccgtcggcttgaccgtggaacgcacgacctacgacaccgccgacgtcgccatcctccactcccggttcgtgttccccgcaagccgcgtgttcttcgaggtcgacctcgtcgatgaggtcagctccatcggtccgagcggcctccgcctcgtcacctgaaccgcttgacaggattcattcagagacctacgatgctgtatcgagctatgcagtagcacggctcgctgcacgtcgaggggggaccatgagctcggcaccgatgttcgaggcgcgttcgatcgagcagattcccgaccacgaacgccatggtcggccactgtcgctgctcacgctgtggttcgcctccaacttccagatcaacggcctggtcaccggcgcgatcgccatcgccgtcggcttgagcgtgccccaagcccttctcgccctcgtgatcggcaatctgctcggtggtctgttcatggcctaccactccgcccaaggccccaagctcggactcgcgcagatgatccagtctcgggcccagttcggcttcgtcggtgccatcgtgccctatgcggtcgtggtcatcatgtacctcggcttcgcggtcgcagggggcctcgtcgcgggaccggccatcgcgagtgcgctcggcaccacgagagatgtcggcatcgtcgtctacaacgtggtcgtcctcgcggtcgcggtgttcggctatcggctgatccacgcgatctcgcgagcgatctcgctcctctcgctcgtcgccttcgtggtgatcgcggtcgcggtgctcggtcgccttcacctccacgcggcgccgtcagcaggtgccggggccttcctcctggcggtctcgatcgccgcatcgtggcagatcacctgggccccgtacgtctccgactattcccgctacctgccggcgagcactcggacctcgacgacggtcgcgttcacctacgtcggctcggcgatcggtggcgcgctcatcatggcgatcggcgccctcgccgccgcgctcaacgcgaacgccgtgaacgccaacccgatcggctttctcgccggacaggtctcgccgatccacgaagcgctcgtcgccctcctcctgctcagcctcgtgccggcgagcgcggagagcccgtatggcgcattcctgaccgcgctcgcggccgtgacaccccggggactcgtctcctcgacacgcaccgcgcgcacgatcttcgtcgtggccttcacagtggtgagcctcgtcctcacgctcgccctcccagcgacgatcctcacggactttgagaacgtgatcttgttcctcctctatctcctcgtgccgtggacggccatcaacctgaccgactactacctcgttcggcgtgggcgctacgacgtcgccggcatcctcgacgcgaacggcccctatggccgcctgcaagctgggccgctcgccatctacgtcgtcacgatcctcgtcgagctccccttcgtgaactcggcgctctacgagggaccgatcgcccgagcgctcgacggcgccgacatctcgtggatcgtgggcctcgtcgtcgccacgatcgcctacctcgcctgggctcgcgcacgcggcctcctcgtcgccagggccccggggacggcgccggcgtgaccgcacgcgccgaccgtctcgccgcgctgcgcgacctcgtcgggacgaaccgcttgactccggttcagcgtcggatcgtccagaccatcgccgagcacctcgacgacgcggacacgttctcgagcgccgagcttgcggcgattgcgggggtctcgcaaccgtcggtcacgcgccttgcgtccgcactcggctttgcctcctatccagagctccgccaggcgctgcgcgctctcgtgcgcgacgactcccaacctgtcgagtcgacgccccgactcgacgcggtgcgcgacgagatcgccaacctgacctggatggagcgacagctcacctcagaaccccttctcgccgaggccggtcgtcgactggcgggctccgtaccgctcctcgtcatcggccttcgtgcctccgcgccactcgcggcgtacctgagcttctacgcccgcaaggtacaccctgccgtgatcacggtcgaccgcgccggctcagagggcatcgatgcgatcgccgaggcacacgcgcgtggcgccaacgcagcgctcgtcctcgcgctgcccaggtggccgagagaactcctcaccctcgtcgaggtcgctggcgacctcggcatcgacctcgtcaccatcgccgaccgcgcccacgggcccatccaggcgcgcgcacgcgtgtcgctcgtcgctccggtcggaacgagccttctctacgacacccacgcaagcgccttcgtgctcgcgcagctgctcgtgcaggcgatcgccgacgccgcgccgctcagcgcgaaggcatcgatggaggcattcgaagaacgtgcctcgcgctatcgctacttcctccgaggagaggcatgaccgcactgctcgtcgacctcttggagcgtgcacgcccgatcggtcggcacgccgacggtggctggacgcgtctcgggttcagccccgaggagaccgctctcggcgacctcgtcatcgccgaggcgagccggatcgggctcgacacctcccgcgaccgggctcagaacctctgggcatggctgggtgcgccgggccccgacgcactggtgctcggctcccacctcgactccgtcccccgtggcggcgaactcgacggtccgctcggcgtcttcactgcgatcgcagccctcgacgccctgctcgctcgcggctggcgcccacggcgcccgctcgccgtcgtcgcctttcgcgacgaggaaggcggtcgcttcggacgcgcctgtctcggctcgcgcctgctcgccggcgaacttgcgcccgccgatctcgcgaccctgcgcgatgggcacggacggagctttgccgaggtgctcagagacctcgagctcgagccggcgcgcgtcgggcccgatccccaacgcatcgcagcgatcggcacctacgtcgaactccacatcgaacagggtcgccagctcgcacccctcggcgcaccggtggggatcgccaccgggatctggccccacgcacgagcgctcgcgaccctgcccggtgaggcgaaccacgccggcacgacgcccctcgatgaccgtcgggatccggtggtcaccctggctcgcctcgtcctcgccacgcgagaccaggcagcactcaggggagcactcgccacgatcggccgcatcgacgtcgaccccaacgcccccaacgcggtagccggctccgccgcggcgtggctcgacgtacgggcaccccaggcgacgatcctcgatcagctcctcgacgatctcgcacgcctggtggtcgagctcggcgggacgttcgacctccgctcgatgacgccagcgaccatcttcgatacccagctcgccagcgagctctccgcgctcctcggtggtgccccacggatcgccaccggagcggggcacgacgcgggtatcctcgccgaccacggcgtacgagccgggatgctcttcgtgcgcaacccgaccggcgtgtcccacgcccccggggaacaggcaacacccgccgatcttgccgcagggcagcacgcactcgagcgagtcatcgaggcactcgcatgaggatcgcggccgacttcgcgctgctctcaccgaccgagctcgccaccgacgtggtcgtcgaggttcacggcgagcgcatcaccgcgatcgagcacggccgagcgggcgcgtgcgacagcgccgtcgagctcctcgtgcccgggttcgcgaacgtccacggtcacgcgttccaccgcgccctgcgcggtcgggccagcctcggcgctgacttctgggactggcgatcgagcatgctggccgtcgccgagatcctcgacccggatcgctaccgagacctcgcaaccctggtctaccgcgaactcctcctcggcggctacaccacggttggtgagtttcactaccttcaccacacacgagacggctccccctatcgagatccgaacgccatgggcgtcgccctcgtcgaggccgcccgggccgcggggtgccgctacaccctgatcgacgcggcctacctccaccaggctcccgaccacggcgagtgggcaccgaccgagggcgtccttcgtcgcttcgccgacgcaacggtcgatgcctacctcgcgcggaccgaagagctctccgagggcgcaacccatcgcgtgcaactcgccgggcattcgctgcgcacgtgcacgcccagcgagctcgtcaccattgcgcaggccgcacggcgtggctggcacctccacctcgccgagcaacacctggaggtggagatcgtcgaggcggcactcggcgcacgaccggtcgcgctcctcgagcacgccggcctcctcggccccgagctcgtggcggtgcacgcgaacgcggcgacggccgaggaactcggcacgctcgcacgccacgacgtggtcctctgcgcatgcccgagcaccgaggaggatctcggtgacggaccatcgcctgcggcgaacttccatgggctcggtggacgcctcgcgatcggctccgacgagcacgtactcgccgacgggctcgtcgaggcgtcgcgcctcgaggcccatgcccgactcgcgagccgccgacgtcgcggtctcgatgtcgccgcgctctggaccgcgctcaccgcccaccacgcccttggttggcccgaggcgggcaggatcgctcccggttggctggccgacctcgtcgccatcgacctccacgacgtctcgctcgctggggtcacgcccgaggcgatcatccagatcacgacgccggcacgggttgtgcgagtctgggttggcggcacggagatcgtgcacgacgccgccgtcgaacgtcgcgaactcgccccccgtctcgaccacctcatccgcaccatctggaaggagatcccatgagcacgcgtcacgacgagagccgaaccatccgtgcgccacgagggagcgagctctcctgccggagctggctcaccgaagccccgtaccgcatgatccagaacaacctcgatcgagaggtcgccgagcatccggaggacctcgtggtctacggcggaatcggccgagctgcccgcgactgggagagcttcgaccagatcctcgacaccctgcggaccctcggtgacgacgagacactcctcgtccaaagcggcaagccggtcgcggtcctgccgacgcatccggatgcacctcgcgtcctcatcgccaactccaacttggtcccgcactgggccacgtgggagcacttcgacgagctcgaccgtcgggggctcatgatgttcggtcagatgacggcggggtcgtggatctacatcggctcgcagggcatcgtccaggggacctacgagaccttcgccgcggtcgcgaagacgcacttcgacgacgacgtggctgggcgctgggtcctcaccgcgggtctcggaggcatgggcggtgcccagcccttggcggcgaccatggcagggttctccatcctcgccgtcgagtgcgacccgagtcgcatcgagctccgcctccagaccggctatctcgagcaccgcgcgctgtcgctcgacgatgccctcgcgatcctcgagcgggcccgtcgagacggacgaccgacctccgtcggcctgctcggcaacgccgccgaggtcctccccgatctcgtcgagcgcggcatcatccccgacgtcgtcaccgaccagacgagcgcccacgaccctctccggggttacctaccactcgactacagcctggaggagtggcgggcggcccgcgaacccgagcgccaggtcgcagacgccaaggcagccatggcccgtcacgtgcgcgccatcatcgccatgcgcgatcgtggtgcggtcgccttcgactacggcaacaacctccgccagggagcgctcgaggcgggcgtcgacgatgcgttctcgtatcccggcttcgttcctgcctacattcggccactgttctgccgtggctacggaccgttccgctgggttgcactctcgggcaaccccgaggacatctaccgcaccgacgaggtcgttgccgagctcgtcgacgatccgcacctgcaccactggctccagatggctcgcgagcgcatccacttccagggcctccctgcccgtatctgctggctcgggctcgcggatcgcgcccgagtcggactcgccttcaacgagctggttcgtcgaggagaggtaggcgccccgatcgtcatcggacgcgaccacctcgacacgggttctgtggcgagcccgtaccgcgagaccgaggcgatggccgatggctcggacgccgtcagcgactggcccttcctgaacgcgatggtcaacgtggcttccggagcgacctgggtctcgatccatcatggcggtggcgtaggcatgggcttctcgcagcacgccggccaggtcatcgtggccgacggcaccgatgctgccgcacgacggctcgcacgggtgctccacaacgatccggcgatcggcgtcgtgcgccacgcggacgcgggctatgcggacgccatcgacgaagcccgacggcgaggactgcagatcccgtggctcgcctaggggagggccccgtcgactggctgctcacgaacgccgtactcgccgacgtcgacggacacggcagccttcggatcgaggaaggctggctgcacgttcgaggcgagcgcatctgcgcgcgaggcaccggtcgacccccagccgacctcccacacgtggatgctggcggggcggtcgtcacgccggcgttcgtcgagtgccacagtcatctgctctttgcggggaaccgtctcggcgactggatgcgacgccagggactcgaacccgacgacccccgcctcggcaccggcggcatcgccgccaccgcgaaggccacgtcggcgctcgacgacgctcagctcgtcgcgacgacgctcgcacgccttgcacccctcgcgcgctccggcgtcggcacggtcgagatcaagaccggctatggcctgagcgcgcccgccgagcttcggctcgcacgcctcgccctcgaggtggccgagcgggcccgccacgacatcggactcgacgtcgtggtgacgttcctgggcctgcatgcactgccgacagcccctgcccacgagcgacgtcacatcgtcgacgacatgatcggtgccctcgacgaacttcccgctggcgtccgcaccgtcgatgctttcgtcgatccggctggggtgagtgccgaggaggcacgacccttcctggaagcagcgcgagcacgcgggttcgacctccgccttcacgtcgaccaattcgccgacgcgaacggtgcggccctcgcggcgtcactgggcgccctgagtgcggaccacctcgacgccacgggccccgagggcatcgcggccctcgcggctgctggcacggtgggcgtgctcacaccgatcgcgaccgtgctctcgggaacgcgactgcgccctccggtgatggccctgcgagacgccggggtcggcctcgcggtctccgccgacgccaatccgggcacctcgccatctgccgacctgcgcctcgcggcgctcctcgcggtcaccgagctcggccttcgacccgacgaagccttcgccggcatcacgctccacgcagcccgcgcgctcggcctcgcggaccgcggcaccctcgaagctggggcgcgcgccgacctcgtcgcctggcccgtttcccaccccttcgaactcgtcctgagccacctgccgctcgaaccatggcgcccgctgcctgactgagcgtgctccagctcggaaccggccccttcccacaacaagcccccacctgcccacgacccctgaatccatggagcgccacgcgcggcgacacgcctggccgctccgacccgcagcacaatgcgctcgcccatctcgagggcccgaaccgcaccatcacgctcgagctccgcgagcccgacgcccgatgggcatcgtgagctctcgagcgacgtcacgagccgttggccggccccacgcgtccggtgacggacgatcccgagtggacggccgatgttggcaaccacgtccgatcgaacgatccgtcaacgcgcaagggcctacgcggatgcgctgggccagatacgtcgcccagcgacctcgacctggaaggcgaccgacaccggcaactcatcgcgcacgagccgcacgaaatcggagtcatcgagccatcccgtggaggcgacctggatgcgaacgaacggagaggaggccggatcgtcctggtgtcggcgtacgccgccggtctcggtgaggatcacgggcccgccggtcaccgcctcgagaatggtcgtcagccctcgccgcgtcccgcgccaggccagcgcctccccgaggctacgaacggcccgccgctgcgtggcttccgggagcgaaccatcgagccaggacacgccgagccacgctcccaaccacgccagcatcggcaccggggtgacggtcgggtcgacgatgtgctcgatcgtgtcggcgtcctcgagcagtgtcgacgcgacctcctgaaagatcgacacgaatcgaacgaagaaatcatcgtccgtcatccccatcgggagttgctgcaggagccatccgtcacgtcgcatggtgagccctagcggacgacgacctggtgacggaacgagaggaacagcgacaacggatcgagcgccaagacctcccgtccgcgtccttgacgctcgccggtgcgcagatcagcctcgaacaggagcacctcctcgaccgcctcgatgccgtcgacggtctcgagtcgttcggccacaccggctgcggtcaaatctgcgtcgaacggccaaccgtcaccggcggggccaccgaccagcggatggacgtattgatagagcacatcgagggcacgctggcgcacgatggcactcgggcgcccggggatggcccgcacgagtgcagcgaccgtggcgccccgatagtacggggtggagacgtcgaccgtggtaccaatcagtcgtcgcggttcgaggtagccgatgacctgctcgacgagcgcgtccgagagttcgaagtcgtcgagctggtgatcctcgcagcgccctcggaccctcggcacgacgagcaagcgcaccggatcaccgacgaggttcggcgccacgcagcggacccgtgcgacctcgggcgaggcttcgagcgtgagccgctcgaaatccgatgcgctcacggcccgctgaccggagcgcaacgtcatcggcccgcgaagcttggcgttcgcgaccgattcgggatcgaccccgcccgaggcagggaatgggttcgtgactcgatcgatgtaggccaccgaactgcgcaagacggtgagcgtctcggcgccgacgttgccgacggaaccgcccccgtagcggtacgacgagagcatgatcgccgcaccgtcgggggggatcgcgccgtgctgacggacggtgccgtcggcgtaacgcacgcgcggaccgaagcgaaccgttccggtcgctccatcgagcacgaagtgtcggtcctcacccgtcgacgatgcaaagtccgcacgcggctcccacgtccagaccacgccgtctggggtcgtcgtcgtgagcacctcgtcgtcacggagagccaacaccggggcgtgactcagctgaaactcctgtccgggtgagccatcgctccgaccaagacgctcgggccctgtggtcgcagcgtgctcggcagccaccgttccgccgaggacgttcacggtcaccgacgacagggatggtgaggctcgatagggaggttggccagggcgtgccgcgagaagacggacgcgcagccacgtcgcgcgaacaccaccgagcgtcaggggcgagagcgcgcgcgggcacacgagcacgatctccccatcgcgattgagcccacccgttgtgtctcgatgcacgggcatcgctacccatgactctccgacgaacgcctcccacgcgagtggcggatcggtcggatcgacaccgatcccctcgatcgaggctcccacgttgaggcgaatgacggcacccggagcgagtccctcgaatccgaagtacgtcgcgtcaccgggtgcaagcgggtccgaggtgaagcatcgcacgaccccgccctcgaagcggaggtcatcccacacgtcgcgaacctggccaccgccgtcggctgtggcggtcatcgcgccaatcagggtcggggggcgaatgacgagatcgtcgatggtggagaagagcacctccggctgccccggtacgggggcggtggcgacctgggtcccctttggcacgacgacgtcgtgctcgagaacggtcgagagccaaaagaccaggtcggcatgggctggcgccggtgggaatgggctgatgccaacgaggtcgaggaacttcgtgtagagccggtctggcacctgattgatgcggtagagcacggtctcgctcatccaggcgaacagctcgatgagcgcaaccccgggatcggagacgttgtggttggtccactcgggacagtagcgcgggatcaaacgcttggcttcgtcgacgatgtcctgaaagcggcgatcgtcgagttcgggagtcggcagccccactacccctcctctcgtgggatggtgtagaacggatagacgagattgcggcgatcattcgtcgcacgaagacggtaggtcacggtgatgtgcaccaggctcgcatcgttgtcgtcctgcgccacggcgacgttctcgacgtcgatccgcggctcccactgtgccagtgcctcacgcaccgcctgagccatcaaccccatcgtgttggcgttcaccggctcgaacaacagatcccagatgcggcacccgaacgccggacgcatgacccgctcacccggcgccgtggagatcacgacccgaatcgcggtatcggtggagccggttccgtcggacagcgcgatgcctccgcggacatcgacccgcatcggaaacgcgaagccacggccgacgaagccggggtcgctgacgctggcgtccgtcggatgctcacgcgtcgccacggcgcaccgtcgatctcatcacgcgagcacctagaggacgtcgggtcggtgacgcaacccgcgcgcatcgagttcgcgcgcgagacgccgctcgacctgctcgaccaaccagtcgaggaactcctcggcctgaggagcgctcgacggtcgaaccggtcccgcctcctcgaccatgcgaccacctcctatctcgatccctgaaccctcgccacctcgccgccgtgtggaccccggggattcggacgcggccatcatcgccggcgcagctcgcgtcgcgactcgggcatccgacgacccttgggacactgatgacgaccctcggggcaacgacgtcgatcgtgcatagagcgcctgaaggtcagcgagcaccgcgtcatgctcccgagaagcgagtacgtcgccaccgggtcccatgggtggcgcgagtaccggggtcaaccccgtgcccgacggctcagggttgtgcgcacgagaaccacgcggtggcggcggcatcgccgcgagcagacgccgctcgtgctccccatcacccgcctcatcgccgaccagtgcacgcaccaagcttcccactcgcctcgcgtgccgctcctcgtcatcgaggtgcggatcgtcgaacagtcggggggcgcgtcccgtgtcacccgaggccacgtgcacaagttcgtgcgcaatgacgccgagtgcacccggcgagcggtccacggggcgctcgagaaagatcgtctgcccgaccgtcgcggcaaccgtcccgagggcgcgcaggctccgacgagtgagcgggccgctctgcacctccaccggtccgcggacgcccagcgcgctggcgaggggttccagcacggccggaagcggctgaacggcctctcccggctcctgcgaacgctcccgagggccctgccaattcgacctgaccggtctcgatcctcggcgcgacccgacatcggccatgaccgcgtcggatgcgctcgcgaagagccgaccgtcggactcgactccgcgccccgcgacctgcgatggtcgaagctcgcggccccgaggtcgtgacggccctgaccagccaaggcccctcgtcgcgaccaccccatcactgagcgcacgtggcatcgagccgagcactgagagtccctgcgcgacccatccactcgatgcaagcgtggccacaccacgttcccaccgacgacgaccgcgcgacgccatggtcggccacgacccgagcgctcggcgaaccccaccgtgccttcggacggcctcgtcgtcgccgacgaccgagccgtccccagtcggagcagctggctcgccgatcggcacatcgaccctcacgcccctcgaagcgtcgacgcgacgcagttggcctctcccgcggaccgcatcgattgcgtgtcgacgagcggcgagtccgccatcggacagcccgatccccgagctccccgcccgtcccgccgacgtgcgaacgtcgctccgtcgaccgccggactcaaccatcgaacgcctcgcgctcggcacgcgagcgcccgtgctcctcgcctgggactcctcgtcgaatccgatcgaacgcagccagggggtgcgccgacggaccgggcgcagcggccgaccgggaggcgcgccgcgctcgcggccccgacgaaactcagaccgaggaaaccgcgacgtgtactgccagagcggccctcgctcgcccgccctctcgctgccgtgccgagccagtgcggcgtaggtctcctggcgtacgagaccgtcgagaatgaccgcagccgcctcccaaccagccgccagcgactcgccgaacgtcatagcgtggctcgccccgtccgaggttgcccctcccgccccaacggcttctcgatccgtgacggtgcgaccagctgtcacggcgtccaggagcccgaccgccgatctcggcggccgatcgcctccttcacgtggtgccccaggagctccccgtccttccaggccaggctcagggggcgatgctccatcgcgatgctgctggcgttgtgccccctgttcggcctggtgtcgctgcggcgacgcccctgccggagtcgtggccgtcggcgtcgaaggatccgagctcgatgcgggctccgcggacgcgccactgcccgccccggcctccccatccctcgcgctcccccgcgatcctcctcgacgagagggtgccacacgcggcgcacggtacgcactgcgcgatggcgaaggcctcgccgccgcgcgcggacgtcctcgctcccgatccgacaccacggtaccgacagctgcgacatcgggcacgagccgaaccggcaagacctcgcgtcggagcctcgccaagcctccccctggtgcgtagggggtctgctgccgagccgtgacgcgaggaaggcggcccgcgtgcgccccaaccgcatccgccagcgccgacgcgtcgtcctggccctgaccagcaagccacagccgcaggaacggatggccgagcggacgaaccgggcgatcaccggtacccgccccaatcggcaacgaagggccaatcgccgaccgcagcgagagaggccgaccgacgatcgttgcgtggcgcaccgaccgcagtgcgagggcgccaaccgacggtcgaggccgacgcacgagcgaacgatgccacccgaaccgtcgctcaatgccggccacgaacgtcgacacggtggcgtcgtggccgctcatgatgcgaacgtcttcgacgtgaagccctggtgagcgacctcgatctcctccatggcaggaatcccatgcgcgtcgaccgccaacttcggaccgacccaccgcacggcgaatgcccccgtgatctcccaggagcgcagccgacgaccgtcggaagcgatcagcgtgatcgcagccgtcgatcgctgcagcttgttctggttcgccgcgaacgccggccccgaggaccgacgaacccaatcgaacagtgcgtccgagcgacaaatccctcgccgcagcacgatattcggccaatggatctggcccgggaacttgtgtgtgaagccgttctgtccgccttcggcgaactcggcgacctcgacggtcatctcgagtcccgacacctcagcgaacatgccgatctcggtgccatcgacctcaagaaggaagctggaggagtcgggaatatgcccatcaaagcctgactgcgtggtcacgagagctgtcgtacctcctcccatgctcgtgcgttcagcgcggcgaccccttggacgagcctcacacggtcctgatgctccagatcgagcagatcgtcaagatcccagtgcaggtggtacgccaggtagatcacctcttgccagaggacgtcgatcggatagtgcttcatcgcccgttctgcggcacctcctcgatcgctgcgcgccgcccaccagcaggtggtcgcggaggcgactccgatcccgcggcagccgtcggaggcgtcgtctcggacgccgtagtctcgggtcgaggactcgtctgcgactcggctcgctcctgcgcggccaagagcgcctcgatgtcctcttcggaaccaaagttgatcacgccgtagaagtcctgcaaatacgcgaggtcgaccgcgaagaggtcttggatctcgttgggtgtcacgagctcgagatccccaagccgctccaccacgcgcgccaagaccagaatggtcaggcgcggatcgtccgggccgctgatcgtgggatcacggagcggctcgagctcgtcgcgagccgtcgcaaggcgcatcacgccacggcgacgaacgaccccttggtcgtcgatgtagcctctcggcagaacaaactcgtagcgcgtccgcacggcctacttcttgcgctcgagcttctcgtactgcaaggtgatggtctcggtggcgacgtcgttcgccgaggcctcgaggctggcgaactcgatcttcgagggccaggcgtcgtagaagttccagcgggccgtctccgagagcgccgaatcgtagacgacgatggagccgtggcggcgaggcttgttgcggttctggacccccatgcccttcgtgcgcaggtcgttgaaccacttccagatgtcgtcgtcggcgacgttcagcggggcgacgcgcttcatggtgagctcgccgttccacttcggcttgctcatgaccttgtgctggacgagctgggcgcccttcgtacgctcgttgaagtcggcgacctcgatctcgacgctcaggccgtcgatgctcgtgacgttggtgacgtaggcaccgtcgatctcgacgaagaagttcgtcgtggtgagcggatcgttcttgatcaggttgaactgggccatggtgctcctttctccttagccagcgagctgcttgtgctggctgatgcggaagacgacgaactcggcgggcttcaccggggcgatgcccacctccacgacgagacgaccctcgtcgatgacggcgggagggttggtctcggcgtcgcacttgacgtagaacgcctcttcgggcgaggcgccaaagagtgccccgtcttgccagaggccgccgaggaaggcggtgagggttcgggtgatgccctcccagagggtgacgtcgttcggctcgaacaccgcgaactgcgtgccgtcgaggatggtggtctccaccatgttgaacagacgccgcacgttgatgtagcgccagtcgctgtcggaggagagggtgcgtgccccccagatgcggatcccgcgcgtgccgaaggggcggatgcagttgatcccgatggggttcaagagtgcctgctcgttcttcgtgatggagcgctcgacgtccaagcacccgcggatggtgtcgttggccggggccttccacacgccacgggtgtcgtcggtccgcgaccacaccccggcgatgtgaccgctcggcgggatgagcacctcgctctggccgttggtgccgacggggttctccactcggatccacgggtagtacatggccgcgaaggccgagtcgtacatggcgacgtcgctgcgccactcgcgcacctgctggggggtcatgccgggcggggcgtcgaggatcgccatgcggttgccctggcgctcgcagtggccgatgagggcggtctggacggccttccacatggcgaggtcgatggtgccgtcgggacgggtcgccgccgtcacgaggtcggggacgatcaccatggtgacgtcgtcggcgatggtgaggccattgatgccggtgcgggcactctcggagcctgcgaagcgcttggggctcacagggacggggtgcggggccggtgccacgaggggataggtcccgggacgcatcacctcgagcagcgacgagaggtcgacggcgtcggcgaggtccacgcgcacgcgcacggtgtgggaggcggcgttgacgaccgtggcgacgttgcgctcggagtcgtcgagggtgaggttggtgaacgactcgatggtcgtgccgtcagggccgacgatgtcgaggtcgaagggagccgggccgtcggcgtcggcgtccaccgtgcgcacgactacctggagcggagcgccttgttccaggctctcgacgtgcaccggggagccgagggcacgatcggccgcagggagggaggccgtcgagggggcgtcagcgggctcggtgttcgggatccgaacgatgtaggcgatcgtgccaccgttctggaagaagccgtagacgctgagcggcagcatggccccgggggtgaagctgccgtagagctcctcgaactgcgtccagctcgtgacgagacgagggcgggtgccctcgggatcgctcgggtcgtcgttcggggcacgctcggtgaagcccacgaaggccgcgatcgcggtcggggcaggcgtcaggctcttctgcgcagagggcatttcctccacgtagaccccaggagcggcgtacgtcggcacgatggttcccctttccctcgccctcgagctgtcctcgaggaggttcactcactccagacactcactcacagcactcgcgaacgacacggcacgcatgcccgggggccaccaccgcaggccatctgcgagctcgcgtcagagcgacctggtgacgtccggcccgcaccatccgacgtcaacgaaacgcttcgacgccatcggtccgacagggcgttgccacaagaccactcagcgtggccgataccctccacacacacgtacttgccacgtgacgttatcagagtgtgcgggggtggtcaacagggggttgtgaactgctccagcatgagtctgtcatacaccaagtacgtgtgtgttagtgatacagtggcgccgtgaacctcaccgagtgggcacgccgccagggtatccaccctcagaccgcctacaaccggttccatgcaggcacacttccggtgcctgcggtgagagtgaagcagcggaccatcctggcccagccagacgctgccaccactaccccgagggacatggtaggtctctctgcccgcgtctcttcgtatgaccagcgaggtgatctcgaccgtcaggtcgcacggctgaccgagtgggcagcgaaggtcggcctgccgagagcccgggtggaagcagaggtcggctcggggatgaacgggtctcgacccaagcttcgacgcctcctcgctgatccgcaggtcaccatcatcgtcgtggagcacctgaccgcctggctcgcatgaatgtagaactcgtcgaagcagcacgctcggcccatggccgcaggctcgtcgtgatcgacgacggcgaggtggacgacgacctggtgcgggacatgaccgaggtgctcacgagcttctgccccagactctacggacgcaggtccgctcgtagccgagcagagaaggccctgcgatgtgctacccaggacatggggccaaagccccctccaagaaggcaatgccatcgcgggcgtctcacctgaaggagcagagcaagccgtgagcaagcggcttcgcgcgatctctccgccgttcgtggtagcgccacccacaggtgttcgtgtgcgcaccaggcttcaggtgactgacgtcgatgcagcggtcctcatggcccttggtacctacctcggctcccttgcatcgaatgacctggctgagcgctgccgccaaggagagctcgatgccaagggcaagactgagtctcgtcgtgagcgcaaacgagcgctgacggccctcacgtcctctcggtgggcgggaacgatcaccagaacgagcgaggatgccttccaactcgccatgggcaacctcgaagccgaacaacggagcctccgggctcggatcgcccagattcgccgtcgtctcgcggtgcctgcgggaacacgacgtggacgttcttacgggtatcccactcaggccgagcggttccagaagcaacgccgtctccagatcctcgaacaccgcctcgaggtggtcgaggcccgcctggagagcgggcgggtgtccatctgtcgtggtgggaagcacctggccaacgtccatcaccacctggacgaagccggactgactgacgatgcctggcgagagcgctggcgagctgagcgctggtttctcaccgcggacggggagaaggacaagtaccttggcaacctcacgatccggtggcacccagatgagcagtggctcgacatcgcccttcctagggcgcttgcccacctcgccaaccggtcccgaaaccgctaccgactctcatgcccgatcagcttcccctacagaggggatgaggtcgcagctcaggccgtgaatggggccgtgcgctacgacattgtgttcctgccgcagaaggggcgatggtatctcgacgcatcctggagataccccgaccgtcagccactcaccatcgagcaggtccgagagcatcgggtcatggccgtcgatctgaacgccggacaccttgcaaccgtcctcctcgacccgtcgggcaaccctgtcgggcgaccggccaccatccccattgtcctcgacgggctgccagccaccacccgagacggccacctgcgtcaagcgatctctgacgtactcaccatggcgaagaccggcggtgctcgggccatcgtgatcgagaacctggacttcgccgagtccagggacataggtcgagaactgcatggcaaccgaccatcgcgtggcaagcggggcagacgctttcgccgcctcatcgcaggcatccctacggcgaagttccgtaacctgctcatccagatggccgcgaacaccggaatcacggttgtcgccgtcgatccggcctacaccagtaggtggggcgccgaacactggctcggcgccctccaggaaaccttcatcgatatctcgggccaccatgcggcggccctggtcatcggaagacgtggacttggacagcgagcacgacgaaagacgaggtgtgacttgacccgagcagagcatcgggaagagagagctacccgcccggtcgtgggggccacgggtgacgggggaccatcactcctgtccaggcagcgcatgaggggacttgggacccgagaggccagagggcagccacagacgtggcagaagacccgaagggccgaccggaccaccccggttacccaggtggcccaagaccgttcggggccacccacgaagcgggacagagtttcgctgagtgtctaggaacggtgaggagatgttcacgatgaacagcccgcactggcatcatcacagcaccacggtggggagcacactcgacggctttctcgtgactccacccccgcctgaaggcgggggcttcgggtgcgctgttcacgcacctgcggttcctaccatggcaggaaccttcgcggaaacgccgaccgccttgcgacgatcgcgaacactcgaaccttgctagagtcagtggtcactggccaccttggccgatgctgcggcgcgcggccgcagaagggggttggcgatgccttcctggtttccatggcttcggcgtcggcggcccgccgcaccgcaagtatccgcacagacatcccgtcctcagtggcagcgtgtgggcacaccctcaaccgatgggcgtgcctcgcgaccgtcaccacaacaggtgctcgccctccaacggcagctcggcaatcgcacgacgagcatgcttgtcgacaactccggatcggcgccgggtgggaactacaacaacaccgagaaccagcctctctacgaggacctacgccatgtggtcggcgaggggcaacagcacgaggcgccgggtgggaactacaacaacaccgagaaccagcctctctacgaggacctacgccatgtggtcggcgaggggcaacagcacgaggcgccgggtgggaactacaacaacacccaatcgtcaccttcgcagtcccgcgcaccaagctacggcaatgacatcaacgagttgctcgcaacagtatcaagcaggccgccgtcggtggaggcccaagagaaggcaacctccctatgggcccttgacgcacacctgcgtgccaagcacggcctcgcaccagctttcccctcgacgaagcagctcgccatgcgcgagttcaccacgacgaagtacctcacgccgctcgagtcgcagtcgaagaccctcgcgtttcgcggtggcctgctcatgcgccgtgtcgccccgggccccgaccagccaccgggtaagtggcaactcgagccctatgacaccacggacatccagaacacgatgcatggcaacgagtctgagcgaggccaagccctctacgtcctctcccaaggtggcacgctgctctcggcaccgggcaaggtacaggagacgcatcactccacgctcctcgcaggcactgaggtggcaggggctggcatgatgcgagtcgagaacggcaagatccgctcgatctccaacgcgagcgggcactaccgtcccacggccgactacttgcgcaacgttttcaaggtattcgagcgcaaccacgtcaatctcgacgagatcgaagtcgaggaagccctcaactccacctgcaatcgatctcacctgaacggtcatcgccgcaactgggcatcggcgacggaatggctcgccttccacgacgaaccggccgaggacacgcaaggtccaccgccacagtcgatcggttaccagtcgtccgcaccgccctcagacgagtagacccggctacagctcggggctgtcgccgtccacggtgcgcgagccgaagttacgcggccagagacgctcgcgttcgtcccgatgacggtgagcgctccgctgccagagctcgatccagctccgtccttctggaacgaacgtacccttcgtccggcgcgcttcccagaaatccgttgcagcctcgcgaccggcaagcgcgagagcatcggcgatccgagcggtgaacgcaccgggacgctctccctcgcgcgccgtgagtggttctccaacgacgatggtcgtcgagcccggtcgcaggcggcgttgtcccttgccgaggatctcccacgtgccatcgatgaacaacggcacgaccggtcgtcctgttcgcagcgccacttgtgctgctccagccttcggctcctgtggcaggccatcgggagttctcccgccctcggggaacagaaggagattccagccctcctcgacgagctgctcggcgagttcggctgagcgccgagagactcgctgccgctcgatggggatcgcaccgagcaccagggcggaggcgaacgccttcgagggacgatcgaagaagtagtccgctcccgcacccacgacggtccgatgccgcaccctcgccggcagaaccgacagcacgaccggggtgtcgaggtgactctggtggttcgccacgaacacgaccggctcatccaaggcgtcgagaacctcgcccgcaatgagacgaggacgcgcgatggctcgcaccccaggtaacaccaccccatcgagcaagacggcgcgagcgacccgcaccgagtcccgccgggcaaaggacgtgtcgaactccacgcccgtccgcgcagttcgatcaaacggaagctgcccaggcgggctcggagctcgtacgacgaagcggacggaagcgggcagcttcaccgctgtccctccgatacgtcggccatgaccagcggcggactgtgcaggtgggtgatcgatgggttggggccgacgatcgaccgcgccatctccagagcatcgtcgagggtgctcgccgcctggaaaccgaggcgacgagctgtcttcggatcaccgccgagaatgatcacgccgccaaggtggtcgagggcatgtgcgccccaataccacatgtagaacgggtgcacgccgtggtaggcgttctgcgtccgatacaaatggatgtaccaggggtcccgcgcaaagctctcctcgtactttgcctcgatcacgaggggatccgtcgtctcggagagcacctggtcatagaagtcgatgtagctcgggtggaacgctggatcgaactcgggcctcgtcggatgcgccatgatcaagactccgccacgacgaaccaagggacggcctcgatacatgttgaagagatagccaagtcctaggcagtagacgaggatggggttcatgatcgagttcacgttgtagggcccgacgaagggaaggcccatggtcaagatgtcagcctgcccctcgacgggcacgagctgctggcgatagacccgctcgatggtctgctcgtgcaccgcctcgacctcaccggcggcgacgcccgtcaaaccgtagggcgatcgaacgcgatggaagatctcccgcgcgagatgcggcggagtgcgtcgcaaggactcggcgacggcgacgtagctcgctcgatcgcgaaggtcccactcccactcccgtcgattgaggaaccgaaacgacgatggaaaggtgttggtgttcagcgtggtctcgatctggaaaatacgtatgccgctacgggcgatgagacggcccatgcgccagttggaggagtgcagctgggagttgtgtcggtccatgaacgaccgcgagtgcaccatcgtcgtgacgttgtgatgatggcggatggagtcgtagctcgcaagcccagttgcaacactcttgtggcccccatccatggagacgaggttgatattgacgtacacgagcaagtcgctctcgaccgcacggcgattgagctcgaccagctctccctcgtcggtatggccgacgacgaccatgttggccttgtcttcggcatcgtgctgggtgatcatcccacgcggtgcaagcgcatcgtagacccgacgaccgagggcatgtcgaagttccgactccgtcatacgccgatgcaaggccagagccgcgacgagctggatatcctcgacccccttggcggcggcgagctcgagaacctcctcaatgacgaggctgcggacatcgggggcagccatctgcggcagcgggagcgacacgtcgtcgaaggcgatcgtcagtcgcatccccggaaagagcagcgcttcgagcggctcggcatcgatcgggtgcgccagcgcatcgcgaatcgccgcacgagcgtctcgaactgccggcagcggatccggaggatacaccacccgtgatcccgcagggagccgctccagccggaaaccctccccataccagaacagggtcgggggcgtcgctcggtctacttcgagtacgaagccaggtcgatatgccacttagcgtgccttcctttggtgaagatcgaagacgaccttgattgcatcggcgcgacccccttcccgagccttcgcgatggccgtgacgtagtcgcgcaggccatagcgatgggtcacgagtcgtccgaggccaaggtccgcggcgagacccatcgccagatcgaacgtgcgtaccggaccggcgactcgtcccaaggactgggcgatgtcgggttcgagcacctcggtgccgtaggcgtatgcgccgatcagtcgcacctcccggtgccacaagggtgcgagatcgagacgttggggcgacggcatgcccgccacgatcacctcgccacccggtcggaccgactcgatcgcgagctggatcgaactggcagagcccaccgcatcgatgacggcatcgaaaccgtcgccgaggaagcgccctgctcgcagtgttcctcgcagacgacgtgcccgctctggtagctcgcgctcagtcacgacacgatccgcaccgaacgcgctcgcgagctcacgttggagcgggtagcgtgcgacgctcgtcacgctggcaaagctctgcagccgagcggcgacggccgtcgcgacaaggcccacggtgccagcaccgatcaccgccacatgcccgtcacgccgaccgacgctcaagacggtatggagaccacacgccagtggctcgaccatcacggcgtccgcatcgtcgacctcgtcaggaaccgcgtgcaacgtggcctcgtgcgccacgaactcgctcgcccaaccacccccggtcgaggcacagtagccggtctggatgcccggctcgagatcgccgaccgcgatcgacgcacagcgctgcgtttcacctcgttggcacgcgtcacacagcggcacgccccgcacggcacacgtcaacgccggctcgacgacccaccgacccgatcgaccctccgcgtcaacgacgacttcgtgccccgggatgaagggcagcgagacgagaggctcgaagtagcgcgacgtctcgaagaacaccgatgcgaggtctgacccacagatcccggcaagccggggccgtacgcgcacccagttgggcccaggaagctccggcgggtcgacgtcaaccaacgcgagtgggccgctctcgatcgcccgtcgcgtcgaggatccagcgagcagacgagccgccgcgaaccgcgctggccgacgttcgacctgcaacgccctcatcgacgacctccgatgggcagcatgagcgacgggaacccagaggcacgttcccactcctcgatgagccaaccccgccgcttggcaagcgcgcgcagcttcgcatccggattcaccgcgaccgccgtacccgctgcttcgagcatgggcagatcactggtggagtctgcgtaggcgatcgtgtcagcgagcgggatctcgtagcgggccgcgagctgacgcacgaggtcggctcgtgcctccccaatgggcagcgtcccgggcaccgtaccacttaagcggccgttcctctcaggcatgtccagggcgatgagctcgtcgaacagcgggcggaacggctccatcgcaaagcgcagcgcaccggtgacgccgaccgtcacatgaccggcggcacgatgttgccgcactctggcgaggccctccgggaacgtcttgcgcaggaggtagcccgtcatgagatccggagccagcttggcaagctcggcaggatccgcatcgcggtaacgacgatagaagtaccggaggaagtcggagcggtcgcggccgtcgagccgcaacagcttcggcgcctcggcgagcaggctcgcgacgagcccgaaccgatccacggggcgcagcgcactggtcgcgacgaaggcgaacgagtccaccacgttcgctgcgaccaaggtgttctcgagatcgaacacggccaggcgtcgcccgcgcagcagaccctcgcgtaggcggtcgtctcgggagcgtcgcggaccgcgccggggattcgtgcgcgcgcgagcgtgctcgaccacgctcggcaggtggacgtcgaggatgaagtgccgccaatcgatggccgccggatcgacgagcacgccgtcgtcagcgctcgcgagggagacgagttctacgagccgttcggacccgtacatcgcctcgcactcggcgtaggcaccgtagagctcgacgtaggaacgagcccgctcgagggcgtcctgcgtctcgacgagaccatcttgggccgagagcatgggaccgcgaagcggcagccgccccaggaggccgagcaccgccccgacggcccgcctggtgcgctcgagacggcgttcgacctcccctctggctgggtaggtccacgaaggtatcgcgatggcttggcccttgtcgtcgtagagcgggtgttcggcgaagtactgccggatgagcgagaccatcacctcgtaacgaagcgggttcctcgtgcccgaggccgcgtggtagtacgccatcgcccgggggggatgagcagcggcgacgagaaccgcgccgacgacgaagtccacggggatcacgtcgaccaccgtctcggccgacccagggaaatcgcgcagcagcccccgcgcgaacgagatgatgatgggctccgccatgcggaaccctcgaatccaacccggtcgcggctcggcgtagctcgactcgatgatcgaggggcgcacgaccgacaccggggtgcgctgacggcgctcctccaggacgcgttccccgagcgccttcgtcatggcgtaggcgtccggccatcccaggctctgcgctcgcgcccgacccagttcgaccatacgctcatggacccagtcgcgtcgaaagcgctcggtgcgttcggccacgatcgcgacccccgcagccccgagctccgccagcgccttgcgacggaacgtttcgagccgctccggctcgcgagaacgatgctccgtctctcgacgcagagccctggcagcctcgacctccgcacgccaatccacgtccggatagtgcggctgcgtgcggagcgacgcctcgggtgcgtcacccttgcgcgagccggcgacgtaggcggtcgagatggcgacgaagtggcctggcgcgagatcggcctcggcacgtgcctgctcgtacgcctcgagcactctcgccggcccgagcaggttgatctcgacggcagcatcgagtgtcgcgtcgaagctcaccgtcgccgcggagtggatcacgatgtcggctgcgccaagcaccgaccgtcccgcagggtcgagaccgagaccatcacggccaacgtcaccctcgacgagcacgacccgacgagcagccatgtccgcaaacgcatcccgaccgagctcggctcggagtcgatcgaagcagctgttgccaagcagctctcgacggaggcgctcctcggcgctcgtcgtacgaccgcgtcgaatcaagaccgcaacacgagtctccgggagcaaccgaagaacggactcgacgatggccgtcccgaggaagcccgtcgcgcccgtaaggaagatcaaccgacccgccaaggactcgcgcaacaccccgacctagcctcctcaagcccccaccgtggggctcatcaagcctaccttcgggcactcacgacgaggacgtgccccgacgacgcaccgtcgccctgcgcttgggcggggtgtagcgcttcgatgcggttgtcggccgatgcggcaacaaggtcccttctgtggcggcaccatcgccagtcttgcccttgccgctgcgtcgtgcttcacgagcagctcgacgagcagcgacgacctcgggattggccttgaagccgacgaagacgccccacgcgaggatcgggaatgcggcgatgacgaggttgccccaaccggcgccgatcgcgacgagcatcgcaaacccacccgcgatccgtcgccggtctcgctgaatcatgatggccgtgatcgccatcaagaccagcccctcggcaagaatgaactcagggttagcgaggatcccgtggcccgtgagcttcacgtggccatcgaggactgggatccacagcaccgtgtacaccacggcctcgatcagcacgagtgcgtagccgatctgtcgttctcgacgagagagtggcatggcacggcgaagggctgcggtcacgggaccagtgtagtgcttgctactgcccacacttggtccccgcgaccgcgggctaccgatccgtcaccgaagtgtggcccttccgtcgagcgcgagcaaccgcaccgtcacccagggctctcacgctggaagcgtccctggaagacgacaacgggaggtcactgtggacacgcatcaaccgccaagtccgtatgaaccggtcgacgaggctcgactgaaccgcttccactggcggtcgctcttcaccactgggatgggcgtgctcaccgacggctacgacctgtcctcggtcgggatcgtcttgccacttgcgctggcaagcttccatcagcactcactgaccggtgtcgagagctcgctgctcgccgggtcagcactcgtcggatctgccgttggcgcgctcgccttcggcttcgccgcgaaccggggccgcaagcgcttctatggtctcgacgtcacgatcatggccctcgcagcgctcgctcaggccttcgcaccctcgatcacctggctcatcgcgatccggttcatcctcggcatcggcgtcggagccgactacgtcctcagtccgatgatcctcggtgagcacgccaatcgccgagatcgcggcaagatcatggcgctgggcttcggccttacctggaccgtcggcgcggtgatcgcaagcatgctctacctcatcctcgagggagcgggcgtcgcgcctgatctcgtctggcggatcgtgctcgcggccggcgcactaccggcggcatccgtgatctacctgcgacgacgccttcccgaaacgccgcgctttctcctggccatccgccgcgaccccaccgcctatgcagccgtcgcacgcgaagccagcggcgatcgcgtcgcaccgcccacgcgcctcggcctgaacgaggacctcaagtcattcttcgcacgtcgttggcccgccgtcctcgcagcctgctcactctggttcttgttcgacatcgtcgcctacagcggcatcctcttcgggccctcgttgatcgcgaaggggatcggcctgacgcccggaacgttcaacttggccatggagctcgtcgcgacgatccccggcgccatcgtcgggctcagcctcgtcgatcgggtcggtcgtcgctggatgcaggcgctcggcttcgccggcatggcagccttcctcgtcatgttcgccgcagcgcacgctgcgatcgccgcagcaccgcttgtcggcgcattggtgtacggaggcgtcaacttctcccagcaagcaggtccaggatcgatctcggcttcggggcttctcggcgtcgaactctcctcgacacgagcacgcggactcgtccaagcgctcaccgtcgcctcgggtcgtctcggtgcctcgctgacgtcattcgtctttccagcactcttcgcgacctggggagaagatgccgcactcgtgttcctcgcgggggtcgcgatcctagcgctcgccatcacgctgctcgcggtccccgagacagcgcgacgcaccctcgaggagaacgcaggcgaactccttcccgccggcgcagcggactgatcagacccgccgaggcacgcaccgacacgctcagctaccgctcggcccgcccgagcggtagctcgtgtcgcggggcctcgatcgggacagcccgcgaagcgcgctcgaccgcgccccacgcgcgtgcacagcgtcacgatcgtcacccacgtgtgctcgtgtgtcgtaaggcttcggcttgcgccacgccgcggcccctccccgaccactcccacctcttcgagcaggcagaaccgggttggacccgcccgctaccgcgacaggcgtcccacgtcagggctcaagcgccaacgggccacccgatccgaccgagcgtggagcgaaggacccgtcgtggcgatcgaagcgcggttccaccgggtgtcgtcgcaccggtgacggcgaccgcccaccacgatcactcggcggctccgggcaagtcgagctcacgaagccgcaaacgggtccctggtcgggtccctgttcggctccaactccaacgtccgagccagctccatcgcggtctcatccccgcagagcgacgcaacgagcgcaaccgtcatgtcgagaccagccgcaatgccagatgacgtccagcgatcacgatcctccacccatcgagcctgggcctcccagcggacctgcggcgcttgctccatcacccacgccaacgctcgcttgttcgaggtagcccggtaaccatcgagcaaacccgccgcaccgaggagtgcagagcccgtgcagaccgagctgaccaacgttgccgccgacgcccacgtacgcagccatgcgaggaagtcatgatcgtcgaccagctcgcgagttcctctcccgcccggcacgagcacgatatcggcgactggagcatcagcgtaggtggtatcgacacagagtcgtggtccttgcgtgctccgtaccggtgcggtcgtcggaccgacgaccgcgatcgcgaactggtccgcgagcgcgccgaggagctccatcggtccacacgcatcgaggagctcgaaaccatcgaacaccaccacggccacctgctgcgacatgggatccccctcgactcgacacactgacgttaggccacggccgcctcctcgcggaccgaagagagctcgtcgccgacgcaagcctggcacccgagggccgacgacaggcagatcgtgtcggttcactcgacccagcgtgcgatggcgtggccgcctcggcgaggtccatgacgcggtggcgggcgacgagctcgcacgatgagctcgcgaggaaggtcccggcgacggcgttgtcgcaacaggccacgaccgtgcccacccatgccaacaccccgtctgccaccagagcgtccacacgttcgcgacgagccgtgcaaccttagtcccgaggaagatcgcacccgtgaggccaccgcgagtccgccgcgcagctccgatcacctcgatcgccagctcacatcgagcatgcgctgctcgagcaaccagcccttcgtccgcctcgagtcggctcaggtgcgattgcgaggcggctcgatccctcgccgcgtcggacgtcggtgaggccggtcgattccgagtcggcgcagatcacgctgacgggcatcacgtgctcgctatcctcgccccttgggcgatcgctggccgtcgcaggcctggcgtcagatgtcgatggatcgtgctgggcatcgtcgcggagagccgatcggccccgtcgtgcaaggcccagcgcccagagcccactgtcgcgctctcacgccgagtcgggcatcgctcgcttcgcacgctcccgctccgtgtcgagctgcttgcgctggcggcagaggcagatctcctcctcgcggtcggcgggctcgagcccaccgtccggccgtgcgtgatgtgctctgcggacccagctccaagagtctgccctcgcgccgagcccaccggaggcatcggcactgcgcggggttggtcgaggaccagtgccgcgacaagcgcgacggaactggtaggagcagcggcccgccgacgtcgagcggaaccgctgcccaggagtggttcgtcgtctgtgactccttcgttccgggcccagtacgtatcaacccggcagaggaacggcggcgaggcgagtgctctgtgactcgaggctcgcgaccgcgctgcctcgtgcatcaggcacactccccgtcgctcacgccagtggcgccgaggcccggtgaccactgcccacgcggacggccccgagcgcgagccccacgatcgcgccgacgatcgccacgccgatcgcgacgatcatggccacatgcagaccgctcatgaacgcagcgtgcgacccgttggtgacggcggtctgaacaagggccggtacttgtggaatccgcggtgcgagtccttccgcaatcaaggggcgcgctggtccgagtcgcgttgcgacgacgccaggcacacccgctgcctcgagcttggagatcagtacactgcccacccgattcgagagcaccgaaccgagcaccgccgttccaaggagcccaccgatctgcacggcggtcgactgcacacctccggccacgcccgcttcggcctcaggcacgttcgcgacgatggtatccgaggtcgtcggcatgacgaggccaatacccaatccgacgatgacgaacggaagtgcaaggtggacgagataggaggagctgaccccgagcgtcgtgagcagtgcgagcccaacggcgatggcagccataccgatcccgaccggcacgcgcggcccgaaccgaccgttcagcgcagcaccgagcggcgccccgaccacaaaggaagcggtcaagggcaaaactcgcacgccggccgctacggggctgtagccgtgtacctcttggagatagagggcgacgaagaacaccaccccgaagaaggcgaagaacgacaagatgaccaccacagcggacagcgagacctgtcggcgtccgaacatgccaagtggcaccaatgggaagcgagctcgcccttcaacgaacacgaagatcaccgcgccaacgattgccaacccgaagaagatccaggtgcgacccgcgagccatccccagctctgggccttgatcagcccgaagacgagggagaacaacgtaccggcaagcacgatggtccccggagcgtcgagtcggtcgggttcttgttcacgtgattcggcgaggacgaacaggccgaggaggatgccaatggctccgacgggcacattgaggtagaacaccgactgccacgagacgttctgcaccaacagcccagccacgatcggtccgccagcgatcgccaagccactggaagcgccccagataccgatggccgtgttcagccgctcgaccgggaaactcgcacgcaagatcgcaagcgtgctcggcatgatcagcgcaccgaaaccgccttggatggcgcggaaggcgatgacccacccaatggaccccgcgagccccacacctgctgacgcggcggcgaagcccagcatgcccaccaagaaggtggcccgtcgaccgatccgatcggcgagcttgccagccgggatcagcagcaccgcagtggtgagcaggtacgcgttcgtaacccactgcagatcagcgaggttggcgtgcaggtctctcgcgatgaagggattcgcgatcgccacgacggtcgcgtcgagaccgaccatgatcaccccgaaggccacgctggccagggcccaccaggggttcgcgcgaatcgtgcgcttctcttgtgtctccatgagcttgcctcctcaccggccgtcgacctgcgccattctggcagccgctgccagtctagcaattctgacagtcactgacacttccaacccgatgctcccgcgatgcattccgccgcgcgtacactgatgattccggaggagccatgacccgcgagcagacgaaggcgcgcacggaggcagagcttgctcgggcagccgccgaactcttcgcacgccagggcgttgcccagacaaccgtggagcagatcgccgagcgagcaggcgtgtcggagcgaacgttctttcgctacttcccgaccaaggaagatgcagtcctctcgtacatctggttgaaggcagacgacctgcgcagtgccttcctcgctcgacctgcgtccgagtcactcgccgaagcgttcctggcgtccgttcgagccaccaagacggacgacgaggcccaagcgaccctcgaccgcgagctccttcgcctccttcgcaacaccccgaccctacgggcgcgctggctcgtcgccggatgggaaaccgcggcagccttcacgccgctcgtcgccgagcgactcgcctgcgagcccgacgcgctcatagctcggctcgcgacgaatgcgctactcgttgccatccagacagcgctggacgtggtcggagagcatggcgcagattttctcgaggtgctcacggacgccatcggccggctcgccgatggagcgggactcgctacgagaccgctcgagcgcccatcagactcgcaacgatctggctgaagtggcgagctgcgatcgccgcaccgctctcgacgaggaacgccacctcgggatcgcgcaggcggtagcgccgctgacgaccatcgcgctccgtcgagagcaacccggcgtcgaccagacacgacaggtgcaccgacgttcgcccctgcgacagtccagtgatctgtcgacactccagcgaggtcaactcgccccgttccaacagggttcgcaccagccgcacccgcgtcggatctgcgagcgccgcaaacaaacgtgccagcacggcgtcgacgtcggcatccggacgctcgtccagtgcgacgccacctgtgagcgctatctccctcatgacacacccatccccaccagtcgatcgagcatctctgcgaggacctccggctccgtcgccacgttcacacgcatccagtccgaacgtccctggagatcgaaggtctcacccgctgagacgacgacgccagcgcgacgggcccacgcagccgcactctctgccccaagaccgagcacctgcacccagagcaggtaggtgccggcgggaacggacgtgcgcatccgaccggtgcgaacgagtgcctccgcagctgtctcgaggttgtcctggatgcggtcaagggtggactccaaccactcgccgccctgctcccatgcgacggcggcagcgagcagccccagcgacgtcggcgaactgcgaaagtgtgcatcgacctcaccgagcatctgcgcaacgcgtgtcgagccggcctccacgtgagccgccttgaggcctgcgatgttgaacgtcttcgttgccgcggacagaccgactgaccgctcggttgcggcatgatccagcgagagccagggcacgtggcgcacgcccgtgcgcacgatatcctgatggatctcgtcggcgatcacgaccacgtgatgtcgctcgacgacgtcggcgatggcggtgagttcctcgcgtgtcgccacccgtcccgtcggattgtgcgggttgcagaggatcagtgccttcgcccccgacgcgatcaaggtccgctcgaggcgctctgggtcgagtcgatagtcatcctcttcgcgaagcggaaccgtcacgacgcgacgcccgagcgacaccggcgtcgagaggaatgggggggtacgacggcgtcggcaccaccacgccactcccgggctccgtgagtgtccagagtgccaaggcgaggccgcccaggacgtcgccgaccaggagcacgtcccgtggctcgtagccggtgcgcgccttggaccagcgtgccagtgccgatcgataccgctcgtcgagggctcccgaggcgtagccgacgtcgccacgcgtcaccgcatccgccaccgttcgccgcacgacctccggagggagcaagtccatgtccgcgacccacgccggtaggagcggcgagggtgccagctcccacttcacgctcaggggacgacgggcacggagcgcgtcgatgactcgccctcgcgccgccccggtatcgatcggacgaccattcgagccgtcctgagggagatcgaactgctggtgagccacagcatcatgctacgcatcgacgatccgcccgcgagagtggcaggtcccccaaagggatgatgcgaatgtgctatccggatgcgcgggactgcagcgcagctcgaatccgcgcatcggcgagctcgcgccatgccgtcgagggttcgacccgcggcacatgcgcgcgctcgagcagccaagcggcgaggtatggattgcgtgcaaggaccgggccatgcaggtaggtgccgaccacgctgcctgcgacgaccccgtccacgcccccaacgccgttcccgacaccgacgagcacccgaccgagcgggacggcatcaccttcgagcgtggtgacgccgcggtggttctcgaagcctgtcagataggccccgaccgagatcacgggactcgtcagaacctcgccgaccgcacggcgctcgccgctcgccgaccgaaccggcaagagcccgagtccttcgtgctccgctccctccgcggcaaacgagcgtcctaggagctgcaggcctgcgcacaccgcgagaaccgggcgcccctcctcgacgacggcacgcagcgtgccatcgcgcgcaagcagccgagcggccagcacctgcgggccgtcctcaccgccgcccaagaggtagaaggcgccatcatgtggcaagggacgatccgatgacgcatcgacgacctcagcctcgtgaccagctcggcgaacagcagcggccaacaccaacgcgttgccacggtctccataggtcccgagcaggtcggggtagacgacgacgatgcgcaccatcatggcacggccctcgccgaagcactcgcagccaaggtggtatcgcggagcgcaccgagcgcacgcagcgacgcattggcctcccaaaacgctgtgtagttgccgacgaaggcgatgggcttggaagcgtcggcacggcgaagcgcctcacggagcgaggaggcctgccaaggctcgtgcccggccacctccagacgcaaggcgagatcttcgacccgtcgcccacacacgatgacgcgtcggggcgcgattcgctcccagggcgcatcccaaatccacgaggtgtcacgaccatcggcgatctcggcattgagttgcgcaatcacgtcaccgtcccaatctgcgagcagctcgacgagagcatcgaaccccgctggattcttcgcgagcatcgtcatcacacgaggcgtaccgggcagctcgaggacccgccagtactcgaagcgtccctcgacctcgagccgtcgacggccaaggccgcgcagcacgtcggcgaccggccgacgttcgagcgccccgatcgcaaccgccgcagccagcgcattgaaacgattgaacgtcccaggtggcgcctcggccaggctgagcatcccctcgggaccatgggcgttcccgtcgtctccgatccaccaatccggatccggcgacgcgaggccgcacccctcgcaccaccatcggccgtcctggaacgacacgtggccaccacagcggggacacgcgtgggcgtcgtcggtccaggtcgacgtcgggcgaatccaaatctgacgtcgaaatcgcgacgcgccgagcaccacgatggggtccagtgcgttcgccacgacgagctcgatcgaactcgccgcttcggcgatgcgctcggacagccggcggacctcgagggctcgatcgagttggtcgcgagtgaggttgagccagacgagaagcgagggccgaagcgcctccgccacgctcggcacgaacgcctcgtcgacctcgaagaccccgaccgtcgcctctcgtcgagctcgagccagtgccccagcgatgccgaaactcatgttcgcaccacggttggtgaccaccgcgcccgcggccatggctaccgcaagcgcggtcgtcgtcgacttcccattcgtgcccgtcacgaggatcgagcggagttgtcgccccgcacgttcgaggatgtgcgggtcaatcgccaacgccagtcgaccactcaacgcgccaccagcgccgactcccaacatccgagacaacgccgacgcggcctgcgcggcgcccctcgccgcacgctgacgagcactctccacgggcgtgaggctatcgaccgggtgggcgcccttgcgctcatgcccgacgcgcggccgactccttcggacacgcggcagaacgtagaaggagccggctggggggtagccggctccttaagtgtgcaacggtgttgtgttggggggaaccatgccgttgctgtatgccagactaccccaccagtccgcgaaaatccaactatggtgatgatatcgtgtatcactttttccgatagcctcggtggctcgccatggagttgcgccaacttcgatcactcatcgccgtccaagaggcaggcagtttctccgcggcagcggaggcgctcgccacggttcagtccaacgtctccgcccacatctcgaagctcgagcgtgagctccaggtcgtgctggtcgaccgcagaacgggccagctcaccaccgagggcgagatcgtagccaagcgggctcgccatctcctcggagagatcgccgagatctacgaggatctctcgctccatggctccgacgccacgggcaaggttcgcctcggcatgatcgcgacggtggcgagttggctcctaccgccgctcctcgaccggctcgccaaggaacatccgcgagtcgagctcgaagtcgccgagggcaccgcggcctcgctgcagcggcggctccagagtggcagtatcgaccttgcggtactgacgacgccgattcgctacgaggaactggtctttcgcgttctgctcgaagagcgctacgtcctggtcgcaccgcgctcccatcccctggccagcgaatcgacgctcaccatcgcccaagccgcttccgtgccgatgctggtcccgcccgtccacgtcgggttccgcgacgaactcgaggcgatcgcggcgagccggggcgtgcgcctgcgcgtcattgcggagatcgacggtctcaacgtcatcgccgccatcgcacttcgcggctttgcacctgcgatcctccccgcgagcgccgtcgaggtgctcgcccatcacgccgacacggtcgccgtccaactcaccgacgtccctcctcgccagatcggactcgcacgccaccgcaaccacctccagagcgcagcagctcgagcggtcaccacactcctcatgagcctcccgactcggatggcggcccatgccctgccggcaggcgtcaccgcccctcgaccacgaggagcggaggcccgacgctagcgcacgcttctatcaccatcgttataggagtatcgacttctacgcactcttccggggtgccatgtccggcccgtggcgtcgtggcaggatggagcggttcgttcctcggaggaggaacgctcgctgggaaggagcaccatggctgggatctgtgaaggccgggtcgtgatcgtgaccggcgcgggccgagggattggacgtgcccacgcgctcgcgttcgctgaacagggcgcacgagtggtcgtcaacgacctcggcgccgaggtcgacggatccggctcgtcgacagggcccgctggcgaggtggtcgatcacatccgaagccaggggggtgcggccatcgccaacggcgacgacgtcgccagttgggagggcgcgcagcgcctcatcaacgcggccatcgagtcgttcggtcgcctcgatgtggtcgtgaacaacgcgggcatcctgcgcgaccgcatgctggtcaacatgaccgagtccgaatgggatgacgtgattcgggtgcacctcaagggcaccttcgccatgacccgctgggccgccgcctactttcgggagcaagcgaaggcgggtgtcgcgcaagacgcccgaatcatcaacaccacgagcgcatcagggatctacggcaacgtcggccaagccaactatggcgccgcgaaggcaggcatcgcgtcgttgaccatcatcgcagcgatggaactcgcgcgctacggcgtcacggtcaacgcgatcgcccccgtagcgctgacccgcatgactgagaaccttggcatcgtcgccccggacgaccgtgcagcacaggccgaactcgcgccggagaacatcgcacccctcgtggtctggctcggatcgacgcactcggccggcatcactggacgagtgttcgacgtcgccggccaccatatcgacgtcgccgaaggctggcacgcgggcccaagcgcggaggcgcgcggccaacgtttcaccgtcgacgagctcgacgacgtcgtcccggccctcgtccgcgcggcacggcgcaacgccgacatgagcgggcacgaaccacccgaggcgcccaacgcctaagctccatgcatcgtgaccacgccccctgagcctgtgtatcgctcacggtcgatcgacttcgcggtgctcgagcttttcgccctcgtgagcgacgcgttctcgggtgcaaaggaggcgttcctccacgaagacaagggcatcatcgcccacctcgtcgagcgcgaacgcattatcgacggtcgatacctcgcactcgagcgtgaggtgcacgagcggctcttggccccggaccgcaccccggcgatggtccactacctcgtcaccattgtccgcatcatcccagagctggagcgctcgggcgacctcgccgagcacatcgcgcgcaagggtgcactcggcctcgtgcgcgagctccgaccccgtgcgcgaggtcttctcgaatcgatggccgagctcgcgctgtcgatgtggtccgagaccgcggtggcgttcgagcacatcgacccaaccgtggcgcgtcgagtcaacgacctcgacgagtccctcgacgacctccacgtcaccttcacggccgagatcgcgtcgacgtgccaatccatcgcgaccgcgatggatttggcgctcgttgctcggttcgtcgaacgcttcggcgatcacgccgtcaacttggctcggtcgacggcggcactcgccacactcgagagccctatccccaagggcgacttgtcgtccgcgtcgtgagcagccgctaacgaacgtcgagatcggctgacgagcgcgatcggcggcgctcttcgagtcgggcgcccagcgccgcgatctcacttcgatggtgcatgccgagcttcgacaggatgttcgatacgtagttcttgacggtcttctcggcgagaaagactgactcggcgatctcgcggttggtcttgccatcgacgatcagatcgaagatccggcgctcctgcggcgagagttccgcgagcggatcgtcccccgcatcctggggatgccggatgcgctcgaggagccgtaccgtcaacgcggggtcgatgagcgactcccctttggcaacgcggcgcagcgcatcgagcagctcgtcgacccggacccgcttgagcagatagccagatgcgcccgccatgatcgaggcgaacagcgcctcgtcgtcagcgtacgacgtcaacatcaggcaacgcagctctggtcgtgcggcgcgaagctcgcgacacagctccacaccactgccatccgggaggcgcacatcgagcacggcgacatcgggagcagccaaggggattctcgcccgcgcctcctcaagagagccggcctcgcccacgacctcaaagccgtcgtcctcagcgacgaggcgagcaatgcctcgacgcacgacctcgtggtcctccacgaggaatacgcgcaccacgccatctagcttatcgcgtggcgcggtcgtcggattggcacgcggccccgagcggctaggcccgacgtcgaacgacgaccaccgggatcggcgcgtggtggacgagttggtcactcacgctgccgagcagcaacgaggtgaagcccccatgaccacgcgcgccgacgaccaagagatcggcagtctcacactgctcgatcagacgtgaggccgggttgccctcctcgagcacggtctccaggtcaagatcgggttccagggcgcgcacctgcgcggtcgcgtcgtcgagcagcgcgcgaccggcggcctcgagctcttccacggcggagggagttggaccgtagccaaactccggcaccgtccacgagtacacgatcacgagcgtcgaccggcgtcgcttcgcctcgtcgacggcgaactgcagcgccgtgcgacccgactcggagccgtcatacccaaccacgacgcgccgatgctctgtgaatcctgcctccaccatcgtgtgcacctcctcgagctcagcctacgcaacggtcctggccaccgcatcggacgatagtcccaagtcgcagcaggccttggcactagcatcgaaccgtgagcatgcgggcacgactgcgagaccacgtcgcaagctcgcagcaagcccttgctcgggtcttcgacgagtcgagcgcgctcggatcgctgcggcgggcccatctcctgtccatgaccgccgacgccatgatgacggtcgcgttggctggttctctgttcttctccgtgtcacccaccgaagcgcgaagccgcattgccctctatctcctcatcacgatggcgcccttcgcagcgctctcgccgctcgtggctcccatcgtcgaccggtctcgtcagctccgccgatcgatggtgaccatctccgccgtcgtccgcattgcggcggtcctgctgatggcggcgttcctcaggactctgctgctgttcccactggcactgattgcgctcatcgcatccaaggcgtacctcatcacgaaatcatccctggtgcccgaggtggtcggcgacccgcaacctcgaacactcgtcgcgaccaacgcatcgctgaccctgttggcatccgtcgggggcgcactcggggtggtcgcaggtgggatcctcgccaagacgcctcacctcggtcccgcgtgggcgctcatcgccgaacccgtcgcgctgctctacatggttgcggccggtcttcgtcttcatcggatgctgccccaggcggtagccggagcgtcgcaggctcgcgagcggctacgcagccgccccaccggacccggatacgcgagaaccttgctcgcgtccctccttgtcgccgtacttcgaggtcagatcggcttctttgccttcgtcatcgcgttcgcgctcaagggcagatcggctccgacctgggcctacggagcagcactcgcagccagcgccatcggtgcgatggccgccacgcaggttgctccccgcctccgacgccgactctccgaaatccccatcaccctcggcgcggcgacactcgtctccctcgtggccatcgcggcaaccaccgcacatccagcgatcgtctgggccatcgtggtcatggggatcctctcactcgcagccgggtccgcgaagatcgccttcgacgcaaccgtgcagcagggtctgcgcgaagagcactacgggaggaccttcgctcgctacgagacggagttccagctggcatgggtcgtgggggctgccgcagcaaccttcgctcgcacgccgttggccagcggtgagagcctgatcgcgaccacggcagtggtcgcgctcgccgcctacgcgctcgcgaccactgcactgcgtcacgcccgcgagcctgagttgccaggcgaggggacatgacattcacctatcctcgcgtgcgaattggcggctgcgtgcatcgctaggatcgtgtcgtggatcgcggcctcgagagctccgtagcgagcccatggaggccagccctcatcgcggcgatcggcgcactgctggaaatcgccgtacaagtcatcggggtcgggcacggcaacccaggaatcttggcgctcgtcggaaccctgttcggatcgcgcgcccacctccccgcctggattccacaggttcgcgggcctggctacgacggacagttcttcttgcgcctcgcgctcgacccattcgacatccaccgccgagccttcggcatcacctttgacacgccgtaccgtgcccagcgcatcggactgcccttcctcgcctggctcatcgccggtggtcagcagcacctcgttgtgtggacactcccactgatcgaagtcctggcggctgcgtgcatcgccggatcggtcactgtcttggccggatccgaaagccgagccgccctcactggtgtcgctgccgccctctacgaaggctacgcgttcagctacggacgagatctcgccgagccggtcgcggcggcactcatgttgctcgcgattctctccatcgaacactgggaccggccaatcgttggcaccgtcctcctgcttgcatcgacactgaccctcgagaccgaactcatggcggttggcgcgctcggactcgtagggcttgcccgatcgctgcgcatgaggcgggttgaccatcgcctcatcgtggcaacggccgcggcgatcagttggatcggctgggacgcctttgtgtcgcacgaggtcggccacgtcaccgccgctgccgatctcaacgctaacttgggtgtccctctgctcacacaggtcaaggctgtcgccctgcacctccacccctccgctgccgacctggcgtggctcctccagctcgggctcctagtccttgccgtcgcaatcacgatcccgaggatctcgcgttcgcgtgcgccctcggtgatcaaggttctgttcatcgccatgatcgtgctcgcactgctggtgggtcccgctgactgggacgtcgaaagcgggtttcgccagttcgatctcgtctggatttcgagcctgatcgtcatcggcaccaccgacaatccgccggcctggcttccagcgctcggcatcgcggcgtggatcggcacggttcacctcgcggtcaacaccactgccttcctgcgccgtctctagcgagtacacgagaggcggcccgccggtcttgcctgaggcatgaccaattcggtagagtcacaccattcgcaccagcggtcgactagcgagtccgaggtgcggctggtgtgcctaggaggggatgggtgcctcccaggtccccgcccctaccggttggggtagggacggggctggtgtgcctaggaggggatgggtgcctcccaggtccccgcccctaccggttggggtagggacggggctggtgtgcctaggaggggatgggtgcctcccaggtccccgcccctaccggttggggtagggacggggctggtgtgcctaggaggggatgggtgcctcccaggtccccgcccctaccggttggggtagggacggggctggtgtgcctaggaggggatgggtgcctcccaggtccccgcccctaccggttggggtagggacggggctggtgtgcctaggaggggatgggtgcctcccaggtccccgcccctaccggttggggtagggacggggctggtgtgcctaggaggggatgggtgcctcccaggtccccgcccctaccggttggggtagggacggggctggtgtgcctaggaggggatgggtgcctcccaggtccccgcccctaccggttggggtagggacggggctggtgtgcctaggaggggatgggtgcctcccaggtccccgcccctaccggttggggtagggacggggctggtgtgcctaggaggggatgggtgcctcccgaagaaggcgaagactgcttgcaagttctcgcagacgctcggccgcctgagcttcgtgagagaggacgccgcgcccgtggcgctcgacgagggcatgtgcaagcgcctcggcaacgcgcgggcgcgggccaaccaaccagcgcggatccgaaccttccaacaccgcgctgacgagcgcagtcatggacgaggagtcggcccaggcagcatcaccgagatcagcgatgaatcgacgctcgtcgcccggcgaaccttgtggtcccaatgcgagggtggccgcaaccgtcgcgccccgcccgcgggccagctctgccgcgatcttgagcgcatctcccgggtccaccgcatacgtcaggagaaggccaactggcgccctcagattggccggtagtgcctcgagcaaacgacgcataccctcgctgggccgttgcccgaccaccagcgccccgtcaacccagccggcgacaacgatcagatcggcgtcgacgaggtcctcggtttcgaactgatcggcggggatgcagcgcacgcttggcgcaaaattcgcgagcgtctctcccagggaaagtgccgccgcgcgggtgtggccacccttggagtcgtaggcaatgagcacccgtggcggagccagtcgtcgaccgggcaacaccgcgttgcgaccgcctgcggcgagcatctcctccccgacccggcgcccgtgagccatcgcctccaccaccgttgacggtccgacgaggacatcaccaatggcccaggtgcgggcctgccgccacgctgccgctcgcctccgggcccgatcccggctccaggcgagatcaccgacacgcaaccctcggagcggctcacccgcgaagatccctgaggccaaccagtgtcggctcggcagatctccaacttccttgcgttcagcgagcccaggcaccgaagcgatccaggacggatcgacgcgatagcccatcgcagctaccactcgatcgaccacgagctcctcggcgatctcactggtcaccgtaggccgctcactcgcgcgctcctgcttcgtccgaacgaggagacagtggatcccgtcgtcgcgttcggcgaccgactggagcgtcacgccaaatcgcacctgtacgccctcggcctccgcttcggcaagttcgtcaggccgcacaaggctgaagcgctgatccatccaatcgatacagactgcagagccaccgcgccgtcgcaccaggcgcgcgacgtccatcgccgtgttgcccgccccaaccacgagcacacgatcatccaccggcggcaaaccagcttgaatcgccgcctcggccacggcgatctcgtcgagtgcgttgccgacagagatggtctcgatgccatcggcgcgtacgggcaacggagcgccagcaccaacggccagcaccacggcgtcgtagcggttacgcgccgccaccacatcgtccggagacagcgcggtgttcatctggaaagccacgcctcgccgctcgagacgctcgatgacccgatcgagaacgtccgagggcagcgtgaaccgcgggatcccgttgcgcagcaagcctccaggttggtcggcagcgtcgaccacggtgacctcgaccccggctcccgacaggacatctgcggcaccgagcccggccggaccgctcccaacgatcagtacgcggccctccttggcagccggcgtcgggtcgaccgcatcagcatggtcagcgatgtagcgctcgatggcgtggatcgccaccggcctcgctccggcaagccgccaggaacagctcccctcgcattggatcgccgcatcacagacgcgtgagcagatctcgggcaacgatgtatgtgcgctcagcacgtcacgggcaccggcgagatcgccactacgcagctgagcgatgaactcggggatgtcgttgtgcgtcgggcagcctcgcacacacgtcgggtccggacacgccaagcagcgattggcctcttcgagcacgtccgcaaagctcgcgaatccgccgcgtacctcgtcaaggccgcccagggccacgtctggatccaactctggcaagacagcgcccggcgcaacctgcggatcacccgcgacgacgatcgcatcgaacggacagacccgctcgcactggcggcacccgacacaccgtgcgctgtcgacagtgacgacgtaacgatcgaggtcgagatcgatcgcctccaccggacaacgaatcagacactcttgacacccggcacaccggtcggtgagcacctcaacgacaacagcgctcatgttcaaccctcctaggacgctccgtgcatgatgacgtacagccatccagccacggccccgaacacgacgacgagcgcaagagcagagagcttggcgacggcacgatgacgcacgatcgacgcgagatcagcgtcgaagatgcgcgccatggcccagaggccaccgacgactccgagcgccatcacgccgacctggacctcgacaatttgcgggatcgccagcaggtggtccgacagcaagctccagtgctgcgtgttgacaccgaagatgccgacgatggctgggatgaggctcgggatgtgcttgaagaacttcggcagctggcgtgcgaagtagtccatcccgacaactgggatgaggccgtaggtgagcggcaggaacacctgacggaacggagtgacgcggtcgagccgactctctgcggtgaccgtccgccgtgcagccggatcgagaaaggctcgaccccacgcccagatgatccctgcagttgcgagagccaccgcggcgatgatgcccaggtagtcaatcgggttcgggtaggccggccacccagtcgcgcgattgagcgtggcatcgatggagctgtagacgtcggtcgcgttgaactgctggaagatcacgaggccccacaagatcgcgatggcccaggcaaggtcccaacggcgacgcttcggcgcgaccacggaggtgagtggcgcctgcaggaagagtcccacattgttcgaggggcatgccttgtagcactccgtgcacagtccgcaggcggcattcgactcagccgatcccggccacgtgaaccatggacagccataaccggacgcaccgccacgcatgcaatccttggtggtgcactcgaggcacgtctcgcggtcgaccgttcgaaagcccgcgaccgagcccatcgacccgacggtgccgatcaacgccgagagtggacacaggtaccggcagaagctccgccgctcgaagacgaggaacaccgagaccgccgtggcgacgataccgagcaccatgatggctgtgtagcgaggcacccccggacctgcgatgttgaagtactcctcgatgaaggtcagcagcacgaaggtcgcgacagatcccaagaagccgtactcggccagccacggaggcaccgggcgcccgagaccgatcgccgagtgcagtcggcgaaagaaggtacgacgctggatccactccgcgaagccgccgaaggggcacatggagcaccacgcgcgcccgaccacggccatgagcacgaagacaacgcagaaccacaggtaccacgtgatcgcggtcgcaaagttcgtctggggatcgacgacgccgacgaagcccaggacgatcaccagccagaagatgatctggttcggcagaatcaagaggaattgggtggtccgattcgcggcgaggcgggcgatgataccccgacgtgccacgttggcacgtggcgacggatctgatcgctcgaatcgatcctggcccggccgatgcggcggtcgcaatcgcacgaccacctgatcatcgagcacggtctgcacatgcgggggcttggtcgtagccatctcgctcctcctttggcaccgcgccaatgattagtcattgactaatcgttactgtagccatgcccatacgtggtgtcaagtcgcgactacgatcggacacgtggacctctcgctgtctcggcgtggcgactatgcggtacgtgcagcgctctaccttgcgcgccaggagtcgaacgaggccgtcggcgtgcgcgagatcacggccgcaatggcgattccaccgagcttcgcaggccagatcctcgcggacctgacccgcgcaggcatcctcggtgcgcggccgggccgcggaggcggctattggctccaacacgacccgaaggacatcaccctcctcaccatcgtcgaagcagccgagggcaccctccgcgcggaacggtgcgcgctcggggatggaccatgccgttgggacagcgtgtgtccactccacaccttctggcagggagccgttcgagccgttcgcgatcagctcgccaccgtgacgctcgccgacgtccgagacgcggacgtcgccctcgaacatggggttgccccgccgcccgatgcccaccgccacgccacggtcaccaaccttgccgagacgatcgacgtcgaggcacccgcagacgaggtcgaacgacgcttgcgcacgctgacgtccgacgatctcgccaaggcgatcgcgcatcgcctgaaggccgcactcgacctcgacctcactctctgcgaactcgcccatccaggccgtcgcctcgtcgtcgaggtgaacgaccccatcggccagacggcgagagcagagttcgatctcaccaccgagccggcggatcccctgcgcaccacgctcactgcggcgatcctctggcgcggtcggctcgaggacccacgccctagcgttcgcgcgatcctgacggcgacggcaagactcctcgaggacgcgcgctgatgcaccgctcacagacgccgtaggcctcgacctggtgatacaagactgggccaggcgcgtcgtcgatcgtgatcgcctgacacgaggccacccgaacctcgaagatctccccgcacgacacgcagtggaagtggtggtggtgcgacgcgtagggcggcaggagctcataggcgatgtcgtcaccgatggtcaccggttggacgatgccagcctcggcaaacgccgcgatggttcggtaggccgtcgccgacccaacgcccgcttctgcgagaacgtcgaccaactcggccctcgtcagcggacgccccgcctccgccaacacgcgaaacaccgcacgtcgctcatcggtgacccgcaacccgcgttgtctgagtgcaccctcgaactgcgtctcagccatcgagctgctccgtccgaccgggctcggcactcggagccgcatcctgctcgccagcgcgcgagagcgagcgggcccgacgcgcagcgtgacgagtctcacggacgagcgtcccgatcccgacgacgacgacggcgaagatgacgagcacctgagcgatgccgatgttgtgaaggttgtgcacgtggagcggtgtcaccaggtgaaaggagagaaggttcgggaatgcgagtccgacgacaccggcgaccacgaacgccacacctccccacaacagcgtgcgcccagcggtgaccagtgcgacggcgcgaatctgcgcctccgtcaacgacaggtgtcgagcgacggcaccgaagaggccgcccgcgaccgcctggaccaccgtggtgcccaggccgaaggctgcaccaggcgcccaaccgagccacacgggcatcgctggcgcgagcacggtgtagaggatgagagcaaacgccccgataccccagcctgcgatgaaaccgtgcaccgcgggcatccatggcttcatggtgacgtcgggtacaccgtcctcgacgtgatgggccggcgagagcagatgccagtgctcaccgcggaacaagtaacgtgccgccagcgccatcgccagcccgacggcgacgtagacggcatagtccagccagggcgtgtcaacgaagaccttggcgagcgccaggttcgcaagttcggacgcgatcgcacgctgcacggtgaacgcagccgagaacgtcaggccggcgacgagaccgcgtcgactcgagtagctgccgatggcgtacgagaacgtgatcggccacgtgtgctcgtcgggggtgatgccatgcacgatgccgagcgcgaacgcgagtaccagcgcaccgccgatcgtcgccaccccagccgggttccacaagttcagcaccgcgagcagatccacgacgacctcctgtccgtgctacacatgatagcaattctcacttagtgttgacacgcattctcaacaacgaggcggccgtcccattccctgaccgcgcgcgctagccttcccctgggacgatgtgtgcacgtgcaatcgtgggcgcggcgctcgactcggctccccacgcaccccggatcgtcaacggaaaggatccatgatgcgctatcgccatctcggccgaaccggtctcaaggtctccgaactcggcttcggctcctgggtcaccttcggaacccagctcgacgtcgggcgcgcggccgacatcctcgccgccgccagggaagccggcatcaatctgttcgacaacgccgaggcctacgccggaggcgagtccgaacgcatcatgggacaggccatcgcgcgactcggatggccacggtggagctacgtcgtcacctccaagttcttctgggggatccacgacgacgtgaacacgcaccacaccctcaaccgcaagtacctcgtcgaggccgtcgacgcgtcactcgagcgcttcggcctggaccacctcgacatcatctactgccaccgaccggaccccacgacgcccatcgccgagacggtcttcgcgatgagcgaactcgtcagcgcacacaaggcgcactactgggggaccagcgagtggagcgccgaggaaattcgccacgccatcgacgtcgcaaccgccaatcacctccacgctccggtcgtggagcaacctcagtacaacctgctcgagcgccagcgcgtcgagcacgaatacgcccgcctgctcgacgaggaaggcatcggcctcaccacctggagtccgcttgcgtccggcttgctcaccggcaagtacgtcaatggggtgcccgcgggatcacgagccacgctccacgggtacgagtggctccgtgatctgctcaccgacccgggacgccaagccgtcgtgcgcagcctgctcccgctcgcgtcacggctcgaggtctcgctcgcccagctcgccatcggctggtgcctcctgaatccgcacgtatcctccgtcctcctcggtgccacctccatcgatcaactcaacgagaacctcggagcactcgaggcccgagaccgtctgaccccagcggtcgtggacgagatcaacgcgatcctggcggagcacgcctgagcggaccaccacgtctcggacgtgcggtcgctgcggcggccctgttcgcaaccgcacccgcgctcacgcaacgcgcagacgcgctggcgggaccgggtgcggtcctcggtatgcgagccatcgtctcggtcgcggccctcgtcgtgatcgggctgccgcgggtcaggcacctcgctcctaccgtcgcagccggtgtcgccatcgtcctcggctactacggcgcgaccaccctcggctatgccatcgccccggcgacaatcgcgtcgctgggtttggcgagcgaaccgctcgtcgtcggtctcctcaatccccactggttgcgctcgccgcgcaccctcgcaacggtgacgctcgcagtggcggccatggtgctgccggtcaccgcggcccacgcagggacccatcatgtggtagctgggatcggactggtggcgctcggcggcgcatgcttcgtcatcggagctcgtctcctcccggcaagcgcgacgccgcgcgacgccgtgcggacgaccaccttcgcccaagccctcggtgcgatcgtcctggctgctgtgctcgccggaaccggtcgctttgccgtcgcgaccacgatcgagccctggctgctcgtcgcggtgctcgtcgccggctcctccctggtcgggatcgccctctacgtcggggcggctcgcgacgcacctgccatcgcggcctcgagcctcagcctcgtgccaccgctcggagccgcccttgcctggggcgcgcttggcgatccgatgacctggcaactcgccctgagtgccatcgtggccgcgttggctgtctacctgggcgcacgtagcccgaccgttccgtagtacctggcggtaggatcgcaggtgtgtccaccgcgtggaccttcggagcagccgccctccgctacgacactctacgaccgccgtaccccgcggcgaccttctcaacgctcgagcgcgcgatcggatcctacgagggctctcgagtggtggaggtcggtgccggaaccggcatcgccacccaggggctcgtcgctgcaggcgcggacgtcctcgccctcgagcccgatccaggcatggggcgcatcctgcgtcgacgcctcccgaccgtacgcatggtccccgccaggctggaggacgtcgacctcgagggcgtccacctcctcgtcggctttcagtcgctccattggataccggtgcgagccttgtggcgcgctgcccgtcgagccctggctcccggcggcgttctcgccggcgtctggcagctcgccacgctctccgatgtccgagcggcccacgcgatcggcgaggtgctcgcgagattcggcgtggaacgctccaggggatccgaccagcgcgtcagcgacaccatcgaggcactgagcgaccaggcggtgcacgggttcgcacccgcgatgcgctgcgagctcccttggcacacgcagcgcagtgcgacaagctttgcaggcctgctcgcaaccatgagcgacctgcttgcactcggtcacgaaggcgccgactgcgaggcgcaactcgctgaggccctgaggccgtacgagccgatcgacgtgcgctacgactgcgtcgtgatcatgcgtcagcggatgccctaaggtgacggacgtgctctccccgttcacccccgtcacgatcgatcgaacccgaaccgagttccccggtatcggagcggcctggcgcgcgcacgcgctccggatcgacgatcgcctcggcctccatgcgctcgctgcaatcgccgacgacccgcagccagctgcgcacggaccactcgcaggcgtgccggttctcgtcaaggacaccatcgacactgccgatctctccacgacggccggctccctcgtcctacccgaagagccccctgctactgacgcctggatcgtggatgcgctgcgcgccgctggtgcgaccatcgccgccaagaccacctgttcagagtgggcgaactttcgcggcgagggatccatatccgggtggaatgcgcgctacggactcgcccgtaacccctacgacccgacgcgctcggctgggggctcgtcgagcggctcggccatcgccgtcgcggctggcatgagcccgatcgcgatcggtaccgagactgatgggtcgatgctctgcccggcatcgctcaatggtgtcatcgggttcaagactgctccgaagcgcctcgaccggagcggcgtcatcccgatctcgtcgacacaggactccctcggcatcttcgccacgagtgccgacgacctcctcgtcgtcgcgagcgtcctcggcatcgaagccaccaccctgacagaacctgtccgactctgcgtggtcgaggagtccctcaacggcttccatcctcgtacgctcgcacgctttcacgacgtcctcgagctgctctcgcgcgcgggcgtcgacgtcgtgacgctgagcgcaccgccgcgcggaacgctcgagccctccgatgaggacgagctcatcgtgttgcgcaccgagctgcatgtcgagctcgatcgctacctcgatcgtcgcgccatccccggccttcgctccctggccgacgtggtcgcggcgaacgacgcgctcgccgaccgagagctcgcctacttcggccaagagcacttcgtggcggcactcgaggccgacccggccgatcccgcctaccgggccgcgcgccaacgcaacctcgagcgcacgaccgaaggaatcgagtcctcgctcgccgcgacggacgcactcgcgatcctcgcaccaaccatggacgtcgcgtggcccatcgatctgctccgcggcgaccccaactccccagctggctatcgagccgccgcagtcgccggcgggacttcggtctccgtcccggcaggtcgcatcgggcacctccccgtcggcgtgtgtctcagcgcgccggcaggtcacgaggaaacgatcctcgagctgacggcgctcctcgagcgcgctctggccccactcgcgggcctcgcgggacgcgagaggcccacgacgctgttgcccgaagcgtgagcgccaccatctcgatcagtcgccaagttcccttccgtgccgatcgcgtgttccgggaactcgccgcgctggaacgacaccacacctggatggcggatgcagaagcggtcgagatcgtgagcgcccaacgccgcggcgtcggcgtcgagatgatcgcccatactcgcatcggcccgctgcgcacagccgaccgaatggtggtcgtcgactgggacgaaggccgtgccatcggcgtccgccacgtcggactcgttcgcggagtcgggcgtctcagcgtccaagccgacggtcccgaccgtgcgcgagttcgctgggacgaagagctcgtcttcccaggcgggcatctcggtgagctggcagcacacgccgcacgaccagtcctcgagtggatctggcgaggcaacctcgcccgcctcgaggccgcgatcgcctcggcagggcccattacgctgggcgctccgtgagtacgacggcctcgaactccatcgccgcacgctttggcgcgctcgcgcgccacgccgtggccgacacgccgtcacgttccgaggacgtccacctcgaccgtgacgtgatcgcggccatgctcggcctggaggatgagccggaagcgctggttgcaaccgttcgactcgagggccacactgcacgtttcgcaacgcctcgcaccccgctccccccgcgtctcagccgcctcctcgccgagaacccgggtcagctctacacgcaccaagccgccgtcaccgaccacgccctggcgggccaccacgtggtgctcgccaccccgaccgcgtccggcaagtccctcgcattcctcgtccccgccctcgctcgcctcgagcgcgatcccgcagccaccgttctcgccctctatcccacgaaagcactcgcgcacgatcaactggcgcgcctcgtcgagctcgagcgagcgctcggcatcgacatcgcccctgccgtctatgacggcgacaccccggccccggaacgcgctcgcatcaaggaccgatcgcggttcgtcgtcaccaacccccatggcctgaacctctacctcggatggcacgaaggctgggagcgcatcctcgccaacctggcactcgtcatcgtcgacgagacacacgcctacacgggagcgaccggcggtgcggtgggctggttgctccgtcgactccagcgtctcgccgaggcgcacggtgcggcaccggtctacgtgggggcatccgggaccatcgccaatccggccgagcacttcgcacgactcatcggcgatgacgtcgtcctcgtcgatgacgatgggtcggcccagccgacacgcacgatcgccatcgtggatgcaacacgatctcccgatcacgccccgatcgctcaggccgcgctcctcgtgcgtcggctcgtccgccaccgccgccacgtcatcgccttctcgaactcacgatcgcacgccgagctgctcgcgagactcgcgaccgatcgcgcggtccgcgtcgaaccctacagggcagggtacgcggcccaacggcggcgggcactcgaagccgacctccgagccgggcgccttcgcgccatctcagcgacgagcgccctcgaactcggcatcgacgtcggcgtcatcgacacggtcgtgctcaacggattcccgggctcgatcgcctccctcttccaacgcatcggtcgagccggacgatcgggccaggacgcactgggcgtcgtcgtgctgggggccgaacccgccgcccgagcgctcatcgccgatccagaggagttcctcgtccgcccgcccgagctcgcggtcgccaacgtcgaccagccctccgtggtccggcgtgcgctcgagctcgctgcggccgaacgacccgtcacccccgacgaactccgtcactggggcgcgcccgcacgcgacgctgccgccgcactcgtcgaggctggcacgattcggcacgacgccgacggccttcgagtcccgggccgccgcccgcatcgcttccgaccactggtcgagatggagccgacgtggcgcctccagttcgaggggacgcgcaccaccatcgcgccagagagcctgtcggagagtcaggcactgcgcgaggcctatcgcggtgccatcgtgctgcatggctcgcagccctaccgcgtcgtccgggtcgactacgctgcgcgcgtcgcggtcgcacgaccagaacccgaccgaggccaccacacccaagcagcctggtatcgcgcgatcgctccgacgcgcgtacggtctcatgcgatcgcggggtcgctcacgttggacctggccgatgccgtgctcgtcgagcaggtcacctcagccaaggagttccggggatcagtgctcgtccaccaacgcaaggtcactgccccctcacgttcggtcgcgggcgaggccttgatcctctcgaccaaccaactcgtcgatcccgccgaacttccagccctccacggcgtcgagcacctcctcgtcaaggcgctcgcgccgcttgccgtcggcgcaagcgatctcaccacgctgacccaggccacgccggcaccgcagatcctcttcttcgcgcccgatgcgctgggcggcggcacgatgcttgcgacggtggctcgccagctcgatcgtgcgctcgccgtgtccgagcgcatcctcacgacgtgccgctgcaacgatggctgccccttctgcaccctggacgctcgctgcgacggcgacgttgccgccaagtcgctcgtcctggacgtgctcgtgcgcctgcgcgaccaccacgcgcggcacgcttagcacaatccggcgcgatgcgcctcgcacaggtccgcgagccggcagccggcgcacagtggccgcctcgccgtgcacgtctcccgaccgtgcaggatcatgcgcaacgagaaggtcccccagcgcttcggtgccaagaccgcacagagctcctgttcgatcccctccggggtcgacgatcgggcgatcccgaggcgacgactcacccgtttgacgtgcgtgtcgacggggagccctggcaacgagaagccgaccgaacgaacgacattggccgtcttgcgtccaaccccgggcaagctggtcagctcctcgagtccttggggaacctctcctccgaagcgctcgacgatcgcagctgccagcgcgacgatgtgacgagccttcgttcgatagaaaccggtcggacgcaccagcgcctccacctgctcgatcggagctcgggcgagagtctcggcgtccgggtagcgagcgaacagtcctggcgtcacgaggttcaccgcagcgtcggtggtctgcgccgacaagaccgtcgccacgaggagctgaaacggggtctcgaagcgcagggcacacagcgacaccgccgtccctggatagagctcttcgagtcgttcgtcgaccgcgagagcccgtcgggtttcgtcctgcaccgccaacctccccaccgctagcctagagacgtgcacgcgctcacgacggtcgagaacccgtctgcgcgcctgctcccgggggtgcttgcactcatacgcgatgtcgaggcagccgacggccacgaggtactcgaggctcatcgctggatcgacctcgccaacgcggacgccgagagcctgcacgggatcgcggtgacgctcgacgacgacaccgtcgtcggctacgtccacctgcggcggcaccaccgtcacgggatcgagctcgagctcttggtcgcgccagaccaccgcgacgaggccgcgagcatcgtcggcgcgctcgtcgaggccgcgagcgcgagtctcgagaccctcggcccccacgagatcttcgcctgggtacccagacactctcgacaggtcatcgatgccctcgagggcctcgggttccgtgccgaccgcgcggtacggcagctccgacgtcccctcccactcgagtcagaccacccggcacggccgattgactgcccgccgtttcggacctttcgtcccggcgaggacgaggatgcgtggctcgaggtcaacaatcgcgccttcgcatggcatcccgatcaaggcgactgggatctcgagaccctgctcgctcgtgagcgcgagagctggttcgacccagctggtttcctcctggccgaacaggacgggcgcctcgtgggcttttgctggacgaaggtgcatgcgccgcgctcgtcgtcagcgctcggcgagatctacgtcatcgccaccgatccagaacgcgcgcctcgcggacttggctcatgcctgctcgtcgccgggttggactacctcgcccaccacgacatccccaccgcctcgctctacgtggaggacacgaacgaacgtgcactccgcctctatgaccgcttcgggttcgtggtcgatcacgaagacgtccggctcgtgtggcgtctcccagcagcgtcgtagactcctcgacgaggaggatcaatggatctgaaggaagcgttcgtcggtggccccaggttcctcgacaccgcgagctacggattgccaccccgtcgcgaggtggccgcactcgaacaggcgctcgctcggtggtcgagcggcacggccgattggtacgacgagtggctgcgcgcgacggatgtcgcgcggggccaccttgcgcgcctgctcggcaccgattcgaccgcggtgaccaccggtccgaccacctcggtgctcgtcgccctcctcgcaaccaccgtggagccgggcagtcgcgtcgtcgtgccggacatcgagttcacctccaatgtgttcccctggcttgtgatcgctcaacgcaggcagctcgatctgcgtttcgttcccgtcggatcgctggcacgtgcaacggctgagggggccgacgtcgtgagcttctccctcgtgcagtcggcgacgggtgaggtcgccgatctcgacgccatcgtcgatgccgcggagtccgtggacgcacgcgtcttcgtggacgccacgcaagcgctcgggtggcttcccgtcgacgccacccgcgtcgacgcggtggtcgtctcgggctacaagtggctcctcgctccgcgcggcgtcgcggccatggctacgagcgaccgtgtccgtgcttccatgcggatcgttgccggcttttcccatcaggcctcccgagcggaaatggggaagaggcggacctccgtccccaccgcctcggccagtacacggcgagagaagtgctcgatcgcggcggtgtcggcttcctgcaggatgtcgatcttgttcaacaccaaaaagatacggccggcgtacttccggacctctcatggaggaactccagttcggcctcactcaccgcctggtcggcggagaggacgaacagggcggcatcgcactgcggcacgcgcgcccaggcggtgtcggtgttgtggcggaacaccgagccgacgccgggtgtgtccacgatgcgcacgccattccccaggagcggcgagggcgtccggatcagacttcccgcacgcccttcgcgttgcccgggttgcccggctcggtgatgtaatccgcgagcatatccggacggatgtcgaaggggctgccttccagcggctggacggtgatccgggggggatagccgtaggcgagcacggtcaccaccgaggtcagcggcaccgcccgcgtgggcagcaggttctcacccagcagcgcgttgatcaggctggtcttgccccgtttgaactggccgaccgtcaggacgtcgaaatggccggcctgcagcttgtcacgcagggcgagggcggggcgcagagcggcggggaggcgtccgccagctcgtcgatcaggctcaggagttcggttttgagatccgcatagccggtcgttggcgcctcaccggcgatcggccaacgggggatcgcgttcattccgcagtggtcggatcgatgacggtgcggatttcgttgatcgcatcggcgggaaagccgccttccagtgcgtgctgtaccagcgtggcggcgtcgggggcaatgtagacgcagtacaccttgtcgtcggtgacatagctctcgatccactgaacctgcggtcccatggcgttgaggatcgaacaggattacgggagatctgccgcagttcgtcgcgcgacaggtttccggcggccgcgaatcgtgcgctctatgacatatttgggcatggttatcagccttacggttctggtaaggaaaaaataggcttgtattgtgcttatccgaagataagcgctttccgcgcagcccgattctttcatggatcacgattccattgaatgcggcgaaagtctcagggtccggtcatgaatgaagagttatggcggcccagtacgtcaccgttatgtccgatggctgtatcaaacaaagacacgtgtagtgatatcggacaactcgtccatccccgtcggagcattcggataacgtgctcatcgttccaaaatattgatatacggtatacgtatccgaagaataaagttggcacgatccctgtaactaggttgtcacgacctcgtcggaggttgtatgtccggtgttccgtgacgtcatcgggcattcatcattcatagaatgtgttacggaggaagagccgctgtacgccaattggtacgccggcgaacccattccgacctcgctctacggaccaccgctgcgactggctccggatgcgcggcgcttcgacccctcgcctgcgtggttctcctgggtcggcgcggtcgccgcgctggaactcctcgacgaggtcggcatcgacgcgatctgggcgcacgacaccgacctcgccgccgccttccgcaccatgctgggtcttcccgagcccacggtcccaagcgcgatcgtctcggtggcgctcgatcgagcaccctacaagtaatggcacttagcaccgcaaccaaggccgcgacggacgcgctggctgccaatcgggcacccaccagcgtgaatgcacaggaagtgcaccgttggctccagagcttcaactgggatttcaagaacaaccggaccaagtacgccaccaagtacaagatggcgaacgagaccaaggaacagttcaagctgatcgccaaggaatatgcgcgcatggaggcagtcaaggacgaaaggcagttcggtagcctgcaggatgcgctgacccgcctcaacgccggtgttcgcgttcatccgaagtggaacgagaccatgaaagtggtttcgaacttcctggaagtgggcgaatacaacgccatcgccgctaccgggatgctgtgggattccgcccaggcggcggaacagaagaacggctatctggcccaggtgttggatgaaatccgccacacccaccagtgtgcctacgtcaactactacttcgcgaagaacggccaggacccggccggtcacaacgatgctcgccgcacccgtaccatcggtccgctgtggaagggcatgaagcgcgtgttttccgacggcttcatttccggcgacgccgtggaatgctccctcaacctgcagctggtgggtgaggcctgcttcaccaatccgctgatcgtcgcagtgaccgaatgggctgccgccaacggcgatgaaatcaccccgacggtgttcctgtcgatcgagaccgacgaactgcgccacatggccaacggttaccagaccgtcgtttccatcgccaacgatccggcttccgccaagtatctcaacacggacctgaacaacgccttctggacccagcagaagtacttcacgccggtgttgggcatgctgttcgagtatggctccaagttcaaggtcgagccgtgggtcaagacgtgggaccgctgggtgtacgaggactggggcggcatctggatcggccgtctgggcaagtacggggtggagtcgccgcgcagcctcaaggacgccaagcaggacgcttactgggctcaccacgacctgtatctgctggcttatgcgctgtggccgaccggcttcttccgtctggcgctgccggatcaggaagaaatggagtggttcgaggccaactaccccggctggtacgaccactacggcaagatctacgaggaatggcgcgcccgcggttgcgaggatccgtcctcgggcttcatcccgctgatgtggttcatcgaaaacaaccatcccatctacatcgatcgcgtgtcgcaagtgccgttctgcccgagcttggccaagggcgccagcaccctgcgcgtgcacgagtacaacggcgagatgcacaccttcagcgaccagtggggcgagcgcatgtggctggccgagccggagcgctacgagtgccagaacatcttcgaacagtacgaaggacgcgaactgtcggaagtgatcgccgaactgcacgggctgcgcagtgatggcaagaccctgatcgcccagccgcatgtccgtggcgacaagctgtggacgttggacgatatcaaacgcctgaactgcgtcttcaagaacccggtgaaggcattcaattgaaacgggtgtcgggctccgtcacagggcggggcccgacgcacgatcgttcgatcaacctcaaaccaaaaaggaacatcgatatgagcatgccgacctcacgacgaagatctcgttccgcgacggccgcgctcgcgtctccttccacctctacaacgacctcgccgacgccgagacgctcgcagccgagcttgcccccttcggcgtccagcgcccacgtcggagctgatcggccggctcgaccgtgccacgaccgagccaacaccagcgcatacgagcacgcacgggcatcgtgcactgccttaggagaaagacgccgcggtctgaccgatccggaaatggcggccgtcattttgaaggcgcttcctgaagctccgctggacggcaacaacaagatgggttatttcgtcaccccccgctggaaacgcttgacggaatatgaagccctgaccgtttatgcgcagcccaacgccgactggatcgccggcggcctggactggggcgactggacccagaaattccacggcggccgcccttcctggggcaacgagaccacggagctgcgcaccgtcgactggttcaagcaccgtgacccgctccgccgttggcatgcgccgtacgtcaaggacaaggccgaggaatggcgctacaccgaccgcttcctgcagggttactccgccgacggtcagatccgggcgatgaacccgacctggcgggacgagttcatcaaccggtattggggcgccttcctgttcaacgaatacggattgttcaacgctcattcgcagggcgcccgggaggcgctgtcggacgtaacccgcgtcagcctggctttctggggcttcgacaagatcgacatcgcccagatgatccaactcgaacggggtttcctcgccaagatcgtacccggtttcgacgagtccacagcggtgccgaaggccgaatggacgaacggggaggtctacaagagcgcccgtctggccgtggaagggctgtggcaggaggtgttcgactggaacgagagcgctttctcggtgcacgccgtctatgacgcgctgttcggtcagttcgtccgccgcgagttctttcagcggctggctccccgcttcggcgacaatctgacgccattcttcatcaaccaggcccagacatacttccagatcgccaagcagggcgtacaggatctgtattacaactgtctgggtgacgatccggagttcagcgattacaaccgtaccgtgatgcgcaactggaccggcaagtggctggagcccacgatcgccgctctgcgcgacttcatggggctgtttgcgaagctgccggcgggcaccactgacaaggaagaaatcaccgcgtccctgtaccgggtggtcgacgactggatcgaggactacgccagcgcgatcgacttcaaggcggaccgcgatcagatcgttaaagcggttctggcaggattgaaataatagaggaactattacgatgagcgtaaacagcaacgcatacgacgccggcatcatgggcctgaaaggcaaggacttcgccgatcagttctttgccgacgaaaaccaagtggtccatgaaagcgacacggtcgttctggtcctcaagaagtcggacgagatcaatacctttatcgaggagatccttctgacggactacaagaagaacgtcaatccgacggtaaacgtggaagaccgcgcgggttactggtggatcaaggccaacggcaagatcgaggtcgattgcgacgagatttccgagctgttggggcggcagttcaacgtctacgacttcctcgtcgacgtttcctccaccatcggccgggcctataccctgggcaacaagttcaccattaccagtgagctgatgggcctggaccgcaagctcgaagactatcacgcttaaggagaatgacatggcgaaactgggtatacacagcaacgacacccgcgacgcctgggtgaacaagatcgcgcagctcaacaccctggaaaaagcggccgagatgctgaagcagttccggatggaccacaccacgccgttccgcaacagctacgaactggacaacgactacctctggatcgaggccaagctcgaagagaaggtcgccgtcctcaaggcacgatggatcgggttgccccgttgcgatcccagcaccacgagagaggtccgcgatctcggcccggcaggtccgcgccttcaacgaggtggacttccgtcataagaccgctttcggcgaggatgccaagtccgttctggacggcaccgtcgcgaagatgaacgcggccaaggacaagtgggaggcggagaagatccatatcggtttccgccaggcctacaagccgccgatcatgccggtgaactatttcctggacggcgagcgtcagttggggacccggctgatggaactgcgcaacctcaactactacgacacgccgctggaagaactgcgcaaacagcgcggtgtgcgggtggtgcatctgcagtcgccgcactgaagggaggaagtctcgccctggacgcgacggcatcgccgtgaagtccagggggcagggatgccgttccgggccggcaggctggcccggaatctctggttttcagggggcgtgccggtccacggctccccccctccatctttcgtaaggaaatcaccatggtcgaatcggcatttcagccattttcgggcgacgcagacgaatggttcgaggaaccacggccccaggccggtttcttcccttccgcggactggcatctgctcaaacgggacgagacctacgcagcctatgccaaggatctcgatttcatgtggcggtgggtcatcgtccgggaagaaaggatcgtccaggagggttgctcgatcagcctggagtcgtcgatccgcgccgtgacgcacgtactgaattattttggtatgaccgaacaacgcgccccggcagaggaccggaccggcggagttcaacattgaacaggtaagtttatgcagcgagttcacactatcacggcggtgacggaggatggcgaatcgctccgcttcgaatgccgttcggacgaggacgtcatcaccgccgccctgcgccagaacatctttctgatgtcgtcctgccgggagggcggctgtgcgacctgcaaggccttgtgcagcgaaggggactacgacctcaagggctgcagcgttcaggcgctgccgccggaagaggaggaggaagggttggtgttgttgtgccggacctacccgaagaccgacctggaaatcgaactgccctatacccattgccgcatcagttttggtgaggtcggcagtttcgaggcggaggtcgtcggcctcaactgggtttcgagcaacaccgtccagtttcttttgcagaagcggcccgacgagtgcggcaaccgtggcgtgaaattcgaacccggtcagttcatggacctgaccatccccggcaccgatgtctcccgctcctactcgccggcgaaccttcctaatcccgaaggccgcctggagttcctgatccgcgtgttaccggagggacggttttcggactacctgcgcaatgacgcgcgtgtcggacaggtcctctcggtcaaagggccactgggcgtgttcggtctcaaggagcggggcatggcgccgcgctatttcgtggccggcggcaccgggttggcgccggtggtctcgatggtgcggcagatgcaggagtggaccgcgccgaacgagacccgcatctatttcggtgtgaacaccgagccggaattgttctacatcgacgagctcaaatccctggaacgatcgatgcgcaatctcaccgtgaaggcctgtgtctggcacccgagcggggactgggaaggcgagcagggctcgcccatcgatgcgttgcgggaagacctggagtcctccgacgccaacccggacatttatttgtgcggtccgccgggcatgatcgatgccgcctgcgagctggtacgcagccgcggtatccccggcgaacaggtcttcttcgaaaaattcctgccgtccggggcggcctgaaccggggaagtaccgtgaccaccgagcagttcccgccccaattcctgcgtgaaatgatcgagcagctggacgccagcatccaggagctcgcacgcaaggaaaagggacttgcggcatccctgggcacgggccgggtcgccgagctcaaggaatactgggaccacgttctcactcccgaggaggaatgggagctcaagcgaccatggacttccgcgaccgggaactggtgtggatctggtcccgtctcaggcgggcccgaacctcccgcgccaatgccggggaggcctatatcgccagctgtcgccggcgccgcgaaaaaacgaacaatcctgaaacggagtcgacgggtatcgttgggaaaaaggttatctgtcgccctattttgtaacgttccgagcccatcgcctggcgccctgtgcgacaaccgttgcaccgtgactcaggcgagcgactcgagttgtttgccctcatgtggtcgggccatgctcgccaacagacaatcgtcggaaggtgcggctcgccctgggagcatgaggccgatgtccccgcacgactcctgggagcccgggacgagctccgtcacggcaccgagccagggctcgcagcaagacccgcgcgagcgctccgatccgatcgtcgcatcgagcgcacgagtcggagcgcagacgatctgctctgcccgtcactcatcgagccgcggtgctgccgcgacgattccacgccagcgtgacctcgacccgctgcgtggcggggatgcgcgcgccggggcgtcgctgtgcccgaacagccggggcacacccgagccatcggtccaccaaaccgccctcccatggtgatcgacgccgccacgctcagacgcccacccaaaggcgcccacgcctggccctggccatcaccggctcggcgctgcgctgcaggctggtgcgcactagcgaacgagcagatgccagccgagccatgcccacccgagccacgccacgacgcgccacagccgcgagcgacgcaggcctcccacgaactgtgccgggcccgcgccgacacggttcagcaccacccacgccccgatcacggctccgacgaggacccaagccgcccacgcgctcgtcacgacgacaccatcatggcgcgaggagccaccgaccgagcacgacccacgcggccgccagcacgctccgaccgagtccgaagccatcgaccttcgaccgcagcacgaccgcctcgaccatcgacgagaaggtcgggtagtgcccgcgcggtccgtggaccaactccaccagttcgaccgccgtgaacacggtcgcgacgaccaacgccgccaccaccgcagaccgcacgacgcgggcgatcccgtcggtcgtcgtccagggacgagcgacaccgagaccccacgcgatcagcgctccggtcgcaaggcgggcaggccacgtgaacggagtgctcacgccctcgacgacgatccctgcggcgacgagcgcggcccctaggagccagatggcgcgccgaggcgcgcgaacgtccataggccccccatcacccccgcaagcgcgagcgccccgaccgaggccacagcgacgacgaggctgcgcggacccgtgctcgccgcaacgccgatgccgagcgcaacgagaaccgcgctcacgacgacgacaccccggcttgccgatgcggctcgcgcgatgcgagcagcatcgaactcggccgcacgagccgccagctccgcctcgagacggcttgcgcatccccctccacggccctcgcacgcctcgcacgcttgggcgcagccaggctcgggtggcgccggacgtggtgcgctcgatctgacgactaccgcgccgacgacgacccatgcaaccaccaagcccccgatggccacgctggacccgacgccggcaagtgcgcccccaacgatggccgcaaggacacctccgaagccgaagccaagcagccaacgaccgctacgaacaccgcgctcgagcgcacgaaacccggaggtcgtcatgccaggcagtctaggcaggtgattcgccagtgcccaaggcgggagcttccggtgcgcacgaggcgcagctcgtaggccgacgaccgtgtgcgccagcgtcgactgtccgaccctgtccggggctcaccgtaggatcatgctcgtggagcagctcggcctcgacgacgacgggaccgatctgcgaaccgtgcgcttcgccatcctcgacgtcgagacgaccggagccgcatccggtgcggacgagctcaccgaggtcgccatgatggtcgtccaagagggccgtgcgctcgctcacctccaaagcctggtacacaccgaccgccccattcccccggcgatcgtggcactcaccgggatctccaacgagctggtcgccgacgcaccgagcgcccgcaccgtcatcgagcgcacggctcgactgctcgagggcaccgtcatggtcggacacaacgtccgcttcgaccgcagcttcctcggcgccgctgccgatgccgccggcatcacactgcccgaggtaccggtcctcgacacgctcacgctctcgcgcgtcctcctcgacggagaggtgccgaaccaccgtctcgccaccctcgctcactaccttcagctcccaccgccgagccatcgggcgatggcggacgtcgtcaccactgtggcgctcctccaccgtctcatcgagcgggccggtgcgctcggcgtcaccaccctcgagggactcctcgcactgcgacgcccacgtcgcagtggcgccgacctcgagcgccaggccagacgtctcccgcatcgacccggcgtctactacttccacgacgcgggccgggtgctctacgtcggtgtcgcgaccgatctccacgatcgcgtgcggtcgtacttcagcgccgacacacgcacgagcgtgcggcgcctgctgcgacgcgcctccagcatcagtgcccggccggtgccctgcgacatcgctcggcctctcaccgagttggccgagatccagacactgcgaccgcccttcaaccaagtcggcgtccgacgcccgcgcacgcgatcattcgtgacgcccgagggacgcgtcatcgcgccatggcccctcaaccaacccgatccgcccccgtcgatctcgacgtgcttcgatggcgacgcccacacggttgcgagagcgctcgaggaggccatcaggcaccttcaggccgagatgatccaagcgagcgacgacggtgagtacgaacgggccgcggcgcttcgcgacctcggcgccctcgtcgcaacccgtgtaccgacgagcctgctccacgaagtccaccgggagggtcgcaggctcgggctcttcgacccccgctgcgacgcccgacacgagttgacgggccccgagggactcctcgatctcggcccggacgatcctgagcttcgaagctaccgagcgctcctcgtgctgcgtacgatcgccgaacgtcgtgacctcatcctcgacgacgagctcgcccccctcgtcgccctcgttcgtgagagcgtcaggttccgccgcggctcagtcggcgccgcctcggatccgagcaagggtctcgcccgctcgtcctgagctgatcgcgtcgaccgccagctcgaagccgtcgacgatcgtcgccgaccgcccgtcgacccacaaggccaccgcggcgttcagcacgatgatgtcgcgcaccggaccgcgtacccgcccctcgagcacgccctcgagcaccttggcgttctcctccgcgctgccaccacgcacagctcctgccgccgcagtcgcacaaccgagcgacgttggatcgagcacgccagcctcgagctcgacggcgcccttgccatcggaacggagttccacgaagcgcgtcggcgccgacaccgacacctcgtcgagtccatcgtcggagtggaccacgagagcatggcgcacgccgatcgcggccagcacgtgcgcgaccggctcgagcagcgacggactccacacgcccacgagctgcgctcgagcacggccgggattgaccagcggtccgagcacattgaacgcggtcgggacgccgagggctcgccggacgggcgcgacctgggccatcgctggatggaagcgtggcgcgaacgcgaaaccaaagccggttcgttcgagctcccgacggagctcgtccgctccgagctgcgtcgggacgccaagggcctcgagcacgtcggccgagcctgctcgcgacgacgaggcgcggcccccgtgcttgagcacgagcgcaccacaggcggcagccaggagcgccgcgccggtcgacacgttgatcgtgaacgcgcgatcgccacccgttccgcaggtgtcgaggaccgggcccggggtcgtcaccggaaccatgtggtcgaccatggcctcggcgaaacctgcgagctcctccggcccctcgcccttggcgcgcagcgccaccagcacgccggcgatcacgaccggctcgacctggccgtcgaggaccgcgtcgagaaagtcgcgcgcgctgcctcggtcgagactgcgcccagcgaggaggtctccgaggagatccgaccaggagtgcgaatctggcgtcacgccccccaggctagcgaagggcacgtcggcgctgacggagcactcgtgcaaggccgcccggactgagcggacgaaagaagtagaacccctgcgccttcggcacgccaagctccaggagacgcgcggcggtgctggcgtcttggacgccctcggccaccagctcgacaccgagacgccgcgcgagcgagacgagcccgtcgagcatgctcgagccgttcttcgtacccacgttggccacgaagcttcgatcgatcttgacctcgtgcacggcgagcgtcgcgaggtggcgaaacgacgaggtgccgacgccgaagtcgtcgagggccaccttgatgcctgctcccgcgagtgcctcgagggtgcgtcgtagctgctcgagggccgaggcagcgatctcggactccgtgagctccacgacgacctggttcgcggcgatgcccgatcgttcgacgagttcgatcaggcgtgacgcgatgccgcgccggcgcgcactctcggccgacaggttgaacgagacccgaagccctcgtgccaccccggtgcgctcgagctcgacgacctgacggagcgcgagcgcgcgcaccagttcgtcgacgcgctcgacgaggcgaagatggacggcgatcgggaggaaacggcccgggagcaccgtaccgagcctcggatgctcccaccgagccaacgcctcgacgccggcgatctggccggtcgcaagctcgacgaccggttggaacacgacgccgaaggtgcccgcctcgcgatcaccctcgagcgcgcgtaccagttcgggcgcgagcgcgatgtcggccggctcgagcggcgcggtgacgcgctcgacacgagccaccccccgacgctcgagatcggccacgaggtcgcgctcggcgcgttgcacggctgcgagcacgtccccgtcctgaatactggccgcgccgagcgacaccgcgaccccccttgccccgagtacctcgagcatgtcacggcggatcgtgccgaaatcacgcgaactcgtcgtgccgacgatgagagccgcaaactcatcgccaccgatacgcccgacgaccgcctccggaccgagagcctcgaggaccccagtgacggcccgtaccaggtagcgatcacccgctgcgattccctcccgttcgttgacgtcccacagctggtcgagatcgatcagcagcacgtacgcgcccgaacggggcccttcggcttccagtcgctcgctcgccctggccaggaaggcctgccgatgccagacaccggtgaggggatcgcggtcggcgctctctcggagtgcgtcggtggccgctcgacggaccgctgcactcccagccacgacaagacaccgatccaggccgagatcgatcacccactccggatccctcgcggcagcggtcgcgatctcgatgcgccgttgctccgtctccagcacgatcgacatgccaaggctgttggcgagaggcagatgctcctcggcaccgaggtgtgcgccaagaagacgtccacgatcgcggacgtcccagagcgcgacgagtcgggcgaggcgctcgagcgccaacacgtcgccgacgtcgaagcgatacggcaccgcatccagggcggcgagcacgcccacaggcccatcggcaccgacgagcggcacgacgagcgcactctcggccgagacgacgccccgaatggcccgcacggcctcgctggggacgcccacgccagcctcggcagagccgacgaggacgctcagctgattccgaagcacccatccggcgaccccggcgcccacgtccagctcctccagcaagccgaagtcacccgtccccgccgcggctcgcacgacgaggctccgcccggcgacttcactcacgaccacctgcgatgcgccgagcaccgacgcgccagcgcgaccaaggaggcggaggcgatcctcccgagactgatccgagactcgttcccctatccggagcgcccggcggagccgatcggcccgccgccgctcatgatctgccatgaagcttgccgcagcgatccgaacggccggtgcaagccgctcgacgagggccaacccagccggatcgacgccctccgcagcgcccgcaaggaacagtcgctctccgagcgcgaggacccagaaggacgcagcgtcaaccccgacctcgacaaccgtgccatcagcaaccgctgcgagcgccgcccactccagaccgacgaggccacccatcgccgtgggaccacggaccacgcgcaggcgcgagaatccttgatgcacgccgagcaccgcgcacggcacaccgagcgctgcggacaggactccgaggagctggtcgagcacgccgtgcggtgatgacggcgcggcgagcacgcgcgagatggcaccgtagagctcaccttggcgctcgcctggagatggtggtgccggcagctcgggccgagtcacccgaacctcggccacgctgcccctttggcatcaacgctcgttcaatatcccgaccgttcgcaacgttacacggtgctaccatcccggtgtgcgcgacatggcagcgaccgacaccacctctcgcgagctgttcgcccgcatctccgccatcgtcggcgcaccggaccctccctacgcccgcctcgccaggctcggcgagctcgccgagcaggtcggggcccgactgatcgttcgtgacggcctcggcccaggaacagcctccgtccgcgcggccccctcgccagagctggggagggccatgggtgacgccgccaacctgctcctgcgcctcgactaccgggcacgtgctgccgagcgcgccaacgagcacctcgccgagaccgtgaccgcactcgagctcgcgatcgatgcggcgacgagggaaccgccgatcgagacccacgcaccggcgttggcactgtggcatctgccggtcgcgctactcgtcgtggacgagcagcagcggatctgcttcctcaatccgcaggcggctcgcctgctccagctcgacggtgccgacgtcctcggctcggtgtggacccgagcgctcgcgagtctcggcgaggcccagctcgatcggatccgaggtcactttcgtgcctccggacactttcgcggcgtggccaccgtgccatcaggcgatgacggccgtcggtacctggccatcgacgcagcgacggtccacgcaacgtcgtcgcacgcggcacgtcccctcgtgcgtgtcatgctctgggatgcgacgcacgcggccgtggaggcgagctggctgcagtggaccgcgacccacgaccctctgaccggcctgttgaaccgagcgggcctgaccgaacacctgcgaacgtggggagagcgacccctgcccggcctcatctggctcgacatcgccggcttcagcgacctgaaccgagcgctcggccatcgtgtcgccgacgagatcctccggcatgtcgccgacagcatcatgaccgaactcggacccgacgacctcgcggcacgcgtcggcagcgacgagttcgccatcctcgtggccgacggggccgccgccaagcaacggcggtgggccatcagccagagcgcaagcagcctggggagagccgcgatcactgcggacatcgcggtctcgctccggagcgccgtcgcgacccatccacgtcccggcatcgagcgatcggcggcagacgccgtgtgggaagaactcgggcgcctcgcgaggatctcgcgggagatcagccatccggccgctcgcggccgtcgacggttcgcgccacggggaagccaccaacccgccgacgagctcgaccatcccagcgtgcggtggatccgcctcatcgacgttgcgacctcctctccgagagggcacgaactcgtgctcaccgatcggaccggtcgcccactacgcgacgacgcccgacgcgaccacgcggccggtcgctacgaccgcgccctcctcggtgcgttggcgaggaccgcgcatccaggtggggtggtcgcggtgcgtctcctcgagccctcccacgagctcctccgcgctctgaagaccagtgaccgcgggtccacggtgcaggtcaccctcgaggcagacgacctcgtcgcgaccccggagcgccggcgcgttgccgcgaccatcgctcgcgaggcccatgcgctcgcgctccgggtgggcctcgacctcggcgaacgccacggcggtgaactccagctcatcgctgcgctcgagcccgagcagatcgtcatgccgctccaccctcgccgaacccgcccacgaggaccgctcgcagaacccacgactcgactcgtggagggtctggccgccttctcggctggtctcggctgcgagttcgtcgtgaccaacgcacgagtccaggacctcgtcgtgctgcgcgagatcgctgagcgtgcagggggcaccatcatcgccgcgctggcgtcgacctttgctaccagcccgtcgtgaatgccccctcgggatcatcccaccacaggtgctgatcgagcacgccacgggcgatcaggttcaactgcacctgcgaggtaccctcgacgatggtgagctgcttcgcgtcgcggtagtagagctcggtcggatgatcgctcatgtaaccggccgcgccgagcagctgcagcgccacggagctcgcacgcaccgcaagttcggtggcgtagtacttcgccatcgacaggaagggcacccactcgcgggtgaaccgcccctggtcggcgagccaggctgcccggtaggtcagcaacctcgccgcctcgatctcggtcgcgagcttcgcgagctcccactggatgccctggaagtccgcgatccgaccaccgaaggctggacggtttcgcacgtacgtcgtcgcgtacatgagcgcgccctcggcgagcccgatcccccgcgcagccaccaccggacgcatcgcgttcagtccgagcatcgcgaggcggaaccctcccacctcgccgatcacgttctccggaggcacacggacctcgtcgagcagcagctcaccggtgtcgacgccgtgcacacccatcttgtggtcgaccctcggcacatccacccccggccaggaccgttcgacgatgaacgcagtgatcgcatcgtgccgacgcgatgtcggatcccctgtcttcgcgaacaccgtgtaccagtcggcctgccgcacgccagagatccacgacttccgccccgacaggatccaaccgcccggacgatcggggtcgggtactgcccgcgtccgcatgccgaccacatcggagcccgcctccgcctccgagaggccgaacgaggcccgctgggttccatcggcgatgccgggcaagtagcggcgcttctgctcctcggatccagcgatcatcaccggacccgtcggcaggcgcgacagcaacagcatcaagcccgcggtctgcgagaacttcgcgacctcttcgatcgcgatcgtcagtccgaggatcccagcgccagaccctccgtactcctcggggatgcacaggccaaacagacccgcggaacgaaagacctcgaacagatcgtccgggtacgtcccctcggcgtcgatcgcccgcgcgcgcggtgcaacgtggtcgcgtgcgatccgacgcacggtcgcctggaggtcttgatagacgtcgtccaactcgaagttcacctgcgactcctcgctcggatgccgggagcagcgtagccgacaccatgtggtggcgccagctcaccgacgtccccagcgccgtcggcgacaggcgcgggcagcgagcagcccggacccttgcgctgggactaccctgggtcgcatgctcgtcgcggtcctcgatgccggcaccacgacgcttcgcgccagcttggtcgacgacgacctgcgcatcctcgccaccctcgaggacatcacgcccatgctccgaagccgctcgggtgaggcgtcgttcgacgccaacgaactggcacgccgtgcacgccacctcctcgacggtctcgcacgccgcggtcgagcagatctcgtggcgctcaccaaccagcgcgcgagcgccgtcgtgttcgacccgacgcaccgggtggctctggccccggggatcggttgggaagatgctcgaaccgctgcgcgctgtctcgaactcgcacgccacggcgtcgtggtctcaccgagcgaatcggcgaccaagttcgagcgcctgctcgccatcgccgaactacccgaccacgcccaggtgggcaccgtcgacgcctggttggtcgtgacgctcacagggtccgcctcgaccgacccgacgaacgccgcggtcaccggcctcagcgacaccgaggcactcgcctgggacggtgagcgactcgcactgcttggcatcgcgcctgagcgactcgtcccgatcgagccgagcgtggggccccggggccacgtgcgcctcgggggtcgcgacgtcccgcttgtcgtcgtcatcggggaccagcaagccgcgcatgcgggccatccggagctgacgaaactgaccatcggcacctcggcggtcgccgatcactggctgggcgcagcaagtccaccattcgcacgacgtggcggcgccgggagcttccccgtcgtgctcgtcgacaccaccgagccacggacgttcggcctcgaggcgttctggcctgcagcgggctcgacggtcggctggctcgttcgccgcggcatccttgccgacgcagccgaggccactcggctcgccgagcgagctggctcggccgtaccgctggtcgtacccacgttccagggcgcgggcgcacccctctgggacctcggtgcccgaggtcgcatcgagggtctctccgcggcgagcggcccggcagaactgacggccggcgtcctcgagggtctcgcccacgtgggggtcacgctgttctcggtgctcgcagccgaccgagcagccgcggggtacgctccagatcttggcgacgtcgcgctcgatgggcgcgcaggccacaacccccgagtcgcaggcgtgctcgcgagcctgctcggcagaccggtcgcgctcggtgtccagccggaggccaccacgatcggggctgcgcgactcgcactcggtctaccccgtgaggcggttccgcgtgggcctctggtcgaaccaggtcgcatccggccggtccacgaccacgacagctggcgagcagccctcgaacgatcccggggcgccgtacctgccctctcagcggtcgccttctaggccctcggacaacgccgtcagcgggccgacgagtccgacgagcgcacagccggccgcctcccggtcgttcgcaccttacgcagcgtgaaggctcggaaggtgccgagggcatcgatcacgccgtcctgctcggcggtgaggaaatcgcgcagcgtcacgacgcccgcgatgaaccaaggaaccgctccaaagacccacaagatgcctgccgcgatctgttggtcagcctcgagcgagagcgtgcggagcgtccccatccattgctcataggcgctgtaccagggttgcgtcgacaacccgaggacgatcgcgaggatcatgcacgacatcgacacgatcaccatgtgcgcaaagcgcacgatgggcgactcgtgctggcgccgaggattcggatcgaccgcgacgtaccacatccagatccccgaggtgaagaagctgaacatcatgagctccatgcgcccgcccgaggccatggcccaatcgaagggcccagggagatgccagatccacatcgcagcgtcgaaggccacgaccgcagaccacggcgacgacaccacgccccacacgcgggcgatcggcgcatgtgctccgagccggccccacagacgacgcacggcttcccgaggtccctcgggcaccccggcgacgatctcaccccaggggtccgcgcggacgatgagcggtggcgcgaggatcatgagatcgaggtgccagatcatgtggacccactgatagaccatcgaccacgccgcgatcggcgagaacagcccgatggcgagcgcggccatcccacccagcatgagcagcgctcgccgctcgtagcccctgcgaagctccggatcgtcgagggtgcgcatcacgatgaggtgaccacgccaatagagcgcgatgggcagaccgaagatgatcaatccccaccagtcgacggaccagttctccaggacgtacgcaaccagaccatgtgccggctggatggccatgctcatgccaacgatccccacgtccacctcccaagcccgacggccgtggccccagtcctcaaggctagcgcagctaggctcagagcagctgagcgacgagtggcgcgcaggaggatcgggtgacccggacgatcggcgtcgtggggggcggccagctgggccgtatgctcctcgaggctgccctggccctcgatctccgcctcgccttctacatccgccccggcgagcagggagtcagcggctgggcgacgtcggtcgtcgaggggccactcgaggcaagaccactcgcgagcttcgcgaacagcgtggacgtgctcaccttcgagcacgagctcgtcgatccagccatcctcgcagcactcgaggcccaaggggtccagctcgcgcccggggctgtcgccatggcgaccggctcgaacaaggaacggcaacgagctctcttcacgacactcggcttgcccaccatcccggcccagctcgtcgaccgcgacgtgggtgaggtgcccacgctcgaacccccgtacctgctcaaggccgtccgaggcgggtatgacggacgagggctactgcgcgtcgacgcgacggttgagctcccgcgcaccgggcggtggcttgccgaaccgctcctgcccatcgcgtccgagtgcgcggtcgtcgtcgcccgagcggccaacggcgaggtcgcgacctgggatccggtcgccctcgtgcatcgggagggcatctgtgtcgaggcggcctggcccagcggtctcgaacctcgactcgagcgagacgtcgtccgtgcagcacgaaccatcgccgatgcgctggactacgtcggcgtcatggccgtcgagttcttcatcgtcgacgacgccatcgtcgtcaacgaaatggctccgcgagtccacaactccggccacctcactatcgaaggagcagtcacgtcacagttcgagaaccacctgcgcgccgtcgccggtctgccgctcggctcgacggagtcgatcggaccggccgtcatggtcaacctcatcggcgcccgacacctcgagcgggtcccgacggccgcacgcgtgcatcgctacgggaagacaccccggaccggccgcaaggttggccacgtcaccgccgtcgccgcctcgctcgacgacgcgcgtcggcgcgcctgggccgcagcgcgcgacctcggaggcgagctcctcgatgcgccctgggagcttccatgacaccccccgtcgcgatcgtcatgggttccccgtccgactggcccgtcctcgggcacgcagcgaccatcctcaccgaactcgaggtggagtgggacgcacgggtcctgtcggctcaccggacccccgacgacatgctcgccttcgcccgcgacgctcgcgacctgggattccacgtcatcgtcgcgggcgcaggtggcgcggcacacctccccggcatgatcgcggctgcgacaacgctcccggtcatcggggtgcctgtccgcctcgccgccctcgaggggctcgactcgctgctgtcgatcgtgcagatgccacggggcgttcccgtcgcgaccgtgggcatcgacaacgcgacgaacgcaggcctgctcgccgcacgaatactcgcgatcggtgaaccggggctcgccgatcgcctccaggcgtaccaggccgccaacgcggagcgctcgcgaggtgcggtactgcccccaccctcaccacactgaggaccaactacccaccagatggtcggtgtcctcgagcggctccggcgactggccgaccgatcgtcggcgcactgcgacgacgcacggcacccatacgcgctcctcgtcgagagaggaacgctcacgagcgttggctctatcaccgtcggtcggcacgacggatgcgggcaggtgcgtcgagccttcccggagatcgtcgaccgatggagcgctgtggtgcgaagcgatccacagctcgcacgcgccgagtgggcgcggggagccctcgctctcgagagcgccacgggcgcaaacgatcgatcggccatcgcgacaccgatcggctcctcaccagcgtggttcgctgtcgtttcggtcctcagcactcgaggacctcgcctcccaatcgagcggggacgaggcccccgcgaccgaaccgaccgccgccgaggccatcgtcaacgcctcgcgcgctgctcgcgagcgatataaccccatggcaactcgccggcccgatgaggcgtccgctcgcgccaaggaacaacgcctccgagtcaaggaccgcgccacacgggctcatggccgatggggccagacggccccacgcccagactcagcccccgatcgacgggcgcccgctcgaggcgtagccagcttgcaggtagagctgagaaccgacaggcgcacccgcataaccgttcaccgtttggccaaccgctggctgctgccacgaccgtgagccgatactcagctgctcgacgagagcgcctgcggccatcgtgatcaccagcgccacgacagccacgagcaaccacgccgtgactggggggatgcgatggatgggccgatcgtcgcttccacgacgcatcccgacacgccttcgcccgatcgccgccaacctgacctcctcagcacccagacaccctcaggctgcacgacgccgatgcctgcgccgtcgcacaaaccccgctggacacgaactcgttgcttccagcagccggctgccacgatcagcggacaggatcaccgacgagactcacaacctcgtgccgaggctaccaaacacgctcgtcgacgaccaagtccacagctaggagccctctgaacaagcccctccctggtggtggctgagcacgcccacccagcccgggaacgagcccagctgacccgttcccatctcgctcctcaccctctcctcctcgcccctcctgtggggcgaggaggagaggacccgagcgcctctcaggtggcaagcacccagccaccacccacccgggtgagccccaggcgaaggagcaccttcaggttccaggtggcacagagcagctcgaagtggagtcggttgcgcacgagccccaggtagcgcagcctcgcgccggagagcttgcgtttgagctgtgcgtggatccgctcgacgttcggtcgggtgcgctgatagtcgagacgaacggcagggtccccaaagtgcgcccgctggctgattgcgtgccaggtggcaggggtgaaggtgaggacccgtcctcgcttcgagcgcgtgcagcgatcccggagcggacagccggtgcagtgcttgacaaaggaagcacgacccttggcggagatgggtactcggtgtccttggggacagctgacccatccctcctcgacgacgaagtcatcgatggtgaagccaccagggaccgccatggcaaggggccgaggcttgatcacctcgtcgtggccacgagcggcgagctcgttggagacctcgctcgtggcataggcgctgtcgccatagaccgtgcgcgggccgtcctcgtcacgaaggagctcgctcgccactgctgcgtccggcacggtgcccttcgtgatggtcgcagcggtgacgatgccactgtctggctcgacggccacgtggcccttgtagccatcgatggcacgggcacgggacttgtggacgtggcgagcgtcagggtccacggtggagatgaccctgtctgtggctacccgcctcgcgatgcgccagcgaccttccttggcatcgacacactccacgtcttggcccgccacgagcccaaggagaccaagggcttcggtctgtggctcggtgagggatgcgagcttctctgcatgggcgaggtgggcagtggcatcggcgacgagggcactcaccgtgcgcaccactgcctcttcgtcccgatagtcgatggcaggctttgcgcgggtgtagtcgatcgctggtgacagaggaatgtcgcgtagttcggggatcagcctgcgtacccggttgatctgggcgacaagttgggtcatggtgtcttgggtggcaaccgcatcggcgagcacggtggagtcgacgacgcgcttcgtcttgcccttgagcacccccgtggcaccgatcacctcggccacgagttcgccgatgagtcttggggtctcggaggtggcgatgcgcctgcgccagtaggtgagcaccgtggggtgaaagcctgggtcctcgagatcaagaccaagggcgtacttccagcggaggttgtagcggacctgctctgtcgcctcggtgtccgagagcccctcgagcacctggagcaccatgaccgcgagcaccctcgaggcggggatggagggtctgccggtcgtggaggggtagagatggcggaagcgctcgtcggggaagagctctctgcggtgctcggcgaggaaggcgtagatggaccctggctcgatgagcgaggagcagaaggcctccgtcgcggtgaggtgtgcctggtctgattcggtgcccagcatgcaaaaagtctagctgagctgggcaaatggcgcttgacaggcggagggaagcgcttcccgtagccgccctacgtggaggagttgttcaggggactcctagaacgtcaacctgcacgtcgacagcggcgacctcgtcgagctcgcgttggccaaccgactaggacgatcctctcgatcgcgatcccctgtcagcatgcacgcctcgctaccgtaggacagcacccggggaggtgctagcgcgactcccttgcgtgcatcgtggtccttcgccgtctctgtctggctcgggttgcgaaacgcgcgactcgagacgagacaactcgtgacggttccgcctgggctccgcgaccccctcgagcccagccgtagtcgcactacgcgcagccgcctcgttctcggttgcgatggctttcaggagttcgtctcgcacgatgcgcacgtcacgtggcgcgacgatgccaaggcgcacgccgccatatggatcgatcgcaagcacggtcacgacgatgtcgtcaccgatgacgatcgattggccgagcttccgagccaagacaagcactagcgagacgtgccacgcatgagaccaacgacgtcacgagtggtcgcgacgaagatcccggcactgatccccaccaggaggacgccgatcgctccgaggaagagcatggccaagccgagggcccattgaccaacgagtcgttcgcggatcaccttgtcgacgccagcacctgcaacgaacgcgaggaggcagcctgcgagtgttccaccagcaagcgtcgccatcacgatgaggagcatgggaacgagccacgccgccgccactatgaccacgaactagggtgactgaagacgtcaataatgcaaagccaatgaaccacggccaactatgccgaagccacgaacggcgtgcgaggcgacgccggcgtcgcacgcctgtcggaatcacacttacccgcacacgcgaccccacttcggaaatggaggattacccgaccctccatactggccgttcatataccagtagagatcgccgttgggactttctaatggctgatcagcaacagcatgcgcggtagggaagctgaaatagtctgcccatgtcggcgtcgcgagcgtgacgttgagcttgccattcaccatgacccaagacgacgacgatttacacaccacgacgtcgattgcgttcttcgtcggatgcaccgcgaactgcttgttggagatactctgctgataaaacgtcttcggtgaaggcagataggtctgattggtcggcgtgatgctggcaaagaacgatgcagtcggtgcgacattggcgttcgcggtcgagaggtactgcgacagcatcgtcgacgccgggattggtccgttacccgcatacgggtcgaagagctgcgccacatccggcagcacggtgacctgaccgttctgctcggtggtggcatagctcgagctgtagagcccgcccatcaccccgagggtgcgcgccgtgtagaccgcatcgcgctcgagcggcgtgagcttcgtgccgacgtagaccgggccgacatacggcacgctggtgtcgttcacccatgcgccgagcacgctcggcttcggcacgcgcaacggcaccgggatggccgggtccttgggcggaatgagcaggttcgacagcggcaccgagttcggatcgccctggtagatgggcagatcgttcgcggcgtcgaacggatactccttctcgagctgcgcgagggtgaggttggtcggcgcaggggccgtctggctcgagctgctcgacgaggcgttcagcgagctcggcacactgggctgtgacgatgagccacacgcagcgagcaggatggcgctcgtgccgatgactgcgccggctgttgccgtccgcaagcgagtctttctgtgcatcactcccctccttgacttgcactcagtataacgcgctgaccatagtgcgtgagaagcaccgcatgatccgagtgtgacacacgagacttgcgaacgcaagggccggaggtccgtgcgtcatccctcctaccgagagatatgcgtgtgcaacgaccgttgcccgtagtaaccacaaccgatgccatcgacctactgtccgagcaggtgcagcgcgttcgagaggccagcgttgccgaggaacagaccaacgatgacagtccccacgaagacgaccatgtacgggagcaggagcaacgaagcggtattctgtcgcgagcgaagcgtctgatccacgagatctgtggtctgacgccaggtttggtcgatgagcgaccgcaggaccggcaccagaggtgcgccggtgcgctgagcctgcgcgagcgcagagcccagcgtgaccatgatcccgacctggtaggtgcgtccccagtcactccagacctcagccagtgtgcgcttggcaagaccggtcatccagtcgttcagccaaacacgcccacgagggttggcatacgtgccgtagacgcgaaagtactcgctcatagccgactccattgtgccggcgccggcggtgagagccagccggaggtaggacaggatcggtgcgatgagcagggcgctctcagcacgagcagccttggcctgactgcgaaggtatgtctcggcgaagacgaggcccccagggaacgcaatgatgatgccgacgatgccaccgatcaacgcgaggttcatggacatgagcttgatgaagacgagtaccccgagcgtcgcaacgatgagcagtaagagcatgagcgacatgcgcatgacgaaggacgcgaactcgtcggtatccatcccgagcaagtgaagatcgacctggagcagctcagaggtcgtacgccgttcgagggcgttcatcacgaagcggacggtcgccgagccgctgcgagtacgcgaggggtggtcatgccatcgcgtgaggcgtcgagatcggcggtatccaatcaagccacgtacgccggcgacgagcgcgatcgcgaacaggccagcgagaatcgagatcccgagtggtgacgagaaccaagccattgacgtctcccgaactcaaacaaaccacgtcgacagcgcgaacggcctgcgagagaagccgacgacgacgatcgtgatgaccagcaggatgccgaacgcaagctgcatgagtaggctcgcaaagagatggtgctggtagacgctggcgtagtaggcaccggcaccaagcgacgtcaagatgccaaaaccgagcaggatgcgcgccaccgtgatgttgggcacgatgtaggtgcggtaggccatctcgaacgtcgtgagctgaggcgtgatggcctcgaggaggtcctgcacgagcggcgccacactcacaatgcgcgatccagccgtgaggatgacgacctgatcgatgacgcgactcggtggatcgtcagcggtggcgatgagctgctcgatgttgcgctcgtgatcctcggggtcggtcgcatcgaagatcgcctcgtagatgcgctgacgactgcgtacgaagaggttctccgggttcgcagcaagtgccatgcgaacgatcgagaccagcgagacgttaccaccgctcgtcgcggtcgacgcgagtgatgccgcgaaggtctggaggtcgcgcagtcgttcgatctgacgttgcgcgaatgtcggcgtgacgtaggtgtcgacgaagatccacgccgctaccccaccggcgatcgcgaggatcaggtagtgcaagagaccaaaaacaacgccaaccacggcagcgatcgcgagacgaatgtcgatgctaggggatccaaaggtctgataccaagcaaccttgacctgaccaaccgtaactgaggcggccttgatcggttcctcgagcttggggtcggtgggatctgcgcgaaacacgaggagcatgccgaccacgatgacgacaacgccaaccacggcagcgacgacgagtgctccggttggggtcatggtcgaacctccgtggactcggtgagctcggtctcgagaagccgggcggtcacgaggagttgctcgagtgcgccgtggcgccgacgccggcgccggtcacgggagtcgaagacgagtgactggatatccgggatcaagacgtcgccagagagcggtggcgtcacgagcagagggatctgactcgcgccgagcgacgcacgaaccgcatcgacgaaaccgagggcccggtcagcaaggagcacgatcgctgagggcgtgagcccgtcgcgcacgagctgagtgagacgaccgaggtcgctcggcgtgggagccgtgacgaggaccaagcgctcacaactgctgagccacttgagcggtgctgacgtctcgtcaaagatgtaacctgcgtcaacgacgctgtggacacgacggtcttgaccagcaagccaatcggccatcgcggtgagcaccgtcgcgagatgagaccgcgtcaagatcccggccatgggatcggccaggagcgtcggaagagatcgggcctcttcccaccgttcgagggaatcgagcacgacaccactggcaaggtccaccgtggcagcaaggacgatgccggcggacagcgatgaggcgtgttcactgatcgcggcagcgatcgcacgctgacctggcggctgaggagcatgctcgcgatcacggatcgcccatgtcgattccatgccggcgatctcgatgagcaggcgtcgtccaggaacgctgtcagcaagcatcgttgcaaggacgcccgtcgggagatcggtgctcgtggcgacgacggcagtacgcatagccctagttgaccgtatgcgtgtggaccgacggctgaagctgcacgatggggacgggctttgcgttcggcggagcgaaggcgatgaccaggttcgaagtgtcagcgacggcagcgatgtcgctcgcctcgttcggtgggacctcgatctcgagctgcgacgaaccaccgttgctcgacgggatgacagcaaggacgggaatcgctgtggcgaccggaatgtacggtgcaggggcggtgtaggacatgggcgcgttcgacgacccacttgacgaccccgacgcctgggcctggagcggagcgtaaatgtccaccgtgtcgccagccgtgagattcggggggatgacagaaggcgtcaacacaaagacccggtagttgccacgcaggtgcggcgcgagctcgctcacgagcacgggagcgttctgtggaatcgtcgtcgtcacgacttgattgttgagcacacgcacgttggcgaccgggatcatccccggcgtgaccgactgctgtggcaccgcctcgacagcgaggtctgacttcgtcggcacttcccctgggacgagtggcttggctgccacgacgatgtcgaccgtctgcgactgcttggagaagaacgagtagaccccaagagtaacggcggcaccgagcgcgacggtaccggcaatcttgagagctacagaccgacgctggcgagcaagtgtcatgcgggtctcctttgttggtgtgagccgccccagattccgttgacacgtcgtaagtcacacgtaccatggcagagggaaggggaggtcgatggggacgtcgagaaggaagttcaccctggagtaccggaccgaggcggcccaccgggtcatcgacagcggccggagcgtcccagaggtggcccgtgagctcgcgatcggggagcacaacctctatcgatgggtgcgggaggagcgcaggcggatcgaagcagcaaacgccactggcagcccgcccctcacggcgcaggagcgcaccgagctcatcaggctgcgcagggagctcgaggagctgcgcaaggacaacgagttcctgggaaaagcagccgcgtacttcgccgcgaagccaccaagcaagagagattcgcgctgatggaggcggagtacgctcgcttcgagatcaaacggatggcacgcttactcgaggtctcccgggctggctactaccgatggcgacgcacccaggtagcaccgtcgcgtcgggcatgtgcaagacgcgacctcgagaaccgagtggtcgcggtccaccaggcatcctctggcacctacggcgcacgacggatcacggcggcactcctcgccgctggcgtggtgacgagccacaacacggtggcagcagcgatggccaggcgcggcatcgccggtatcagccccaggaggttccgcccagcgaccacccacgccgatccgaaggcgatctacccaccagacctcgttgccaggaagttcgacccggggcgcctgcacgccctctggacctcggacatcacctacctcgctctcgccggcgcgatggcatacctgtgtgtggtgcgcgacgagcactcgcggcgggtgctcggatggagcgtcgcggagcgcatggagaccacgctcgtgctcgaggccctcggccaggccgtcgcggtgcgtgggtcccacgcgcagggggtcatctggcacaccgaccgagggagtcagttcagcgaccatcgagttgtggccttctgtgcccgacacgggatcacgcgctccatggggcgaaccggcacctgctacgaccacgcgagcgcggagtccttctggtcgatcttcaaacacgagttcttctaccgccacgcctttggcgacctcgccgagctgcgccgcggcatacagagctacatccagttctacaaccaccagcgcagctgctcgaagatcggctaccttgccccagtcgtcttcgagcacctcgtcgcggaggaggctcgcgtgaagtaacctgggtgtctacgaaatctggggcacctcagtgagttgcgctcagcctaatcgcaagggacatgtcgtgagttgcagtgatgtgcgtgtgcctaggagccctctgaacaagcccctccctggtggtggctgagcacgcccacccagcccgggaacgagcccagctgacccgttcccatctcgctcctcaccctctcctcctcgcccctcctgtggggcgaggaggagaggacccgagcgcctctcaggtggcaagcacccagccaccacccacccgggtgagccccaggcgaaggagcaccttcaggttccaggtggcacagagcagctcgaagtggagtcggttgcgcacgagccccaggtagcgcagcctcgcgccggagagcttgcgtttgagctgtgcgtggatccgctcgacgttcggtcgggtgcgctgatagtcgagacgaacggcagggtccccaaagtgcgcccgctggctgattgcgtgccaggtggcaggggtgaaggtgaggacccgtcctcgcttcgagcgcgtgcagcgatcccggagcggacagccggtgcagtgcttgacaaaggaagcacgacccttggcggagatgggtactcggtgtccttggggacagctgacccatccctcctcgacgacgaagtcatcgatggtgaagccaccagggaccgccatggcaaggggccgaggcttgatcacctcgtcgtggccacgagcggcgagctcgttggagacctcgctcgtggcataggcgctgtcgccatagaccgtgcgcgggccgtcctcgtcacgaaggagctcgctcgccactgctgcgtccggcacggtgcccttcgtgatggtcgcagcggtgacgatgccactgtctggctcgacggccacgtggcccttgtagccatcgatggcacgggcacgggacttgtggacgtggcgagcgtcagggtccacggtggagatgaccctgtctgtggctacccgcctcgcgatgcgccagcgaccttccttggcatcgacacactccacgtcttggcccgccacgagcccaaggagaccaagggcttcggtctgtggctcggtgagggatgcgagcttctctgcatgggcgaggtgggcagtggcatcggcgacgagggcactcaccgtgcgcaccactgcctcttcgtcccgatagtcgatggcaggctttgcgcgggtgtagtcgatcgctggtgacagaggaatgtcgcgtagttcggggatcagcctgcgtacccggttgatctgggcgacaagttgggtcatggtgtcttgggtggcaaccgcatcggcgagcacggtggagtcgacgacgcgcttcgtcttgcccttgagcacccccgtggcaccgatcacctcggccacgagttcgccgatgagtcttggggtctcggaggtggcgatgcgcctgcgccagtaggtgagcaccgtggggtgaaagcctgggtcctcgagatcaagaccaagggcgtacttccagcggaggttgtagcggacctgctctgtcgcctcggtgtccgagagcccctcgagcacctggagcaccatgaccgcgagcaccctcgaggcggggatggagggtctgccggtcgtggaggggtagagatggcggaagcgctcgtcggggaagagctctctgcggtgctcggcgaggaaggcgtagatggaccctggctcgatgagcgaggagcagaaggcctccgtcgcggtgaggtgtgcctggtctgattcggtgcccagcatgcaaaaagtctagctgagctgggcaaatggcgcttgacaggcggagggaagcgcttcccgtagccgccctacgtggaggagttgttcaggggactcctagcatggagtgcggaggtggccgggcggccgcgggtgacctcggtcacctgaggaaggtcggggctccagagggcagggtgctcgcgagaggcgagtcggggtgacccgcaggacagtgcaacagagagcagaccgccgatggatcgacgatcgatcacaggcaagggtgaaacggtgcggtaagagcgcaccagcgacttcggcgacgaggtcggcttggcaaaccccacccggagcaaggccgcagtggagcagggtggcccgcccgtcacgctcctggtaggccgcagagatggatggccgcacaggcggccgtttgggccgctggacagaaccccgcctataggccacctcccgccaatccttcgcccacgagccaggcgccacacgattcgcaatcgacgtcccgccctgccgcgaccgcgccaaggaccgcacccgagagctccatgtgacaggccgaacaacgaccagcgatgctgagcgccaacgcgcgcccacgcttggcccgagcttcgatacgcgccctgagaccagggtcgagtcctgcgagcgcctcggcccacgccgcctccgccgtgcgcacagcctctcgacgctgctcgcgctcgacgtcaagggccgcccggagttcggcaacggtcccaccgacggcgtcacgctgggcagttacctcatcgagggaggccacgaccgagtcgcgctcctccatcgcctcgagctcggcctcgtcgagttcctcgagcctggagcgcaccatggtcgactcggcctcgagcctggattgatcgcggaagccggcatggtcgccctgtccacggaggcgagccaggcgttcaccgagttcgtcgcgttgcgactcgagcgcagcgatgcgtccctcgacctcacgacgttcggcttcgagagccgccacgcgctggacgagctcagcgtgttcggcttcagcagcacgcagtgcggcagatggccggaccgcctcgagcgccgctcgcgcacgcgagagtcgttcctcgacggtagcgatctcgatcagctcctggcccatgggcaccatcctacgccaggcagcaagagctgcccccgaacgcgcgacagactcggtcgtgccgatcgcagcgcatgcgtcacgccgccacggctctcgaggccagcgcggcggacggcctcgccaccttgagtgcacggtcagtggggcaaggcgctagctcccctcacgagggaggaccgcctccacgacgacccgggtaccagcaacgcggtcgtggagggtctggcgagaaggatcgagaaatgcgacgagatagcccgtgaagagcatgacgaacgacagcagtgagacaacgaagcgaatgctcgcgcgtcgcatgccgaccgggccaccgtcttgagcctcgacccgaaggtgcgcagccgcctggccgagcgtttgggaacgcagtccgatcagcacgacgaagtaggcggcgatggcgagtgcgttcaggacgtagtcgaacaccggcagctcgaagcggtcgacctggaagatggggttcgacaggccagcaagcccgccgaggatcagttcgaagatcaccgagccgagaaacaccacgatcaggtcgacgatgagtccccacaaccgtcgccacggcgacgcgagccgcgatccgccatcagccgcactcataccctcgacctcccgcaccacatccgtccgccacgtcgaaccgcacagctcgaccacgagcccgggaaaccacgaccgcgccagtcgatgcaccatccgggagcgcgaagtactcggcacccgtcgacctaggccacctcatcaagcctagcgacgccaccctcgggagttcctgaggtccccgtcgctcgcgcccgttcgcgccagcgtcgctcggcgaacccagctgccgccatgatcacaagaccgaggacgccgacgacgacacctgcgaccgcaacggttcggaacccgcccaccccatagaggagcgatgcgctcgacgatccagcgacgccgccgaggaagtagcacaccatgtacaccatggtcacgcgcccctgggcgcccggtgcgagcaggtagatcgccgcttgattggagagctgagccccttggatcccggcgtccagcgtcgccgtgagcaccacgaaccagagcaacgacgaccgatcgaccgccaaggcgagccacgagagcgcgatcaggctgaacgaagcgaccgtggtgaccccggcgcgtcctcgatctgcctggtggccaacgacgcgggccgccagcacgcctgccaggcctgcgaagccgaacagcccgatgacgccggtcgagaggtggaacgggggccccgagagtgcgagtgccatcgtcgtccagaacatcgagaacgcagcaaagctcaagaacccgagtccggcccgcagtcgcagcaacggctcgcgccgcaacaacgccatggccgtccgatacaacacgacgagcgatcgctccttcgcaacccgctcgtgcggcaaccatcgggcgatcgcgagcgcgagcacgatacaggcgacgcctgcgacgacgaacaccgctcgcacgcccgccacctgcgcaagccatcccgcgtaggtgcgcgcgaggacgatcccggagagcaggccagccatcaccgccgcgaccgagcgtgcgcgacgagccggctcggctgccgcagctgcgtaggtcaccgcgagctgggccaccgacgagaagaccccaagtccgagcaggccgatggcgaacacgacgacgttgccggcgaaggcgaccaggagatcgaacgcggcgctgacgacgatcgtgatcagcatgagcctgcgacgatcgaagcgatccccgagtgggaggagcgtgccaagcccgatgacgtagccggcctgcgtgacggtgacgagcagccccgggctcccgccgcgaagaccgaaggtgtccgcgatcacgtgcagcaacggctgcaggtagtacgtgttcgcgaccgtgacgcccgcgacgagggcgagcaggacgagcggaagccgaggagcgcgttgccgtggaatagttgcagtctacgaggacttcatcgccctccggaggtctctacactgaggtggcccgagcttggaggtgtccatggacgcactgcactgcgtgatcgagatcccgcgtcactcccgcaacaagtacgaggtcgaccatgagacggggaccgtctggctcgatcgcacgctgttcacgccgatgggctacccgcttgactacggctacatcgattcgacattgggcgaggacggtgacccactcgacgtgctgctgtatctggatgtgccgacgtttccagggtgccatgtgaagggtcgtccggttgctgcgttcgtgatgagcgacgaggccggtcgcgacgtcaagatcctctgcgtgccccatggggatcctcgctacgaccacattcgtgacctcggcgacgtccacacgcacctccaacgggaagtcgctcacttcttcgagcactacaaggacctcgaaccgggcaagtcggtcgcgatcgaagggtgggcccccctcgagcaagcccagcgtgagatcgatgcagcgctggcgcgcttcgagcacgcccacggcaacgcctcgccgagccactagcctggcaggtgacgtccacccactggtcgcgccagcgaccgcgagctgggaaggaggcctgcccatggactcgccgaacgacgaacgcgatcccgaggccgtccgcgacctgatcgagcagctgcggccggcggtacagtacgacggtggcgatctcgaactcgtcgacgtgaacaccgagaccggcgtggttcgcgtcaggctgaccggcgcctgctcgagctgcgccatctcgacgtcgacgattcaactcggtgtcgagcggatcgtcaagggtcgcttctcgtgggtcaccgcggtggagggcgaactcgacgaggagttcgacttcgccgcctcggcagccctcggacgcggcggctgggtaccgcttcggccccccaccaccgcgtgaggtgcacgcccactcctcgcactcggtgacgcgcgaggcgtcggccgcgctggtagagatcacgcggcccgagcgcgccaatgcgttacgcgtcgacgacgccgaggcgctcgccgcgaccctggtcgcactcgacgacgaccccggcgttcgggccatcatcctcctcggatctcccaggtacttttcggccggcgcggacctcgcagacctcgcagacgaggatgcactcgcccatatcgaccgcatccaccgcctgcttcgacaggttctcgcactgcggaccccgacgatcgccgccgtacggggcgcagccgtgggcgccggactgaacctggcccttgcgtgcgacctcgtcgtcgccggcaccagcacgcgcgcgagcgagatgttcatccaccgaggcctcacgctcgactttgccggctccgccatcttgagcgcgcggatcggtccgcatcgggccaaggcgctcgccttcttcggcggcacgctgaccctcgacgagctcgccatgctcgtcaatcgcgtcgtgcccgacgacgaggtgctcgacgtggcccgtggctgggctcacgatctcgccgagcgctcgccacgcgccctgaccttgagcaagcgcctcatcgaccaagccgcgccgtcactcggatcggcgctcgatcgcgagatcatcgcccagctcgccgcagccagcgatccagcaacacgcgcagagctcgagcgatggcgctagccccacgttggatcgaagacccgctgacaggcctcgaggccgagctcacggtcgtccagccgtaccaggcccacaagtggtatcgctgcccgggatgcaacggcgacatcgcaccgggaaccggacacctcgtggtcgtcccgaccgacgcaaacgacctgcgccgtcattggcaccgcagctgcctcgactgggagctccgccacggccatcgccgccggcaccgacgaacgtgagcagtgtcctcctagagacccgctctcgtgagcgctcggtcgagatcgccccagagatcctcgacgtcctcgagaccgaccgacagtcgcacgaggccctctccgatacggtcctctccggggtagcgtccccggcgctcggccaggctctcgacaccccccaacgacgtcgcgtggtggaagaggctcagaccatcgagcatggcgtcggcttgctgggcactctcgagttcgagggccaccaacgccccaccagccgactgctgccgtccggggccgacgagctcggagtcgaagccgggatagcgcaccgtgtcgccaaggcgatcgcgaagccgcatcgccaaggtggtcgccgtcgcgctggctcgttccactcgcacggcaagggtgcgcagaccccggaaacacaggtacgcctccacgggaccgatgatggcccccgtgagctcgcgcacctctcccacgcgcgcaacgaggtcctcgtcgctcgccacgagcacacctccgaggacatcggaatggcccgagaggaacttcgatgccgagtgcaccacgacgtcggcacccagcgtgagcggccgctgcagcaccggcgtcgcgagggtcgagtccacggcgagcagacctccgcgctcatggatccgcttcgcgagcgtcgcgatgggataggtcaccaggagcgggttcgatggcgtctcgatcagcaccaccgagccgggagcaaggcgatccaggtgcgcatcgaggtcggagggctcaacgagctcgatgcccgggatacgcgcaccgagccacctggcgagctgtcgcgttcccatgtacgagtcggccacgacgagggccctcggaccaagggcgagcagcaacgcgaacgttgcggccgcacccgaaccgaaggccactgcggtaccaccctcgagctcaccgatcagggcttcgaaggcctcccaggtcgggttcgtgtggcgcccgtaagcagaacgctggccctcgtagtaggtggcattgagcgagaccgaaggattcggcccgaagagacggtcctcgctcggcggcaactgcaagagggtcgcgatcgaacgccgttcgaccacgtcgtcctccggagtggccatgctcagctgggatcccgtcgaggaagctcctcgacgttcacgtctcgaaacgacaccacccgcacatgatcgacgaagcgcactggacggtacatgtcccacacccaggcgtcgtgcagttcgatctcgacaaagctcaatccggcctccgccttcggctgcacaacgaccgagttcgccagatagaagcggcgctcggtctcaaccacaaagcgaaacagcgggagtaccgccttgtattcctggtagagacccagctcgacctcggtctcgtaccgctcgagatcctcagcactcatcgagcaacgccgtcacgctggcggtcagcgcttctccttgaccttcgcggcgcgaccgacgcgcccgcgaaggtagtacagcttggcacgacgcacgtcgccccgggtcaccacttcgatcttggcgatcgtgggtgcgtgcacggggaagatgcgctcgacaccgatgccgaagctcagctttcggaccgtaaaggtctcctgcgcgcccgacccgtttcggccgatgacgatgccctggaacacctgtacccgctcgcgagatccttccacgacccgcacgtgcaccttgacggtgtcacccggggcgaactcgggaacgtcctcacgtagcgaatcagcatcgacgagatccgtggccttcatcttcgaccctcttgctccttgacccagcgtgcaaccaggtcagcatagccgtagcgctcgaggagcgagacctcttcgtcggcgagtccgccccgtgcgacgatcagatctggacgatgtcgtaacgttcgagcgagcgcagcggctcgccgccaacgagccacctcctggtggtcgccactgagcagcaccggggggacctcgaggccctcgaacgaacgcggcctcgtgtactggggatattcgaggagcccctcggcgccgaaactctcctcgaccgccgaggccgtgttgccgagcacgtgtggcaccaggcgcacgaccgcttcgatgaccagcagcgccgcgagctcaccgccttggaggacgacgtcgcccaccgagagcagctcgtcgaagacgctgtcctcgaggcgcgcatcgaagccctcgtagcgcccgcacaccaacgtgaatgcatcgaggtcggcgagacgctcggcctcgcgctgcgtgaatctccgcccagcaggagacatcccgatccagggatggggggcgtcagccacacgcagagccgccgcgaagggctcgggcttcagcaccatccccgcccccccgccaaagggagtgtcgtcgacggatcggcgaggatcgtccgcgaagcgacgcacgtcgatcacctcgtagtggaccgcttcgtcacgtgctgcccgcccgaggatcgactgcgtcaagaccccctcgacgagcgccgggaagatcgtcacgaccgcgatgcgcatggccgtgctcagtcgtccaggagcccgggcggaaggtcggcgaccacgtagccgtcggcgacctgcgtgatgaagatggaggggaccaaaccacctccttcgaggaccagcaactcgctggccgggttcgcctcgaccgcaacgatgcggcctcgatcgacgccatcggcgtcgacgagtcgcgcacccacgagatccggaacgatcaccatgccgtccggcagtgcgacacgctccgcccacagggagtgccctcggagctcctccgcggcttctcggctctccacgcctcgaaggcgcacgataggccggtcgggttggccccgcacctcagtgatcaccatagcgacctcgtcatcgagccacacgtgggcgtcggcgacgaatcgtcctgggacatccgagacgtggtgaagcgtcacagcgcccttcacgccgtgcgggcgcccgatgaccccaatgcggaccctcgaactcacccgcggccgcgacgccctccggatcggccccgaggcccacctcgccgaggtcgatcgtgaccatcggagaacgacacccgcgtcgacagaccagaccgctgcgcaagcgccgcgaccaccgtgcgcaccgccgtcgcggtacgaccaccgcgaccaatgactcgaccgagcgcttccgtgggaaccgtcaccgagagcgacagctcaccatcgcgcaccggctcgtggcgcacgacgacgcgctcggcaacctccggcgcgagtgatctcgtgaggtacaggacgagcgacgacgctcgctcgattgcgagcccctgcgtcggcgagatcgacggctcgctcgtcgcgggcacgttcgcggagtcgtccactactcggccgcctgcgctcgcgcgagctccaacagcttcgcaacgcgctccgatggggtcgcccccttcgcgatccacgactcggccttcgccagatcgatcgagaagctcgacggctcctggcgtggctggtaccaaccaaggatctccaggaaccgaccatcgcgaggggtccgcgcatcggcagcgacgatgcgatactgcggctgcttcttcttgccggtacgagtgaggcgtagccgcactgccatcgagagggactccttccgttccaggtgcgccaactcgggcgctcggtcgaacagtctagacgcaccgacctcgccgttacttccgcttgcgccgaggaggcttgcgtcgcttggtcgcactcggcgcgccaacacccgcttggcggagcaccttgtgcacgtcgcgaaactgcttgagcagcgcggcgacctgcgctggttgtgtgcccgagccacgcgcgatccgagctcgcctcgatgcatcgatcatggtcggattgctccgctcttccctcgtcatcgacgagatcatcgcctcgatgcgtgtgagctccgcatcatcgatgtcctggttgcgcaactccttgggaactccgggcagcatggccagtacccccttcaggggcccgagccgacggacctggcgcatctgctcgagcagatcgttgaggtcgaagcggccctggcggagacgatccactcctcgctgggctacctcgtgatccatcgtcgactcggcccgctcgatgagtgagagcacatcgcccatacccaggatgcgcgatgccatgcgatcggggtagaacggctcgaagtcttcgagcttctctcccaccgaagcaaaggcgatcggcttgccaaccacctcgcgcaccgagagcgcagcgccccctcgtgcgtcgccatcgagcttggtgaggatcacggccgagatcgagaggcgctcgtcgaacgcctgagccactcgtaccgattcttgacccaccatcgcgtcgacgaccaggaagcgatagtgcggatcgatagcctccgacaccatctgcacttcgcgcatgagggcttcgtcgatggccaggcgacccgctgtgtcgacgatgacgacgtcgcgcccaagtcgtcgcgcctcggcgacaccgtgacgagcgaccgtcacgggatcgtccccgtcgctcacgacggcgacgccggctcgctcgcccaagatccgtagctgctcgatcgcaccagggcgctgcaggtcggccgcgaccagcaacggcgaccgtccctcccgtagctgcgcgagcgcgagcttcgcagctgcggtggtcttgccgacgccctggaggccggccaggaggatcacggtcgggggtgtcgaggcgtagcggagacggaagggctcgccgccgagcacccggaggagctcatcgtgaaccgccttcacgacctgctgcccgggggtcagcgatgccgacgccatcgcaccgacagccgcctcttcgacgcgggcgaggatcgtgtcgaccacacgcaccgcgacgtccgcctcgagcagcgcgactcggatctcggcgagcgcttcgtcgacgtcgcgctgggtcagtcgactcttgcggcgaagacgacccagcgctccgtccaacctgccactcagcgtctcaaacatcggcctcgtctcctcgcatggaatcgggtcccgcctccgatccactcatgtcgagcaaggcatcgacgaagtcatcaggatcaaacggttgaaggtcctcgagggcctctcccaccccaacgagcttcaccggcaccttgaactcgtgctcgatcgcgagcgcgataccgcccttggctgatccgtcgagcttggtgaggacgaccccggtgagcccagtcacctcgccgaacacgcgggcctgactcaacccgttctgtcccgtcgtcgcgtcgaccaccaacaagacctcgtcgacgtggccggccgccttctcggcgacccggcggaccttgccaagctccgccatcaagttcgccttgttctggagacgccctgcggtgtcacacacgacgaccgcggcgccacgcgccttggctgcgtcgaccgcatcgaacacaacggcaccgggatcggcaccctgctggcccgccaccagccgaaccccggaacgctccgcccagaccgcgacttgttccgttgcggccgctcggaaggtgtccgcagcagcgatcaccacatctccccgctcgcgcaagcgcgctgcgagcttgccgacggtcgtcgtcttgcctgccccgttgacgccgaccacgagtatcacggtcggtagctctgccgctaccgcaagcgatcggtcgccactcaggaggcgagcacgcagggctctccggagagcctgccagaggtcatctgccgacgcgccgcgtcccgtctcacgtcgaacctcatcgaggaccgccgccgtcaacgtggggccgagatcactctcgagcaggacctcctccatcgtctggaagagcgcgtcccgatcgagcccgccgattcgccgacgcaggtcccggaaccgacccgatgagcgtcgcatcgcaccctcgagggtgcgcggacgagactgaccgatgaccgctgcggcttcgtccggcgctgccgattcgctcgccggaatcgactcttcgcgcgcatgcgggcccacgcgtggacgacgacgaacaagcagtgccgccgtggcaatcgcgaacacgagaacgaccagcaatacgatgtccaagaccatcgccaaagagcgtaggcgaccggcacaggagcgtcgccgaccaggcagacgccgtgctggccgcgacgtcaatcaccattggtcggtcgggcagcgccaggaccatcgctacgaattcttcctcggcaactgcaacgctgggctcagtcgtagcgattgcccctgttgccgccacaggggcgcggccctaggacaaggaggaactatggcactcggagtcggctcactgagcaagctactcagcatgctctcggcaaaggccgccatcgcgaccgcatccgccgtcgttgcgacaggcacggtggcagcagcggccactggaaaccttcccgcatcagcccagaacgtagcgtcacagctcgcggcgtcagtgggcatcacgatcccaacagccacggcagtagccccgaccgcgtcagcgacgccagccactccggcgacgccagccactccggcgactccggcaacgccagccactccggcgactccggcaacgccagccactccggcgactccggcaacgccagccactccggcgacgccggccactccggcgactccggcaacgccagccactccggcgacgccggcgagtcacgacaactcccctgacaccgcacagcaagagctccagtcttccaacgaccatcagcagagcacggatcagcagagcacggatcagcagagcacggatcagcaggtcgccaatcccgggaccacgctgacctctcctgctgggacaacgagccaggacggctcgagcagcgactctcaggcgagttcaagcacgcagagcagttcatccgacaactaaccgagcggacgctgcacgcgccacaccacaccatcgcagcgtgcaggcccagtggaacgaggagcgaacatgccggaggcggcgatgtcgaccgacgacgcgcaacgcgagtccgtcgacatcgatcgcctccgtacaggcgacccggacgaattcgggcgatgggtacgtcacgttggcccggccctacgaggattcctccgcgcctcaggagttgcagacgtcgacgacatcctgcaggatgtgtggcttcggctggtccgttctctcagtcgcttcgacggcgacgaagacggtttacgccgcctgacgttcacgatcgcctatcgatcgcgtgcggatgcactacgcgcgcttggacggcgccgcgaggtcgctttcgatcctgccgaactcccacatccgacgttgtcgccggaggacatcgatgacggcaccgtcacagccctcctcagacggctaccggagcagcaagcgctcgtgatcggccttcgtgtcttcggcggcttcgctgccactgaggtaagcgacatgctcgggatacccgatgcgaccgtacggagcctcgcacatcggggactcaaggccatggcacggctcctcgagcaacaatccccgtcgtcgctggaggcaccctcgtgagcacttccaccactttcaccgaccgcctcacggcgcttgcgagcgaggtcgcgctcgagaccagggaacaagagctactggcgacggtctgcgcacggtcgtctgcttggccgacggaactccccgacagctacgttcgcaacgtcacggagctggtcacagcagagttccgcaatctcgcagcatccaccaccagccagcgtcgtgccacacatgcgtgggcctcgtggttccgctctcgctggctcatcgtcgcggcggtcctgagtgccgcaagtgggggcgtcgcgttctccggtgccctcgcccacgctctccaccgtgtggagtcgatcgtcctcgccccgacgccaagcacccaccaagggacgctgaacggttcgcaaccagccattggctcatcggccggcataccaccgtcgggtcttcgcgaacaggggggccaacagtcctctggctccgcgacagcgacggcaaccccagcgcagagccgcgacaccggcgacgaacaccacccgcttggaacggtacgatcaatcccttcgtcatcgccaccggtcgaatcgcctacgccgaacgaccaagcacccccatccgacatcagccagcaagctggcgacgcttcctcgtcgcctgctccatcggaccacacggacagctcctcgagcccctccgaccagtcgaccagtacgaccgggtcatcgaaccagtcaaacacgacatccacgtcgcaggaccagtcgagcagtgcgaccgggtcatcggaccagtcgaacacgacatccacgtcgcaggaccagtcgagcgccgctacgtccagcgccagcagctcgaacccagacaactaggcgacgaagacccgtcggagtccgcgagcgacacgggacgtcgcgtggctagtccgtcgcgacctgaacgccctcaaggcccgcctcgccaaggtcatgacgcacgaccgtcgatactccgctcggcgcaatcgagacaccaagcagcacatcggcggcctccatggtccgtcgctggtgggtcaccacgagcacctggctcgagcgtcccacccggcgcagcagttcgaccagacgagtcagattgcgctcgtcgagcgcggcgtcggcttcgtcgagcacgagaaacggtacgggtcgaacctccagcatggcgaacaacagcgcgagccccacgagcgagcgctcgccgcccgacagcaacgccaaccgacgcacgcgcttggttggcagatcgacatcgacacgaaccgtcgccgccagcggatcggcaccagcctcgagctcgaccgaaccgcctccgccagggaagagctccccaatgatgctccgaaacgccgacccgacctcctcgaccgtggtcagcacgcggcggcgcatctcctcctcgagccgctcgagtccctcactgatgacagcccgcaccccacgggcctccgcaagcaccgcgccgagctcctctcgtcgagcgtcgagctcgcgcaactggacactcgcgagaccgttcacctcgccgaaggtccccaaggcatcttcgacctcgtgcaacgtccgctcaacgtcgttcggtgcgacatccgagggcaggcgggcaccttcgatgtcagcgagctcgacgtggaggcgaaggcaccacatctcttgctcggcggcgagccgggctcgagctcgctcggcgcgccccatcgcctcgagcaatcgctcacgcgccgtcacgagcgctgcctcggccgaccgacgttgcatccgcagccgctcggcctcggcacggtgccgcgactcccaagcaagcagcagctgcagctgctcgtcaagaccgcgcagcgtgagggcaactgcgttcgccaaagcgtgggcacgctccacgagctcacgtggtactggcgtcgcacgaaccctggcctcgtcaaggcgcgcacgttcgcgctcgagctgatcgaggcgctcccgagccgccaacgcccgctgctgctctcgagtcgcatccagtcgcacgccgacgagctgctcatcaagcgcttgccgagcccgctctgcggcctggccagcttcgatggccatcgccagtcggtcggccgccgccgcctctcgcgcttgaagttcggcggcgcgacgtccgacatcctcgtcgacgtcctcgatgtcgacagtcgggagctctgtcgcgaggcgcgcgacgaccgtcgcgcgatcgcgatcgatccgcgcctgctcggtcctgatccgctcgagatcccggcgcctcgcttcacgacggttgagctcctcgacatgcgtgctgcgacatcgctcgacaacggctcgcgcctcccgaagcgccgcatcaacggccgcgagctcctcgccgacgccctggagctccgcggcgatcgtcaccgcctcatcctcgagctgacgccgtcgtagccgcagcaacgcacgaatgctgcgaccccgccgaatccacccatcgtcgctcacccagccggcagcgtcgacgaggagaccgtgcgctcggccgacacgcacctcctcgagcacgctctcgacgactctcgcctgtgcgagtcgcgcacccagtggtccgggcgcccaacccaccgccgcactcccgtgctccccttcgacctcctcgatgacgacggcgctttccacctcgaccgtcgggtcgagctcgccgaccgactgaacgatccgcgcctcggcgagctcgccgagcgcagcaagcgcgacgtcaatgccagctgtccccgaacgcacgacatcgatcgtcagtcggccctgcccctcgtccccgacggcctcgagcacgctccgcagctcaacatcgatgcgacgtgcttcggccgtcaaactgctgtgtcgttcggcaaggactgcacgatctcgctgaacacgctcgaccagctccccggcctcggcgagctcgcgggctgcgtccgcgagcgcctcctcggcctcggccaacgctgcctcggccgccgcacgctcggcggccaacgccgcatctcggtcgttcaagtggcgctcgagctcgcggtcacgcgcccgttcgagccgcacccgctccgcctgcgcgcgcgcacgctccgcggcccgctcgcgctcctggagaagcgtctcgagacgcacgcgctcgcgacgcacctgatcgagctctgcccgcagcggctcgacgtcgacggtctcgatcgcggctcgttcctgctcgagacgctcgcgcatcagcgcgagtgcgcgtgcgcgctcctcgagtccggtcagggtcgcgaccacctcatcatgctcctccgcgatcgcccgccgtcgctggtcgcgagcacgctcggcatcgacgaggcgctggtgctcatcgatcgacgcgatcgcccgtgtcaagcgcacctcgagctcgcgaagacgccgcgcaccctctgcgaccggctccgggtccacacgaggcgcatcgtcgacctccccctcgaggagtacgagtgccgcctcggcatcggcaacgtcgcgactgcacgactcaacgtcacgctccgcagccgcaagctcttcggcacggcgctcgagcgctcgacgagccgccgcgagcgcgagtacctgccatcgggcctcgagcgcgcgacgtgcctccgcgcgctcgacctgcgcgaccagcggtcgacgttggcgtcgaaggtctcggtcctcgcgctcgagctccgccagcgcctcctccgcacgccggagttgctcgagggtcacctgccgttggcgccggagcagcgtgaccctcgatgcgtcctccagcatggtgcgcaggacgtcaccggacgccccagcgagggcatcgatctcgccctgggagacgacgacgtgttggctccgaccgatgttcgccccttggaggacctccaccacgtcctggagacgcgccgcacggccgttgattcgatagctcgcctctcccccacgctcgactcgccgggtcagagcgatctccgcgacaccaagtccgctctcgtcgtctgggtcgtccaaggtgagttcgacctcggcccgaccgagcgcaggacggtgcgcgctgccctggaagatcacctcgtccatgcgagcgagtcggagcatcctgggactctgggtgccgagcacccaggtcagagcatcgacgacgttcgacttcccggatccattgggcccgacgatcgcgttgatccccgatccgaatcgcaccgtgaccggatccgcgaacgacttgaaaccgcgcatcgtgagcgcacgtagtcgcactcagccccctccctgctggcaccgcgggcaccagtgcgctgatcggccctgcaagaccctccggacgatcgacgtagcgcacctggggcacggactgcccgcacgttggtagacggcgaggcgcgcgccaaaggcgccaggccgatcgagcgggtcgcgataggcccgatccgcgaaggtcgtaccgcccgctgcgagcgcctcccgggcgacatcgcccgcagcctcggcgatcgccacgaggcgtcgccccagcacgttcatcggggtgctcggatggacaccgacacgaaagagggtctcgtcagcgtacatgttgccaagacccgccaccacgcgctgatccaggagcgccgtcttgatcgcacgccgagacctcgcagcgtgccgttcgaggctcgctgcgatctcctcctcgggaccgaacacgtcgggaccgagccccgcgagccgacgcggccgcccgtcggtgccgaggacgtcaacgaaggcctcggagaacgtgcgcggatcgaccagtgtgatgacggcgcgacggaagtcgagaacgagctggacgtgggtcgccgtcgccgaggcgtccgagacgacgagacgtccagccatgccgaggtgcacgaccagcgcgtcggtgccgagatcgaacaccaggaacttgccgatgcgtcgcatcgacacgatcgggcgccccgacaccgtcgccaagagctccgggtcgtgccggcgcacgaggcgccgtccaaccatgcggatcccctcgagcgtcgccccctcgacacgtgcggccagcacctcgcgcacccgctcgacctcaggcgcctccggcacgctccggctccgatgggcgtggcgaggcgcggcggctactgcgacgccgcgggggtcgcgagggagcctccgtcgttgcctgagcgaggccggcagcttctgcccgacggttcgcctcgaggatcgcaaggcggcacgcctcctgctccgcctccttgcgcgacgccccttcgccggctgcctcgaagcctccaggaagctgcacgacgacccgatagcgacggtcgtgatcgggcccggaccacgagactttgtagcggggtggctggtggtgcagcttggcgagcgcttgatggagcagggacttgtagtcaccgagcaccaggtcgccatcgacgcgctccagcgagggcccgaggatcgcgaggacgaacgcgaccgagagctggaatcctccggcgagatagacagcaccagcgagcgcctcgaccgcgttggccgccaggacagggccaagagcatctgcttggccgaccgtgatcgcctcgagcagcccgccttggaccccgacggagccgagcgagcgtcgagagacgagagctgagcgcacctgggtcaggcgaccctcatcgacgtccggatagcgccgatagagatagtcggagaccacgagctcgatcaccgcgtcgccgaggaactccaaccgctcgttggagtccagcggatcgcggctcgctgacttgtggacgagcgcttgacgtacgaccggatggtcgcggagcgcagcgggaatgagctcgaggatcgaccgctcccgccgcttcgctcggctcacgcctctcgggtcacgccgagcacctcggcgacgtagtcaacggcgtcacgcaacgtacggagatcctcgagatcctcgtcctcgatccggaaggtgtgatcgccttgggagaactcggactcgatggcctccaccagctcgatcaacgccagtgaatcggcgtcgaggtcgtcgacgaacgacgaactctcgctgatgcgcccttcgtcgatctccaagatgtccgcgagctgcttgcgaatgacctcgtagatcgcggctcgagtcagttcctcaggcacggttcgactccttcgcttcgtagtgtcgaatggtcgagacgacgtctccctctgcgagctggaccgcgttgcgaatcgcactcgcgactgcccgctcgttcgaggcgccatggccgatcagcaccaggccgtcgacaccgagcagcgccgccgcgcccgtggcatcgggcgtcagctcgttccacagcgggagcagtcgctcgatcgcggcgtcggcgaccgcatcgctctcccctgctggtgccaacgccgacagcaccgcatgcgcaaaggtgcgggccgcgccctcgagcgccttcagcaccacgttgccggtgaaaccgtccgtgacgacgacgtcgacgcggtcgctcatgacgtcacgcccctcgacgttgccgaggaaggtgatccgcgcatcgccctcgaggcgcgcgaaggtctccttgacgagcgacgtccccttcccgggctcctcgccgatcgacaacaggccgacgcgcggcgcctccagcccgagacgcgctcgagcgtacaccgtccccatcaaggcgaaatcgtgcagccacgccgcttggacctcggtgttggcgcccgcatccaacagcaccgtcggggtcgcgcctggcaccggcaactcgaccgtaatggccggtcgcgccacgcccttgatccgacccaacttgagcaacgcggtcgccatcgcggcgccagagttgccgaaggtcaccgccgcaccggcgcgaccttgcttcacgagctcggtcgcgaccaccatcgaggcgtcgcgcttacgccgaggcgcgctcgcagggtcgtcggtcatctcgatgacctcgctcgccaccacacgctcgacgccgctcggcaacgccgcgagtgcctcggcggtgccgaccgcgatcacggcggctccctcagcccgcgcgatgccctccgcgaccaccgctgagccgaggtcggtccccatcaggtcgaccgcaatcggcagcacgagcccctagccctggatctcgaccgcgggacgaccgcgatagtagccacactgcggacagacggcatgggagcgcttcgccgcaccgcaactcgggcaactggccgcgccggcgaccacgaggcgccacgccgatgcgcggcgagaccgggacttcgccttggaagtcttcttcttaggaacagccatcgtctctcactcttccttgccaccgggaccgggggatcatgctagcgccccgagccaccctcaccttgcgactgtcccagctcgtcgaggatcgcgaagggaccgtcgacctcgggttggcactcgcacggaccctcgttcaggtccgcaccgcagcgcgcacacagcccacggcactcatcgcgacacagaggcagaacggggagctcgagcaccagcgcatcgtgcacgaactccgacacgtcgaggacgtcgccgtggtaaccatacgcatcgtcggtggtggggccctcgcgatagagctctcgcccttcgacgacgagtggcccttcggctggtgccaggcatcgcacgcactcgcctcgccaccgtgtggttgcacggagggtcaccagcatgccttcgccaaccgcctcgacgtgaccggccacctcgatgggctccgtcggctccacgcgcgacgacgtcaccgcgatgtcatccaagctgccgacgaatccgaagcgctccaaggcggcgctcccgtgtcgcagcgcgaccaccgacaccgcgaactcacgcatcgccgacctcctcatccagcgcctctcccgacgccagcgcactcggcaccgtaccggagcccgccgcttggagccgctcgcggccgcgccgggtcgcggtcaagagctcgtcgagcgcgatctccaccgctgccagacggcgatccaggaagtcctcggtctgcaaccggagccgcgcagcacgctccttggcatcgagcacgatgcgcgcggcttcgtgttcggccgctcgaacgatctccgtgtgcgacacgagcgcctcggcctgctgacgtgctgcgtcgaggatcgcctcagcctcgagcgaggctcgcgcaaggaactgctcccgctcgcgcagcagccatcgtgcctcgcgcagctcctcgggcaacgactccatcgcttcgtcgatgagcgcaaggacgtcatcacgtaccacgatcaccgacgccgagaggggcaccccgcgcgcctcgctcacgagggtacgaagctcctggagcgccgcgagcgtcgtgctgccgtcggagccaaccgccgtcaaggccgacccccgaggcggccatcgagcgccttggcaacgacgacgggcacgaacgaggtcacgtcgccgccgtaggctgcgatctccctgatcaacttcgacgacaagaacgagtgttcggacgatgtcgggacgaagagggtgtccacgccggacagcgtgcgattcatctgcgccatctggagttcgatctcgaagtcgctgaccgcacgcagaccgcgcacgatcaccgttgcgtccactgcccgtgccagatcgacgaccaagctcgacaacgctaccacccgaacgttctcgaggtcatcgaccgccgcagcgatcaacgccatgcgctcatcgagcgagaacagctgcgacgccttctgcgggttacgcatcgccgcaaccaccacctcgtcgaagagcgcactcgctcgctcgacgacctcccggtgcccgttgtggaacgggtcaaacgaacccgggaataacgcgcgcctcactgtgcctcccgcgctcggctcgtctggtaggcccgagcggctcacggcgccggaacgaagagcccgacctgggtaccaccatagcgccgccagcgctccgctcgccaacgctcgccgagttccaccggagaggctgcctcgacgacgacccaacgagcgttcgggagctgggggccgaggtcctcgaaggagcgccggacgtagggcggatccacgaacaccacgtcgacgtccatcgaacgcccctcggacgcgaggaaccgctcgacgctcgtcggacgaacgctgagacgggaggcgacctcgagtgcgtcggcggcacgccgcacgtcggctgcgagtcgcgcatcacgatcgacccacacgacgcaggcggcaccgcgcgagagcgcttcgaacgtgaggccaccggccccggcgaagaggtcgacgactcgcgcaccctcgaggtcgacccgcgcctccaccatcgcaaagatcgcctcgcgcacgcgagctgcggtcgggcgcgtgccgctcggcacccgcaccgggacgacccgaccaccgagggatccgccgatgatacgcagcacgcctagctccggagcaggtatgccagctggtcggggtcggcgaccagtgcgagttcccgcgcgagcctcggatgctcgcggaggctcgggtcgacctcgagcaatcgggtggcgtggtggcgtgccgcctcgaccaaggggcgatcgcgcacgaccgaggcgagcttgaggtcgctcctgcccgattgacgcgcaccgaggaccgtgccctcgccgcgcagcacgaggtcgacctcggcgagctcgaagccgtccgtcgtacgttcgagagcctccaggcgcgccgccgtcgggccctggtcggtctcggcgagaaggaagcacgccgacgcgtgctcgccacggcccacccgaccgcgcagctgatgcagctgggcgatgccgaagcggtcggcgtcttcgatgatcatcacggtcgcgtttggcacgtccacgccgacctcgatcacggtcgtcgcgacgagcacgtcgatgatgcccgctcgaaacgccgccatctgccggtccttctcgcgcgccggcatgcggccatggagcagtccgagccggagtccggcgagctccgagttgccgagcctggcgaactcttcctcggccgagcgcgcctggagccgttcgctctcttcgacgagagcgcagacgacgtaaccctgccgacctcggccgacctctgcccgcaggtagtcgaaggcctcgacgtaggcgctccgttcacgcagccacttcgtgcggatcggcgtccgccccggtgggagttcgtcgatcacggagaggtcgagatcgccgtagaccgtcatcgccgcagttcgaggtatcggtgtggctgtcatgacgagcgtgtccgccacacgcccggcgatctccgcatgacgatcgcgcaacaacgaacgctgctccacgccgaagcgatgctgctcgtcgaccacgacgagcccaagcgaagcgaggttgactccctcggtgagcagggcatgggtcccgacgaccagatcgatcgttccgcgggccaacccctcgacgatgtcggctcggcgcttcgaggccacagtccccgtgaggagggcgacctcgatcggcgctacctcgtcatcgaagaggcccggtgtgcgctcccgagcctcacgagcagtgccaagcagcgacaggatcgtgcggaagtgctgttcagcgagcacctctgtgggcgcgagcaacgcggcttgatggccgccttggatcgcgaacagcgcagcaatcagcgcgacgagcgtcttgccggctccgacgtcgccctggaggagccgatgcatgggccggtcccgctgcatgtcaccggcgatatcggtgaccactcggcgctgggcagccgtgagtgagaacgggagtcgggcgagcagttctgccacgcgccgaccggtcccaggcccgaacggagcaacgtcgtgggcgaagccacgctggtgagcatcgcgctcccgtcgtacgagaccgagcatgacctggatgcgaaagagttcctcgaaggcgatgcggcgtcgagcttcgagtcgctgctcgagcgtggccggcgcatggatggcgcggagcgcttcctcgcgcccgagcagacccagcgcatctcgcaccgccctcgggatcgtctccgcgatcggggagaagcgctcgaggagtccgagaaccgcactcgcgatggcaccagagtcgatcccggccccgtcgcgcagcggatagagcggcacgatccgacccgtacggtcgccgatggggtcgacgagcgggttgacgagctgacgctccttgcgaaagagttcgaccttgccgaacacggcgatgtcgccgtggagccgtccgagctgcttcgcacgccacggctggcggaagaagcgcagcccgaccgaccccgtctcgtcgaccagccgcgcctccaccagcgtcatggagcgcttgcgcgtcggcacgacacggacgctggcgatgcgtccgatcagcacgacctcttcgcccggaaccgcgtcggcgatcatgacgtggcgggtgcgatcgacgtagcgccggggatagtaggtcacaaggtcgtaggccgtcacgacgtcgagcgcctcgagacccttcacgaccttcggtgacagccacgcaaggtccgcaagcgccgtcgctgcgagatcctcgagtccgacgccactcattccacgccaagcaggtagggatagagcggctgccctccctcgatcacctcgagttcgacaccgtgatggcgatcgaacacgcccgcaagggccgcctccacgcgttcacgatgaccccgctccccgacgatcacggtcacgatctcgcctccgggctcgagcaagcgctcgcacaggccgacgagcacggcctccgggtccggtcccaccgacacgatgccttgatcgctgataccgatcgcagaaccggcaccgaacaccccgccctgccaggatccatcgcggacggcaacggtgacctcgccccagcgaacccgtcgcgcggcctcggtcatgcgccgctcgttctctgagagccccgactctgggtcgtaggccatgagcgcggcgaagccctgcacgaggtggacggtcggcacgatcgcgacctcagcgtcgacgagtccgatcattgccgaggccgcagcgaggatgttggcgttgttgggcaggacgatgacctgcttggcgtgcgtggagcgcacggcatcgacgagttctgcgatcgacgggttggcgccttggccccctgcaacgatgctggcgacaccgaaggaccgaaacagccgcgcgatcccgctccccgtgccgacggcaacgaccgcggtcgccggaggcgacggctcggctgctggcggcgcgtcgcgcacccaggcgacttcgccggtctgctcacgcagatcggtgacggagagatcgcgtacccgacccgcgtcgatgccgccttggatggcggcagcgatgtcgttcgtgtggacgtggcaacgccagacggtgccatcaccgacgatcacgatggagtcgccgaggccggcccagaccacccggagcgcgtccacctggcgctcgggtgcctccagggagaacatcacctcgtagcgcagctcgtcctcgcgatcggacgccaccagctcggccgccgacagatcacggacgctcgcgaccgggaccgcgatgtcgtcgagccatggatagggaccgacgctcgtcgtgagtccgagcgcagcgctcatcgcctcgaggacgacgaccaagcccgcgccgcccgagtccacgacgccagcggctgccagcaccgcgagctgggtaggggtgcgctcctcggcggctcgagcagcgtcgatcgccgcggcggggtcactggccccagcggcggcgtcgatgacgctgagcatcgtgccgggcttcgggtccagcaccgccgcgcgagcgctcgccgacgccgcctcgagcccacgcatccatccgcgcgctcgatcagggtcgctggcgagttctcgtacgagcgagcccaggatctgggccaggatgaccccagagttcccacgcgccgcgagcagagcgccacgagcgacggaaccggcgaacgccgcgcagtcgtcggtatcgcctcggcgagcagcctcggccatgccctcgagcgttcggagcatgttcgaaccggtgtccccatccgggaccgggaacacgttgagccgatcgaccgcatcacgcaccgacgccaacccggcgacggcagcctcgatcgcctgcgtgagctgtgcgcaggcactctgacgttctgccaccgcccgcatgctagcctcgaaggcccgagacgtcgccgagcctcgtcgctcgcgccgtcctcacgatcgtaaaggagaccgaatggcgagcgtctgcgagatctgcggcaaggggccgcgcgtgggcatgaagctgtcacattcccaccggcgcaccaagcgtcgcttcctcccgaacgtccagcgcgtgcgcgtcctcgaaggagccacgacccgtcggcggttcgtctgcacgtcgtgcctccgagccaacaaggtcgtcaagccatagccacgatgggcccgacgcgagcgctgctctggctctcgtttggatcacccgagcggccggaggacatctggccgttcctcgagcgcgtggtcgctgggcggggtgtcccgcgcgaccgtctggcgatcgtgcacgaccaatacctcgccactggaggctcgagccccctcaacgcactcaaccgcacgttgatcgaacgcacccgagcagcgttcgacgcagccgacatcgacctgccgatcgtgttcggcaaccgaaactgggatccactggtcgacgaggcggtcaaggagctagggaggctcggtgcgaccgacgtcctcgtgttcgcgacctcggcgtacggctcctactcggggtgtcggcagtaccgcgaggacgtcgaacggacgaatcccccattcacctggacgaaggtgccaccgttcgctggccatccccgcttcctggcagcccaacgcgagatcctcgcgtcgttccttgcgacccacgatctcgaccccgagcacaccttcgtcgtcgccacggcgcactcgatcccggtcgccatggccgccaacagtcagtaccagcgccagcttgccgaggttcgagcagcgctcaaccaggttgctcgcacctacggcctcgtcgtcgaggaggcctaccagagtcgctctggcgatccgcgcacgccgtggctcgagcctgacgtcggcgatgcgatcgaccgcgccgccagcgagcgcacgctcgccgacgtcgtgtgcatccccatcgggtttctctcggaccatcaagaggttcgctacgacctcgacatccttgcccgcgaacgcgcagaagcccgcggcgcgaggttctggcgcctcgagaccatcggcgaacacgggccgatccccgagatcgtcaccgacttcacccaggcctggctcgaggggcgagacctcagatcgctcctcccgtctgagccggccctgtgcaccggcacctgctgccagcccctgcacgctcgacccagcaggagtgtgtcgggcgcgtaacgactcgatgacacctccggccgacggcgcgggatcgttgcgggtcgagttgctcgtggcctaccatggtcgcacgacatgaagagtgcgaacgaagtgggggcatcgtggttcagcgacgtcgaagtcgggtcctgaccgtactggcaggcgcagccctgttggcggcgtgcggcagcactgcccagagcggttcatcgagcacgtcgagttcgtccgccgcgaacggcatcatcaccttcgccgaacaacccggtgcgagcccgaactggatcttctggctcacgcccggatccgacttcaccgttgcgaacaacgatcagttccagtatctgctgtggcgtccgctctacgtgttcggcaatggagcaaaggccgagatcaactacgcgctgtccatcgggaatgcgccggtgtactccgatcacgaccgcgtcgtcacgatcacgctcaagcattggatgttctccgacggccagcccatcaccgcacgaagcgtggtcttctggatgaatctcctcaaggccaacaaggccgactggggcggctacgtacctggtcagttccccgacaacgtcgcatccgtcaccgcggtcaacgcatcgacggtccgcttcgacctcaccggctcgttcaatccgacctggttcacctacaacgaactcagccaggtcgttccgcttccgatggcgtgggaccgcacctcgctcggcgccccagccccgaccgcctcgaccccgaacctccccgacaccacgacccaaggcgcccaagcggtctactcgttcctcgccggccagtcgaaggatctcgccacgtacgcatcgagcccgatctggtcgatcgtcgacggcccttggcgcttgaaggccttcaccacggacggtcaagcgaccttcgtccccaatccggcctactcggggccgatcaagccgaccgcgaaggagttcatcgagctgccgttcacctccgacagcgccgagtacaacgtcctcgcgagcggccaagggcagatcagctacggctacatcccgagtaccgacgtcgagcagaccgcgcacatcacccagctcggctaccacgtctcgccctggacggtgttcggcttcaactacatcccgatgaactaccacaacccgacctacggcgctgtcttcgggcagctgtacttccgccaagcgctcgaacacctcatcgacgaaccagcgtggatctcgaccttcctccacggtgacggaacgccgacctacagcccagtgccggtcagccccgccaatccgttcatcgataccacgacccgccgtccggcctacccatattcgccggctgcggcacgctcccttctcgagtcccacgggtggcggctcgtcaacggcatcatgacgtgcgagtcgcccggcaccgctgccaacgagtgcggcaacggcgtcgccaaggggacgagcctctcgtcggtttcgctcgcctacgcgagcggcgtgccatcgctcgcccaggagatggaggcgttcgcctccgcagcccacagcatcggcgtcaacatcgtgctgtcctcgaagcccttcgacaccctcctcggaggactcggtgcatgctcaccctcgcaagcactgtgctcatggcagatggtgaactggggcggcggctggacgtacggtccggactacctgcccacgggcggcgagttctacctgccaggagcaggagccaacccggagagcttcgcagaccccaccgcgacctcgctcatcgacgccacccacaccgccacgaacctcaccccggcccttgatgcctaccagaactacatcgccaagaccctgccggtgctctaccagcccttcccggcctaccaagtctcggcgatctcgacgtcgctccacggcgtcgtccagaacccgtacgggatcttgtatccggaggagtggcgccagtcctaagcgccgagccacggatcgcgaaatccgcggtggccgcgcgtgagggcgacgacaccgtccggcccccaggatccccgacgatacgggacaaccgggttgggatgcgcgaggatcggatcgacgatccgccaggcctcctcgacgacgtcctcccgggcaaaacgtgctcggtcgccttcgagggcagcgaggaagagcacttcgtacggctctggcgaccgaccgagttctgcccggaacgagaggtcgagatgcaccggcgcgagatggcgctcctcagcgtcgagcgactgcaaggtcacacgcagcgccgaatcaggatcgatccggaggatgatctcgttggcctcgaggtgctcgggcagccccaaggccccgagacgtggagggcgccgcaggacgaggcggacctcggtcgcggtcaccggcaaagccttccccgctcggaccacgaccggtacgccatcccaccgccatgaatgcacgccgagcgcgagcgcaatgaaggtctcggtcgtcgagtcggccccgactcccgggatggaccggtaaccctcgtactgaccccgcacgacgcgactcggctcgatgaggtccatctctcgcaggaccgccacgcgtgcgtcccacagtccatcggcaccaggccgactcggcggctccatgagcacgagcgccaagagctgcaacaggtggttgacgaccacatcgcgaagagctccaactgggtcgtagaagctgcctcggtcctcgactccgaagtcttctgccatcgtcacctggatctcctcgacgtgttctcgacgccacaacggctcgaggacctcgttcgcaaagcgaaggtggacgaggtccgcgagcggttgcttgccgagaaaatggtcgatccgcaggatggattgctcatcgaccacgcggtggagtcgttcattgagagcctgcgctgaggcgaggtcatggccgaaaggcttctcgatcaggtaggtgacctcgctcgcgatcggctcgcgctggagattctcgatgaccggcgcgaacagagcaggggggatctcgaggtagacgagagcctggtggacccgtcccacggccgaacgcagcgcatcgaccgtgtctcgactcgtgaagtctccacgcacgtagcgcaagcgtcgcccgagccggtcgacgaccgagggcttggcgtccgcgatctgcgagctgacggactcgcgcatcctcgtctcgagatcgcccgtgctccagtcgtccagcgcgacgccgacgatcggaaagtcgagcgccccacgctcctcgagacgatagagcgaggggaaggtcatcttacgagcgagatcaccgctcaccccaaagatcacgaagacatccacgaacgagcctcctcctaggggcgcagctgcgccccccacgtcgcctccagaccttcgccggccgtgagctgccagatatcgttgcccgtagcgagcgcgttcggcggcgcggtcatcggctcgacggcaagcccgcaccgacggcgctccgacgcgagcgtgtcgccgctgaagagctgaaggtatcgatacggcggtgcagcccatagtgcagccaccgcaccgtcgacgccggtgagcaaggcccacgcccgatccgcgccgagaagatcgagccggatggtgtggtcgagccgccgaccagcgagcgcgatgcccgagccgacgtctgcaagttctcggtcctcgctcaacgcagaaggcacctgaagccacgcgccatcgatggaacctgcgcccggagagaggtacgggtgatgtccgatcgcgacaggagccgactccgatccttcgttctcgacgatggttctcacgacgagtcccgcgtcacggagctggtagtgcaccgtcacggcgaggtcgaagggataccccggtgttggcgggatccgggtcgcgagcaccacttcgttcgttcgcgcgtgctccaacgtgaagggtcgccaccgaacgagcccgtggatcgcgttgcccgccgacggctcggtgaggtcgagctggaattcggacgtggccactcggtaacgaccgcccagcacgcgattcggccacggaaccagcacggcaccgtgcgcgccatcgcagacggagtcctcctcgtacggatcgagcaccgctcgattgccgcgcgtgaggacccgaatacccgctccgacctcgacgacgaccgcacggtactcgccgctcaccagcacgaactggctgccggacggtggtcgatgctgggtccctcgcacgcgcccaccctacatcggtcgccacccgacctccaagtgccgcgcatcgaagcgccctgctgtcgcccaggacatcgctcgacaccctcggccgggccgagcacctcggtcacgacagccgacagcgtgagagcagcgttgaccctcacgacggccacgagtaccagactgcgcagccgatctcatcgtctcgccgaactcgcaccgagcaacttcggagctccgcgatggacgaggctcctccgacagcgcggtggccctctgcccgatccatgacgttcggcaggcggaaccgacatacccgggagcacgcagcgatggcaccttgtccgcgagccggtgtgacgaatcgcgggcccagagcccgaggctcggggcggtcgcaccctcttcggcgatcaccctcccgatccgctcactacagtggctccacaagacggcccagcgcgcgatccacgtgcgacaacgggatactcgggacctcgacacacagcagaactctcgagacaccgcagagccgacgactcgcagccgtgcctgagggaagaagccgccccttcgggagtcagaacgagcagccccaacgggattcgaacccgtgtctccaccttgagagggtggtgtcctaggcctctagacgatggggccagagtgctcgaagcagcatagcgggctctggccctgcgagacgctactcgcagggccagaggtgcagagcgaatcaggacgacggtctagcgggaatccgaagctccaccctgattactgatgcttcggtagtacgagcgccagatcgcacggtagagcggcacgtgctcggggagtcgacgcaacccagggatgtagggcacgaacgcaaaggccaacgtgaggaccgccatgatcgccatgacctcgacgtcggcgttggacgaactcgccatcgggttcacctgataccagaacgtgtacagccacagccaggactgtcccgggaagttgccggtctcgttggtcatgccccactgcggggtcccgaggaggtgtcgctgggccccgaggttggcaaagtactgaccatcggcgaggaacatgagcggcttcgtgtagttcgttccgtagaaggcgctgtgcgattcgagggccgcgtccagcccaccgctccgtgcgatgacgagcaggtcactcaggagcgtcggaatcggcccgtacgatcctcgcggcacgatgagccgtgagcccacgacacgtagatgggcatcggccttcgcgaacgcggcgttccaagcggcgcgctgagcggcggtcgcatcgttgtacgtcgccaaggctggcgcaagcccaggagtcacggcctcagccaggcgcagcggctggaggacgaaggtctgtgccgcattgatcggttgggtgacgcccgcgagcttctggagggagatcggtccgaggttctgcacgaagccggtcccgttgttgtagggcggaccgtaggtggccgtctccgacgtacccgcaagctcggtcgcggcggtctgcacgaagtccaccggatctgccgtcgcccactgacggatggtcaccgctggatcatccggcgagccgaacacgatcgacaggccgagcgtcagcactgcaaccaccacgaacgcaatggtggcctccttcaggatgtcgtacggccgcacgcgtccgcgccacggcttcgcctcggcctctcgcggcaccgagccgatcggtgggaccacaccgcgataacgaaccaggaggacgtgaatcgccacgacgagcacgacgagcagcggcagcagcaagatgtgccacatgaacatctggccaaagttcatgacgttgaagaaggccccgataccggtggcgttcatggcgtccttggcctgcgtcgagatccattgtgagtcgaagttctgttggctcagatacccggtgaacgctgctccgatggacaggaggaacgcgagcacgccggtgatccacgtcatcgcgcggcgcccgcgccacgccgccatgaagaacttcccccacagatgcacgaccatgaagaagaagaacagttctacgctccacaagtggagggaattgacgaaatggccttcgggactcccatgccaccagtccgggcccttgagggcgaggatggcaccagagatggcgaccacgaccagtgcggacaacgtcaggacgccaaagacatagatccagcttgcgacgtagatcggctgtgtatctggcagcagcttctcaggtggcagcttccccgtcagggtctggcgaagccgatgggtccactccctcgacaacgtctcgggcgcgacgccgtcctcggtcgagatcggctggtcggtcttcatgaccgcctccgatcgtgcgacggaaacggcagtgcgagagccacgatgaacacgacgatcatcaacgcgatgatcaccgcgttcgccaccgtgatctggatcacgccccattggatgtagtgctgcttgccgttgagattgatcaacgcgccaagcacgagtggcaacaccaccccacctcctcatattcgcatgctgagaccaccagcacaggacggataataggcgatggcctcgtcgatcaacagggtcctaggtccccgacagaccgggaccctgggcagatcacggctacagagcgctgggggggccgtacgccgcagcccgtcgcgcatggtcgatcaccgtccgaaggtccgcgaacgcatataccagctctgcagtaagcccgcgaccacgccagagagctcgacgcgctcgctcccaccctggcgcgtcagcatatgctcgccccggtccgtcgaaccagtgctcgagcgccagcttctcgcgtggcgcaatgccccgatgccgttcagccgccgcaagggtcgagagcacgatcaggtcgtcgacacgccagcgcggaatgtcgatcggtgtgaaccgagtggactggatgagggcctgcaccgaggcgagcgaacccgggcgcgcatagcgataaccctgcacacaactaccaccgagacggagccacagaccgatctcctcgtcgacctcgacgccctcggcaaccacggacacgctgcccgtctcctcgagcgtcgcgagcgcagcaagcaccgaaaaggcatggtggtcctcacgcgcccgttgcacgaagctgcggtcgaccttcacctcgtccacctgcaagcgcgccagtgccgacagcgacgaagccgcagtaccgaagtcatcgagggacactgcgatgcgacgagcgcgcaccgccgccacttgcgccgccgcaagctcgaggtcttcgagagcgacgtcctcggtaatctccacgaccagtagggagccgcgaggcacgagctcgtccagatcgtcgaggaactcaccgtgcagaaagtgtgatggcgtgatgttgacggcaacgggaaccccgttgagcctctcggaatagtccgcgccggtcctgagtgcagcacgcccgagcgagcgtgcaagctccggcgcggcgcgaagctccgcgacgacatcgacggtcgcgatctcgggccagcgcaggagcaactcgacaccgaccacggtgccgagacgtgcatcgaccttcggctggcacgcgaaggtggctgcgcctgacgccagcgcatcgaccagcccatcacgcacccgccgacgccgctggacccgctgcgaaacgtcgccgccgtagcgaacccaccgggccttccccgccgccttggccgcgtagagcgcctcgtcggcggccatcagaagctcgcgagtcgtgcgcacgtcgtcgggcgccagtgcccacccgatcgacccggtgatgcgccaccgctgcccgatcgtgcgtaccatcacgctgatacgctctgcgatctgatctaggcggtgacgtgccgatccaaccagtgcgaccgcgaactcgtcgccaccgaggcgtgctacgaacacgtcgggggcggcgagccgagccagcgcgcgcccgagcgcagcgaggagttcgtcacccttcgtatggccgagcgagtcattgacgtccttgaagccgtcgagatccaagaatccgaccgctaccggctcctgcgcgacgagtgcgttcaatcgaacctcgaaggcggagcgattcatgagccccgtgagcgtgtcagtctgagcaagtcgctgctgcagcgcgcgctctcggtcgagtcgatcacgaagcgcgacctccgccataccgaggccgaggagttgggcaccggtgccgatgaccgaggccagccgcagctcgtcgacgccagcgtgagccaggccgactccgagcgtgtcgtggggcccatcggccgagccactcgtcggaacctgaacgagtaccgcgtggcgccacccgcattcggtgactgccgcgccagcaccctgctcgacggcgacgagctgcccgtgggcaagatcacggactcgacccaacgtgtcgaccacgattccctgcgatggccccacggcgcgggtgagtgcggtcgcagcacccggcggcacgcgcagcgctcgcacgatctcgctcgcacctgcgcgagcatcccagcgagagagccatgcccccgccaccaccccagagttcgcgagcgcccgcagcacggcctcctggacgtcctcgggtgcgcccgcagccaccacagcagcactggcatcgaggagtgatcgcgatacctgcgcgaccgcctcagtggtacgcaatccctgattgcgctcgaggcgagctcccgcagcgccaatcacgtcaccgagctggtcgaagagcgcatcggtgagcggtccatgctgctcgtcggcgacgctcaccatcaccacgcccatgagctcgccttggctgacgacgggatagcggaccaccacctgcccatgggcgaggcgcccagcggtgcgatcgagacgatatccagcccagctggcggcgacgccagcggtgagaacgcgttcgcgatgcaccgcagcagcgatcagcggcgcctccgctgcgcgcgcggggtcgaccacgacctcgacgacctcgagctcgcgacgaacgtcgtcttccgcctcgacgtggacgagtcgaaggacctcgaggccgtcctggcgacccgcgtgctcgtagaacgcagcccggtcgaccgcaccgcagccgaccagcgacgccgtcaccttggcaaagaactcacgcgacgaggactccgcactctggaggatcgtcgctcgcacctggtcgagcgcctggcgccgacgctcgagtcgcgccatcgcacgggcgcgaaacagccgtgagagctcgtgaccgagtgccgcggcgatgtcctcgacgtcgtcgggaagctccgctccccgtggacgatagagcgcaatgacacccgatcggtgcagtgagatcgacaccggggccacgactgcggagccgagtccccacgcgtcagccatcccgcgccaaagtgcaaagcgcgcgtcgtgcggcaatccggacacggtgacgcgcccggtccgcagtgcacgcccaaccggcccctgaccagcaggcagttgctcatcggtcgagagcgtcaggcctagggcatagggcgtcgcgacccccgctgccgcccgtaccaccacgccgggtccgagaccactgtgaggggtcccctctgcttcggcccagtacacgagcgggagaccggtgacacgaaccaccagatcacagatgcgctcgatggcgtcttgctcggggaggcccacgaactcgtcgaaactgttcgcgagctccacgatcgcgcgctcgagcgcatcgcgcgcctcgagtcgctcttcggcgagcatgcgcatcgagcgagagagtgcgcgctcgtgcgcgacgacgaggagcgcctcggtgccgagtccctgctcgacgagtacctgctccagcagtgcgtagatctgggccgcccgatcgaactcgacaccgatacggtgatgcatgcgcgcgatctgcgcaacacgctcgtcatcgacgtgccctcgctcgagggtcgaggcgatctcatcgaggactgcgtcggtcaacccggcgacgtcgacgacgttctcgtcgtcgagctcgagcgccgaatggacgagccgatcgagctcggcacgaaccgtagcgcgcacggcagcgagcaccgctgcgatccgtgcctgccccatcagctcgcttctcctacgcgtcaccttgcgacgagccgcccgacatcaacgcccgtggagtcgggcaccatggcgaagcgtagtgcgggctcaccgactcgactgagctatcggctcgaaccgcccgttccttagacggctgctcgatggcggcctctcggtctcaagtggcacccccacccgagaccgagcagaatgtgggtatgactgccttcgagctctcgcaagagcaagacgcctttcgtgccgtcgtgcgtgccgtcgcggaagagcggatcgccccgcacgccgccgacgccgaccgttctgcttcattcccatgggagagcttcaaagctgctcgcgaactcgagctgcccgcactcggcatcccccaggcctacggcggccagggagccgaccacgtcacccaggcggtcatgatcgaggagatcgcgcgggtgtgcgcgtcgacctcgctcgcgctcctcatctccaagctcggcatgaccccggtgatggtctggggttctgaggacctgaagcgacgctacctgccgcgcgtcgccagtggcgaggcccaggcgtcctactgcctctccgagccagacgctggatccgacgtcgcctcgatgaccacccgtgcggtccgcgacggcgacagctacgtcctgagcggcacgaaggcctggatcacgaacgccggcatctccgacacctacaccgtgttcgccaagacggaccccagcgctggccatcgcggcatctctgccttcgtcgtcgaggccgactggggcgtgcaggtggccaagctcgaacacaagctcggtgttcgcggttctccgacgggccaaatcgtcctcgacgaggtacgcgtaccggtcgccaatcggatcggtgaggaaggtcaagggttctacatcgcgatgggcaccttggatcgctcccgtccgatgatcggagcgcaagccgtcggcatcgcgcagggcgcgctcgacgcagcggtcgcctatggcaaggaacggcgtcagttcggtcgccccatcaccgacaaccagggcatccagttcaccatcgccgacctcgccacgcagatcgaggccgcccggggtctcgtctatcgggcctgcgctcggatcgacgccgacgagcccggaaccgagctgactcgcctcggcgccatggccaagctcttcgcatccgacaccgccatgcgagtcaccacggacgcccttcagctcctcggcggctatggctacaccatggacttcccgctcgagcgcatgttccgcgacgcgaagatcacgcaaatctacgaaggcaccaaccaaatccaacgcatcgtgatcgcgcgccaggtcctgaaggaggtcggagcatgaccgtcacacagctcggcgtcgtcggtggtggcctcatgggatcgggcatcgccgaggttgctgcacgacgaggcatcgacgtggtagtcgtcgaggccacggacgacgcggccaaggcggcactcgggcgcatcgagcgctccatcgcccgcggactacgctcgtccaaactctccgaggcagaggccgaggcagcccttgggcgcatcagcgtgacctccgacctcgaggcgctcggcgatcgcgacgccgtcatcgaagcggtgatcgaggacgaagccaccaagctcgcggtcttcgccaagctcgaccacgtcgtcacccgcgccgatgcgctgctcgcatccaacacgtcgtcgatcccgatcatgaagctcgcgatggcgacccaacgacccgagtacgtcatcggcattcacttcttcaacccggttccggtgatgcccctcgtcgagctggttccgtcactgctcacctcagaggcaacccaggagcgcgctcacgccttcgcggccgatcagctgggcaagcacgtcatcaaagccaaggaccgcgccggcttcatcgtcaacgcactgttgattccctacattttgtcggcggtcaggatgctcgagtcggggttcgcgaccgcagaagacatcgataccggcatggtcgatgggtgcgcacaccccatgggccccctcgcgctcgccgacctgatcggcctcgacacgaccatggcagtcgccgaatcgctctacgaggagttcaaggagcccctcttcgcgccgccgcccctcctctcgaggatgtgcgaggccgggctgctcggccgcaagagcggccgtggcttctatcgctacgacgagccgagcgcaccgaagggaggctcctagactcgtcctccgcgccctacccaaggccgaggaggtgtcatggcccctgagcgcgtacgcttcgcgccatcaccgacgggcatgttccacgtcgggtcagcacgcactgccctgtacaactggctcatcgcgcgccagagcggaggtacgttcatcctgcggatcgacgacaccgacgaggagcgcaatcgcgaggcctgggtcgacggcatcctgcgcgccatggagtggctcggcctcgactgggacgaaggtccgctccggcagtcgtcgagggccgagcgctaccgtgccgtcgccgaacggctggtgagcgaggggcacgcctattggtgcgattgcacgcgagagcgcgtcgaggcccgcaagcaacccggcgaagcgccaggctacgatggcttctgccgtcaccgagggctcgggcccggcccggggcgcgcgctccgctttcgtgtccccgaccatgacgtggtcgtgacggacctcgtccgaggggaggtgcgtttcccggccggctccatcgaggacttcgtcatcgtcaagtccaccggtcagccgctctacgtcctcgccaacgtcgtcgacgacatcgacctcgccatcacgctcgtcctgcgcgcggaggagcacctccccacgacgccgaaggcggtgttgctgcacgaagcgctggcagcgccgccgccgcgcttcgcccacctctcttttctcgtgaacgaccagcgtcgcaagctctccaagcgccgcgatcgagttgcggtggaggactaccgtcagatgggcatcctcccctgggcgctgctcaactacgtggcgctcctcggatggagcccaggcaccgacgaggagttcttcagccgtgaggagctcatcgctcgcttcgacctcgctcgagtccagcactctcccgccttcttcgacgagcgcaaactcctggcgttcaatcagcactacctccaggcactgccacttgccgagctcctcgagcaaggccacgaccacttcgcctcgatcggcgcgttcgccacccaacaggcaaccgagctgctcactcagctccttccactcgtcgtgcctcgagcacgaacactgtccgaggcagcagcgatgagtgcctttctctttgcggacccacccatcgccccgaacgagatcgaggcactccggtcggagtccgcgtcgtggctcggggcgatcgccgcacgtctcggggagctcgagcgcttcgatgccccctcgatcgaagcagcccttcgggcgctcgccgacgagctcgggacgtcgctgcgccatctccaagcaccgctgcgcgtcgccgtcaccggcagtcgtgtcggacccccgctgttcgagtcgctcgcactcgtcgggcccgaggccacgctacgacgcatccatgctctccgcgtgaccctcgaggaccggacccaagcacacgccgggtaagctcagctctgcccttcgggggtggtgtaattggcaacacagcaggttctggccctgccattgggggttcgagtcctcccccccgagccgaaggctgcgcacgctccccgcgagcacgctccgaactgcgcgtgccgctggtcgagcgtgcgggccaccgaatggcgtctggccgaggcgatcgatctggcaaaggtgggcaactcggccacgccatcgatgacgaccgtgtagaacgtcgcgtccactgtcgtcgctcgtgtgccctgacgcctccgtgctgcgaccgcgtggaacgggtgagccgacgcacgcgccgcttctgcgagcctcgcgtcgaggcacacccgcaccgcgcctctcggccacgagctctcatgagccaggagctggtcgatgacgacggggacaggtgagacaacgggagcgccagctcgacgcggactcgcgacgagctggcgccgacaccctcgatcccccgacgctcagggcgtctcgcggttcgatgccttctcgcgcacccgcgctgctcgattgagcgcattcaagagcgcacgcgcagaggcctcgacgatgtccgtcgacacgccacgcccactcacctcgtgcccaccgacgtcgacggtcaccgcgaccgatcccagcgcatcggccccgcccgtcaccgacgtcaccgagaagccggtgagccgtgcctcgagggccgtcgcctcggcgagcacccgaccgagcgcgtcgaccatgccgttgccggaggccgaggcctcgaccggggtcccatcgacgagcacggtggccgacgccacggcctcgcgacccgttcccgcctcgacccgaaagctcacgagctcgaaccgatcggcgagcgtcgtgccgagctcttcggcaacgatcgcctcgagatcggcctccgacaactcgaccttgcggtcagcgagctccttgaagcgctggaaggtcgcgttgagcgcatcaccctcgagcgcgatccccatgcgcgccaacgcttcttggaaggcgtgccgaccagaatgcttcccgagcacgatttgggctgcctcctggccgacgctggcagcgtcgatcacctcataggtggagcgatcggtgaggacaccgtgctgatggatgcccgactcgtgcgcgaaggcattccggccaacgaccgccttgttgtactgcaccggatagccggtgagccgcgagacgagtcgagaggttcgcgcgagctcgcgcgtgtcgatcccggttgtgacgtcgccgatcacatccgaacggatcgcaagccccatcacgacctcttcgagtgcggcgttccctgcacgctccccgatcccgttgatgcagcactcaacctggcgtgcacccgcggccacggcggccagggagttggccgtcgcgagaccaaggtcgttgtgacagtgacacgagatcacgtaggaaccggcgacctcccggcgcaccgactcgaccatgcgcgcgaaatcccagggaatgccgtagccaacggtgtcggggatgttgagcgtgctcgcgccctcgtcgacggcgacctggagcacgcggtagaggaacggcagcggcgtgcgcgttgcgtcctgcggagagaactcgacgtcgtcgacgagctcacgtgcgcgagcgatcgcgcgacgcacggcctcgaccacctgatcctcgctcatgcgcaacatgtgctcgaggtgactcggcgacgtcgagatgaagacgtggatgcggtggtgctccgcatcgcggaccgcttcgtagcagcgctcgatgtccgccacgtgggtcctcgacaggccgcagatcacagggccgtgcacctggcgcgcgatctggcggaccgcgtcgaagtcgccctggctcgcgaccgggaatcccgcctcgatgatgtccacgccgagtcgagcaagctgctcagcgatctcgagcttctccaaaggatcgagcgagatgccgggcgcctgctcaccgtcgcgcagggtcgtatcgaagatccgaatccgctcttgcgttcctacctcgtccaccatgttcctccccaacgtcgatcacccaatcgtctgtgcgttgccgctcggagcctcgctcccccagcgctccgagcggccagtgttgcccgaatacgagacgaccctcctgccggaggcaaggagggtcgggccagccgcgatcgcggctggcctaggtaaggagctgctcgctacgacgcgcacgcacgcacgacaccctagaggccagcgacggcacacgtgaccgtccgggcataaatgatgccgtcggtggcatccagctcggtcaacacctcgtccgggatcgggccgtcgacgccgagcaccatcagcgcagtgccatcgtcggtgcgcggcgagaccgccatggcgtcgatggagcgaccggcctgcccgaggagcgagcccacgaccccaaccatcccaggtcggtcgacattgcgaaccaccagcatccatcgcgacggaggaacctcgacccagtggccatcgacaaggacgacccgtggctcgctcgcccgctgacccgcgagcgtcccccccaccacgtgcgcaccagagcgcacgacgaggagagagtgatagttcgccgaggcgacttgcgtcgactctcgtaccgacagcccacgttcggccgcgagctgcggcgcgttgacgtaggacacgggctcttcgaccgcaccggagaggatcccacgcaagacagcgagcgacgcgagtcgcgtgtcctccgaggccaactcgccctcgtaggcgatctcgagctgctcgggaagcttgccctcgatcgccccgagcaatacaccgagcgcctcggcgagcgggaggaacgagcgaacgagctcggatgcttcgcccgcattgacgttgaccgcgaaggggacgaactcgttcgcgagcgcgagcaggacctgttcggcgatcgtgacgccggccttggactgcgcctctgcggtggaggctccgagatgcggggtgagcacgacctgatcgagccccacgatcggcgagttggtcggcggctcctcggcgaacacgtcgagtgctgcgcccgcgacgtgcccacgggcgatggcctcggcgagcgctgcctcgtcgatgatccctccacgagaagcgttcacgatccggatgccgggcttggccttggcaagcagcgccgcgccgacgagccccacggtctccttcgacttcggcagatggatggtgacgatgtcggacgtcgccatgagttcgtcgaggtccagcagggtcacgcccatcttgcgcgcgcgctcctgcgagatgtaggggtcataggcaacgagccgcatgccgaacgcgttggcgcgctgggcgaccaacgccccgatccgccccaggccgatgatgccgagcgtcttgccgtagagctcgacaccctgaaaggcgctgcgccgccactcaccgcgctgcaccgacgcgtgggcctgcgggacgtgtctcgccagcgccagcaggagcgccagcgtgtgctcggcggccgacacgatgttcgactgcggggcgttgaccaccatcaccccgcgcttggtcgccgtctcgacgtcgacgttgtcgagtccgatgccggcacgacctaccaccacgaggtggtgagccgcctcgagcacgtcggcggtgaccttggtcgcagagcgaatgatcagcgcgtcggcgtcggccaccgcctcgaggaggccatcgtggtcgagcccggtgcggaccaccacctcgtgacccgcgtcagagagcagctggaggccctcctcagcgatcgtctccgtcaccaacactctcgccatcgcgcgctccttctccctgctcagccctaaagcctaccaatgaactcagcaattcggcgaaccccctcctccagggcatcgtcgccgagtgcgtaggagagtcgccacgccccagggccgtcgaaggcttcgccgggcacgaccgcgacgtgcgcctcctcgaggagccgagtagcgagctcgagcgcgctgctgcttggcatctgcacctcgaggacgcgcgcgagcgacgggaagacgtagaacgccccgtcgggccacagcacgtccaacccttcgatgccagcaagagcgctcacgatcgtcgtgcgccggcgcgcgaacgcatcgcgcatgggcgccgtcgcctcgagcggggcctcgagagcggcgatcgccgcacgctgggacacgttggcgacgttggacgacagctggctctgcaggttcgccaccgcggacgccaccggtgccggggccacgatccaaccgacgcgccaacccgtcatcgcaaaggtcttcgcaacgccgttgacttggatgagcctcgcctcgagggcctcggtgcccacctccgcgagcgacgtcgcgcgctgccccgtgtaggtcaggtgctggtagatctcgtcggtgagcacccagatcccggcccgctcgagaacctcggccagcgctcgggactcgtctcggctgtagaccgccccagtcgggttcgagggcgagacgtggatgaacgcaacggtgcgatcggtgatcgccgcctcgacctgctcgggggtcaccttgaacccgttcgcgagggtggtcggcactgcaacgggcacgcccccaaagagtcgcacgatctcggggtaggacacccagtagggcgcggggatcagcacctcgtcgccgggctcgacgatagcggccatggcctcgtagatggcgtgcttgccgccgttcgtgacgaccacgttcgaaggactcaccacccgtccgctgtcacgcttggtgacctcgacgatgagctctcgaagctcgcccaacccagccgctggcgtgtagcggtggttccgaggatcacgtgcggctgcggtggcggcctccacgatgaagtcgggggtcggaaagtccggttcgccggccgcgaagctcacgacatcgatgcccgacgccaccatggccttggctcgctggtcgatcgccagtgtggccgacggtgagagctcggtgagtctggtggcgatacgacctcgtggcatggacctcggcctcctcacgccccgtgaagggaatccggacggttacagtgtcccttgccaggcaccaagcgagcctcgaggcagcgaaggtgaccaagggccacacgaaggaggagcacccatgcccgacgcggacgccatcagactacccagcaacctgctgcccagcgacggccgcttcggatctggcccgtcacgcattcctccgtcccacctcgaggcgctcgccgcgaccggcacgacgctcatgggcacgagccatcgacggcctaccgtccgcggcctcgtcgcgtccgttcaagagggcctggccgagctcttcagcgccccagaaggctacgagatcatcctcggcaacggtggcgcgaccttgttctgggacgccgccgcgtactccatgatcgagcacaagagccagcacctcgccttcggggagttctcctcgaagttcgccagcgtggtcgccgcgacgccccacctcgacgaaccggacgtgcgccgagccgaggccggctcggcacccgccgccgagcccaaccctgccgtcgacacctacgcgctcacccagaacgagacctcgaccggcgtcacgacccaggtgacccgccccagcgaggacgggctcgtcctcgtggacgcgacctcggcggcgggtgcgatcgtcttcgatccctcccaggtcgacgcctactacttctcaccacagaaggccttcgcctccgatggcggcctcttcgtggcgatgctctcgcctcgggcgatcgagcggatcgagcggatcgccgccagcggccgagcgatcccggccacgctctcgctcctgaccgcactcgagaacgcgcggctcaaccagacctacaacaccccggcgatcgcaaccttgttcctcatggatctccagatcaaggcgctgctcgagctcggcggcctcaagggggccaacgaacgctcgcgccaagcctccgacgtgctctatgcgtgggcaaccacgcacgcgcacgcgacaccgttcgtggccgaccccgcactgcgctcgcccgtgaccgtcacgatcgacttcgacgacaccgtcgacgccaaggcgctcgctgcggtactgcgctcgaacggcatcgtcgacgtcgagccctatcggaagctcggccgcaaccagctgcgtatcgcaacgtttcccgcgacaccggtggcggacgtcgaacggctgcgcgacgccatcgactgggtcatcgagcgcctcgccgacgacgctcgagccccccagacggcctaggcgaaggccctacgccgacgcggagccttcgaggcgaggcagccaggacggtcgtcgtgcctcgaaggcttcgatctcggcctcgtgctgcaggctgatgccgatgtcatcgaggccgtggatgaaccggtgccgaaccgccgggtcgagggcgaaggatgcctcaaggccaagttctggcacctcgaagcgacccgagaccacgtcgaccctcgccacgatcgtcggatcggacgcgctcgcctcgaggaggcgctcgacgatcgccgtgtccagcacgaccgggaggagcccgttcttggtggcgttctgacgaaagatatccccgaaccggggcgagacgacgacccgaaacccgtaatcggtgagcgcccacacggcgtgctccctcgaggacccgacgccgaagttctcccgtgccaccaggatcgtcgcaccggccatgcgcgggtcgttcagcacgaacgtcggatcctcgcgccactcggagaacagtccctcgccgaatccggtgcgcgagatgcgcttgagccactcgctcgggatgatctggtcggtgtccacatcgctgcgcccgagcggcaccatccgcccggcccactcacgcatgggttccatgctcagccctccacgtccgccggtgtggcaaagtggcccgccagtgccgtcgcagccgccacggcaggcgacacgagatgggttcgtccgccgcgaccctggcggccctcgaagttgcggttcgaggtcgacgcagagcgctgaccaggccggagctgatcggggttcatcccaagacacatcgagcagcctggttcgcgccactcgaaaccagcagcgaccaagacgcggtcgatgccttcggcctcggccgcctccttgacgcgccgtgaccccggcaccacgagcgcctgcacgcccggggcgacccgtcgtccacgcgccacgctcgcgacgacccggaggtcctcgagacgggcgttcgtgcacgagccgatgaagacgacgtcgacgggcacctctcgcatcggcgtcccgggctcgagccccatgtaggcgagcgctcgctcggctgcttggcgctcgtgctcggtcgtgaacgacgaagggtcgggaacgacgtcatcgacaccgatgacctgcgaggggttcgtgccccagctcactcgaggggtgagcgtcgaggcgtcgatgcgaacgacgcgatcgaagaccgcgtccggatccgtcgcgagcgctcgccatgcagacacggcctcgtcgaaggcccggccacgcggggcgtacgggcgaccttcgagatacgcgaaggtcacatcgtccggggcgatcaggcccgcacgcgcaccggcctcgatggtcatgttgcagaccgtcatgcgagcctccatcgacagccgacggatcgcctcaccgcgatattcgatgacgtgtccgatccctccgccggtaccgatctggccgatcaccgcgaggatgaggtccttcgcactcgccgactcggccaaggtgccctcgacctcgatcgcgagtgtgcgcggtcgacgttgcgggagcgtctgcgtggcgaggacgtgctcgacttcgctggtgccgataccgaaggcgagcgcgccgaaggcaccgtgggtcgcggtgtgcgagtcgccgcacacgatggtcatccctggctgcgtcagtcccaattccggaccgatgacgtgcacgatgccctggttctgggaccccatcgggaagtacgagatcccgaactcggcacagttcgtcgcgagtgcatccagctgcgccgccgagatcgggtcggcgatcggctggtcgatgccgaccgtcggcacgttgtggtccgccgtcgcgaccgtgaggtcagggcgtcgtacccgacgacccgcagcgcgcagcccgtcgaaggcctgcggcgaggtgacctcgtgcacgaggtgcaggtcgacgtagagcaggtccggttcgtcctcggttccctgggcgacgacatgcgcatcccaaatcttgtcgacgagcgttgtgctcatcggctgctacccccctcccgtcggccgctagcgagcggtcttgagcggcccgatctcgacgacctggaccttcagggtaccgcgtggcgcctcgtactccacccaggcaccgacgcgcgccccgagcagtgcctcaccgagtggcgaggtcggcgagacaacctcaagccccgggtgccgctcctcgatggagccgacgagatagtgctcgacatcgtcttcaccctcatagcgaaggcccacgaccacacccgggcgcacctcgtccgtcggaaggtccgccgacaccacccgagcgctctggaggatctgctggatctggcgtatccgcgcctccatcttgccctgggcgtccttcgcggcgtggtagtcgccgttctcgctgagatcgccgagcgcacgggcagcctcgatcgccttggcgatctcgatgcgcccctgggttgtcagctcctcgagctcctgaaccagggcgtcgtacgtcgcctgtgagatctctacctcgctcattgacgacgatcctagcggccggcgccgagacgccgaggcttgagccgaccagcatccgagggtacactgagctgccagcaggccgatcgacgcatcggtagcaccagcatcgtccgacggagcaccaccggtgcgacgactgatcgagaagcgaccgacctagaagggagcaacgtgggccaccgcgtagcggtcatcggcggcgacggcatcggccccgaggtcatccgagaagcgctgaaggtggtcgaggcgacgggcgtcgtcctcgaaacccgagcagtggagctcggtgcggcgcactatctcgcaacgggcgaggtcctcgacgacgccacactcgagttcctccgctcccacgacgccatcttgctcggcgccatcggaccggcgatcggctcgacggaggtcccgcctggcgtgctcgaacgtggcctgctcctgcgcctacgcttcgaactcgatctgtacgtgaacgagcgtccgtttcgcaccatcgacccctcggtcaccgtcacgcggcgcgaggcagacttcgtcgtcattcgcgagaacaccgaggggccctacgcgggcgaaggcggctttctctatcgcggaacggcccacgaggttgcccaacagggatcgctcaacactcgtcacggcgtggagcgcgtcgtgcgctacgccttcgagcgagcgcgctcccgaccacgcaagcatctgacgctcgtccacaagaccaacgtcctcacctacgctggcgacctctggagcaggacttttgcagaggtcgcggccgaatatcccgacgtcatgacggcctacaaccatgtcgacgcggcgtcgatctacctcgtcgaggatccggggcgctacgacgtgatcgtcactgacaacctcttcggcgacatcttgaccgaccttgccgctgcggtcacgcagggcatcggctacgcagcctctgccaacctcaatccggcgcgcaccggaccctcgctgttcgagcccgtccacggtgccgctcacgaccgcgtcggcaccaacaccgccaacccatgggcggccattcggtcggcgggagccatgctcgagttcctcggcgagcacgaggccgcgtcgcgtatcgaagcagcgctgtcggtcctcccgcccccgtcggcaacgacaacgcagatcggtgacttctatgcagaaagggtgcgtcatggcgatcgctgagggcaaggtcatctggatggacggcgaggtggtcccgtggggcgaggcgaaggttcacgtgctcacccacgcgctccactacggctacggcgtcttcgagggcatccgtgcctacgatacgccacgcggctccgccgtgttccgactgcgagagcacctcgtccggctgcatcgctcggcgcgcatgctgctgatggagatccccttcagcgtcgacgagctcatcgaggcgacgaggacggtcgtcgcggccaacggagaaccggcgtgctacatccggcccgtcgccttcaccgcctacggcgagatgggcctgtcgcccctgtcctcgtcgatttcggtgtcgatcgcgacgtggccgtggggggcctacctgggcgacgaggggatcgccaagggggtgcgtgcgaaggtgtcgtcgtggcgccgacacgacccgaacgtgatccctccggccgccaaggtgaccggaggctacgtcaactcggcgctcgccaaggccgaggcgatcaaggccggctacgacgaagccattctcctctccccgcaaggctacgtctccgagtgcacaggggagaacctgttcgcggtgttcgacggcgcgatcgtgacgccaccgatcgcggcgggggcgctcgcgggcatcacgcgacagaccatcatgacgctggcggccgacgccgggatcccggtgcgcgaggccaacttgctccggtccgatctctacatcgccgacgaggtcttcttgtcgggcaccgccgccgaagtcgtaccgatcgcctccgtcgacgatcggcccgtcggtaccggagaacccggtccactcgcccgagagctgcaacggcgctactacgcggcggtgcacggcgaagatccgcagcacgagtcctggctcacctatgtccacggctgacgtcctatgagcgcagggttccccgcagaggtcgagatctacgacacgaccctgcgcgacggttcccagcaggaggggatctcgctctcggtcgacgacaagctgaaggttgcgcgccagctcgacgccctcggtgttcactacatcgagggagggtggcccggcgcgaacccgaaggacgcagcgttcttcgccagggctcgcgacgaactcgcgctccacaccgcacagctcgtcgccttcggatccacccgacgagcctcgacgaccgcggagagcgaccccaacctggctgcactcaccaatgccggcgtcggcctggcctgcatcgtggccaaggcgtgggacgttcacgtcatccatgcgctccgcacctccctgccagaagcggtcgccatggttgcggactcggttcgctggctcgtcgaccacgggatccgcgtcatgctggacgcagagcacttcttcgacggttggcgtcacgaccggtcctttgccctcgacgtcctcgccgcagccgccgacgccggagccgaacgcttggtcttgtgcgacaccaacggcggcacgctgcctgatgacgtcggacccatcgtcgacgacgtacgagctgccgtcgcaacaccgctcggggtccacttccacaacgactcggggtgcgcggtcgccaactcgctcctcgcggtggcccacggcgtgatccaggtgcaagggtgcatgaacggctatggcgagcgcacgggcaacgcgaacctcgtacccgtgatcgcggggctcagcctcaagcgatcggtacgcacgattccgccggagaacctcgagctgctcacgaccgtatcgcgccacatcgccgagctcaccaatcaacccctgccgccacagagcccctacgttggggcctcggccttcacgcacaaggcgggcctccacgtcagcgcgatcgcacgtcgtcgcgacgcctacgagcacatcgatcccacactcgtcggcaacaccacgaggttcgtcgtctccgagatggccggacgccagagcattcagctcaaagccacgcaactcgggatcgacctcggcgaggacgacatcgccgaggtgctccgccgtctcaaggatctcgagcatcgtggctaccacttcgaagccgccgacggctcgctcgagctcctgctgcgacgcgcgagcggctggacgctcgacgacgtcgccgtcgagtcctatcgcacgatctccgactgcatgaccgacggaccccgggccaccgaagccaccgtcaagctcacggtgaacgatcggcgtgtcatcgcgaccgccgagggcaacggtccggtgaacgccctcgatgaagccttacgcgcagccctcgaccccgccttccccctcctcaagacggtcaagctgacggacttcaaagtacgtgtcctcgactcagaccagggcacggacgccaccgtccgtgtcctcatcgacttccaagacccagaagacacctggacgacgaccggcgtctcgaccaacgtcatcgacgcttcgttcgaagccctcctcgacggcctcatcgtggcgatcgctcgcgcccgcgaccgaggcgaggaatggtagagcaggaggaaccatggcccaaccagaccccaccatcgtccccgagcgcgacgtcgcacccgccttctgggccgaggaggtcgatcgcgccccgctggctcgccccgcggcgctgcgtggacgtcgactcgacaccgggcccgctcgcgggcgaccgggccccgatcaagggtggggctaccatctgttgaccctggtcgaaggcgagctcgatctcgtcgctggcgaacagcaccaggacatcacggctggggtcgccgccattgctgcagccctcgccgcgctcgaaggccgcgcgcccgtcctcgccgacgtcacccgagtcatcgacgcctaccatctccgcggaggcgcctcctcggacgacctgcgcaagcgagggcgcttccgcggcgtcgcccacgacgcgctccgtcgacgcctcctcgtcgacgcgaccctcgccgagctcagcgccgtccccacggcgcgttagaccgcggcctccgcgaccggtcggccggcactcgctgcgtgacggcccctcagccaggctgcgcccgcgaccactccccaagcgatctcgagcgcgagcagtaggtccgcggccacccgaacacgaaggacccatgagcgagccgtcgcgatccgccgctgcacggatgacacctctgcttcgaagacgacgacacgcccctcgaccgacgcgagggtccgaccaccggccgcgacctccgacgcgacagggccgaggccacggcacagcgaacctgcctgcggcaccagctgctggacgagcccgccgacaccacttgcgcacgccgcctcggcaacactgacctcgtgctcagcactcccgaccgcgacacgcagtccgcgcgcaccgttgctcacgcgctcgaggaccccagccacgcgcaccagctcaccgtgcccgtgatccagttcgcgaactaccgaccccagcaccggcgacggacccaccacgatcaagccgagcccgatgagcgtcacgaagaccaccccgagcacccgctgtagcacgcgcatcgcaacctccgaatccgggccagacacagtcccaacgcctcgacacagccccaacgcacgacgagccgggatcccgaaggatcccggctcgtcacgaaagcccggtcggcggcgccctactctcccagggggtctccccccaagtaccatcggcgctggtgggcttaacggccgtgttcggaatgggaacgggtgtttccccaccgccatggccaccgcccggacgatctgcggcgtcgagcgctccagagcgagcacgaggagctccaagtcctcggccgattagtaccggtcggctgaacacgttgccgtgcgtacacctccggcctatcaacgtggtcgtctaccacgggccttaccaggttgaccctgtgggaaacctcatcttgagacgagcttcgcgcttatatgctttcagcgcttatcccttccgtaggtcgctaaccagccgtgcccttggcaggacaactggcacacgagcgctacgtccgtcccggtcctctcgtactagggacagcctctctcaagtttcctacggctgcatcggatagggaccgaactgtctcacgacgttctaaacccagctcgcgtaccgctttaatgggcgaacagcccaacccttgggaccgacttcagccccaggatgcgacgagccgacatcgaggtgccaaaccttgccgtcgatatggactcttgggcaagatgagcctgttatccccggggtaccttttatccgttgagcgacggcgcttccacatgcgaccgccggatcactatgccctgctttcgcacctgctcgacatgtgggtctcgcagtcaagctcccttgtgccattgcactcgacgactgattgccaaccagtctgagggaacctttgggcgcctccgttactctttaggaggcgaccgccccagtcaaactgcccacctgacgcggtcccggacccggattcacgggtcgcggttagagctccagcaccgacagggtggtatttcaaggacgcctccagggaagctagcgctcccctttcgcaggctcccacctatcctacacaatcggaaccaaagctcaacatcaagctacagtaaaggtccacggggtctttccgtcctgatgcagctaacgagcatctttactcgtacttcaatttcgccgggtctgtggttgagacagtggggaagtcgttacgccattcgtgcgggtcggaacttacccgacaaggaatttcgctaccttagcaccgttatagttacggcggccgtttaccggggcttaggttcagagcttcgcccttgcgggctaacccctccccgtaaccttccggcaccgggcaggcgtcacagcgtatacatcgtcttggcgacttggcacgctgctgtgtttttagtaaacagtcgcttccccctggtttgtgacaccccctcgggctccgggcgcgaggcccttcaccctaccgaggtcttccttatcccgaagttacggaagtaatttgccgagttccttaaccacagttctcccgctcgccttggtattctctacctgcctacctgtgtcggtttggggtacgggcgcctcgatcactcgctagaagcttttctcggcagcatgggatcagtgacttcgcccgaagtgggctcggagtcgcgtctcaggcttcgtgaggtccggatttgcctggccctcgccctacacgctttccccaggaacgaccaacgcctgggatcacctaccctcctgcgtccctccatcgctcaaacgcgatcggggcggtaccggaatatgaaccggttgtgcatcgactacgccttgcggcctcgccttagctcccgactcaccctgggtggacgagccttgcccaggaaccctgaggcattcggcggaggggattctcacccctcgttcgctactcatgccagcattctcactcgagcgcgctccagctcggctcacgcctcaccttcacggcacgctcgacgctcccctaccgcccggtgacgtacgtcaccggacccgcagcttcggtgaccggcttagccccgttacattatccgcgcggaaccactcgaccagtgagctattacgcactctttgaagggtggctgcttctaagccaacctcctggctgtctgggcggttccacatcgttttccacttagccggtactttgggaccttagctggcggtctgggctgtttccctctcgaccacgaagctcatcccccgtggtctcactgccaggctctggagcatcggcattcggagtttggttgggatcagtaaggctgtgggcccccatagcccatccagtgctctacctccgatgctgaacacctgacgctgcacctcaatgcatttcggggagaaccagctatcaccgagtttgattggcctttcacccctatccacaggtcatcccccctgttttcaaccagggtgggttcggccctccacgggatcttacccccgcttcagcctgcccatggatagatcactcggcttcgggtctaccgcaggcaactctcgtcgccctgttcagactcgctttcgcttcggctcccccacgcatgggttaacctcgctacctacggtaactcgctggctcattcttcaaaaggcacgccatcgccctcgcgggctctgactgcttgtagaccaacggtttcaggatctgtttcactcccctctcggggtgcttttcacctttccctcacggtactagttcgctatcggtcgcctgggagtacttagccttacgaggtggtcctcgcagattcacacgggctttcccggatcccgcgctacttgggtggcgacggggaggcagctcgcttcgcctacggggctgtcaccccctgtggcgcgacgttccagtcgcttcggctcacgcgctgcttggtaactccctggaggggctggcgcaccctcctcgtcgctcccgctacccccggacggcaacgccgccaggcttgacaccgcccgggtttgggctgatccccgttcgctcgccgctactaggggagtcgcggttgctttcctctcctgggggtactgagatgtttcaattccccccgttccctcctcctgccctatgtgttcaggcaggggtgacgtggcattccccacgccgggtttccccattcggacatccatggatcaacgcttggtcgacagctccccatggcttatcgcagtcgcccacgtccttcatcggctccaggcgccaaggcattcaccgttggcccttcgtaccttggagttgtgatactcgtgctcgctctggagttctcaagctgccgcgcagcaggtgcttcgcgaagagggagccagtgcttcgactgggtgcggccactcgttgtggccactccttagaaaggaggtgatccagccgcaccttccggtacggctaccttgttacgacttcaccccaatcgccgaccccaccttcgacggctccctcccttgcgggttgggccaccggcttcgggtgttgccgactttcgtggtgtgacgggcggtgtgtacaaggcccgggaacgtattcaccccggcgtgctgatccgggattactagcgactccgacttcacgcagtcgagttgcagactgcgatccgaactgagaccggttttttgggattggctccccctcgcgggttggcgaccctttgtaccggccattgtagcatgcgtgcagccctggacgtaaggggcatgatgacttgacgtcgtccccaccttcctccgaattaactccggcagtcccctacgagtccccggcatgacccgctggcaacatagggcaagggttgcgctcgttgcgggacttaacccaacatctcacgacacgagctgacgacagccatgcaccacctgtgaagggccccgaaggacaccgcatctctgcggcttttccctccatgtcaagcccaggtgaggttcttcgcgttgcatcgaattaagccgcatgctccgccgcttgtgcgggcccccgtcaattcctttgagttttagccttgcggccgtactccccaggcggggcacttaatgcgttagcgtcggcacggagcccgtcgaatgaggccccacacctagtgcccaacgtttagggcgtggactaccagggtatctaatcctgttcgctccccacgctttcgctcctcagcgtcagtaccggcccagatcgctgccttcgccattggtgttcctcctgatatctgcgcatttcaccgctacaccaggaattccacgatcctctaccggactcaagccatggcagtatcggatggcgacaccaggttgagcctggtgatttcacatccgacttgccaagccgcctacgagctctttacgcccagtaaatccggacaacgctcgccccctacgtcttaccgcggctgctggcacgtagttagccggggcttcttctgcaggtaccgtcagtttcgtccctgctgaaaggagtttacaacccgaaggccttcgtcctccacgcggcgttgctgcgtcaggctttcgcccattgcgcaatattccccactgctgcctcccgtaggagtctgggccgtgtctcagtcccagtgtggctgatcgtcctctcagaccagctacccgtcgtcgccttggtgggccgttaccccaccaacaagctgataggccgcgaggccgtcccgtcgcgcccgaaggctttgctccctcgaccatgcggtcaggggagcacatgcggtattagcaccggtttcccggtgttatcccccacgtcggggtgggttcctcacgtgttacgcacccgttcgccactcggtggcaagccaccgcgtacgacttgcatgtgttaggcacgccgccagcgttcgtcctgagccaggatcaaactctccattggagatcgttccgagggtggagtccaccctcgctcgcctcgccccgggacacgtgggtctcgggtgggggagagtcgatcatggttggtgggtttggtcccaccgtttgtgttgtcggggtgacaccgagcttgtgctcgggtcgcccgcactggcttgtcttccctcttcgcgatgtcaacctgcgcccctgtcggggctctgccacgagggcacccgaagctgctcgtcgtggctggtgggttgccccacccccagcggtgctcttggagcacgtgggattcatcagtgtagcggggtcggaacgggtcgtgcacggttggggggcaaaaaatcgccacggaccctgtgcgaagtccggcaacgcggctctcgccgctggcgtcgcgcccccaatgcgagcttgggtgactcacccggccacctcggtgggcagcacagtgctgtcactcgccccgggaccaggctcgtcgagacctcgatcctcgcggccgaacccaccaactccttcagggagatcggcgttcacgatcgaactcggcgcgacacaccaacacctagccctcgccccccacaccacgccaagagggacggccccgaggcgaccgaagctgcggcgtagacgcctgcagtgcaatgccatccagcacgtgggctgaaggcacacacccggcggcggcatccatcggccagcgcgcgtcggcgcgcactccgaacgccatggtccgttggctcgagaacgtagaagcgcccacgaaatgccagaaggtgatgtcgccactcagggtcccggcgagtcgctcgttcccggagacgggtcgcctaccagatccagccgacactgcgcgacatcgagccgcccgcctggcgacgacccctcgtgcccggtgggacgacgctctcagtgctccatgacgacatgcaggcagccctggggtgggccgacgcccacgtgcacgagttcgagaacgatggcgtgcgctatgcgatgccggacatggctgacgactgggacacggaccgcgggtggccgatcgacgggttcgcctctctcgggtggccggcgaggacagccggttcctcgaccgctacgacttcggcgacgactggcgagaggatgtcctcatcgagaaggggttccccgccgaacccgacaggcgttaccttgcgagcatcgacgggcgccgcggcggacagcccgaggattgcggcgagcctctcgggtacgcggaacacctcgaggtccgagccgaccgcgcggaacctcggcaccgtgaataccgcgactgggtgggcgacttcttcgatcccgaggcgttcgaccccgcggacttcgacgagcacgtgcggacgctgcgcgcattgcgccaatggtgagacgacccattgcgtggcgggatagccaggtcgagagataggcgacccacaccgcaggccttcacggggctgccacaggttcgtggaggcctggccagcctgacggacgtcaactcgcgccaccgccaaccacgcgtctggtgcgctcccacgccaagactcggcacgctcgaagcgaccgcacgttcgatccgtcgtgctcccgagcccaccaccgttcaggcgatcttcaacccacgaccgcgacagggcgcccggcgcgaggccactcgtcgtcgccgaaccgctcagccggatgcgtccccgacatcggcggttcctcgtcgctagttcccacgagcgagctcgttcccttcgatgccgccttcgagctgcggtctaaccccccagaatgacccgcgggcccttgccccacgacagatagtgccacgaccagttcatgagcacggacgccttgttcctcgaaccaaggagaaaggcgacgtgcaacagcagccacgagacccatgcgggggttccgtgaagccgcacgcctcctgcaagctccgcgacggcagcgcggcgtccgatcgtcgccatgatgcccttgtcccggtagcggaacggctccgtctcgctaccagcgagcaaggcgaggatctggcgtgctgcgtgctcgcctccttgcagggcgggctgcgcgagctggggcaagggcgcgccgtcacgattcgtcgacagcgcgacgtccccgaccgcgaagatccgatccgatccgacgacgcgcagatccgagcccaccatgatgcgcccaccgcggcccgtgggcagaccgagcttcgacaccaccggcggaacggcgatgcctgcagcccacagcacgagcccgttgcggatctcacgtccgctcttgaggacgatcaagccctcctcaaccgactcgaccgtctcgttcagcagcaccgtcacgccacgcgctcgcagctctcgacgggcgtactccgagagatcctcgtggaacgcctcgaggagacgcccacgctgctcgatcaggacgaccttcacgtcgtccggccccagcatggtgaaatcggtgtagagcgcccgatgtgcgagttcagcgatcgcgcctgcgagctcgacgccggtcgcgccaccaccgacgacgacgaaggtcagcacgccgtcgtgcacgccgtggctcgctgcatactcgaagcgctggaagatatggttccgaacgtcgacggcggcgtccagcgtgtagatcgtgtgggaccgttcctccgcacccgggatgccgaagaacgatgcgctcgccccgatcccgagaatgaggtagtcgtagtcgacgatacgaccatcctcgagtccgatgaagcgacgcttagcgtcgacctcggccaacgtcccttggatgaagtgcgcgtgacgcgctctgcgcaacacggtgcgcaacggataggcgacgtcaccggcgttcagtcccgcagtcgcgacctggtagagcaacggctggaacgtggtgaagttgtggcgatccacgacgaccagctcgaccggcgcatcccgaaggacctcgatcgcggccaatcccgcaaagcccgcacccaccacgaccacccgtggacgagaaccctggcgcaggtcaccggactgtgattgtgtcgactgatcctgatccacggtcttgaccatcgcaactcctcacatcgtgcccgctcgctggagagtctacgaggaaccccgcccaggtcgcgtggcccgagtcagccgtgagccctgaaccgcgaagcgcaccgctcccgaaacctcgactggacgtcgaccgacgacgaggactgcgcccccgatcgactcgcgaaggacgcgatcgaacacctccggcaccacgtctgcgtcctcgacccacaacagcctcgcgaccgccgggcggaccagggccatggccagctcgagtcgcgcgcgcgcacgcggtgagagatcgaccgcgacggcgccgtctcgcccctccaatccgcttgcccgaagcacgtccgcgaacgagggaaccggcgccgaaccgactcggcgcgcgagcctgacggcgagcacgaggtgctcggcgaccgtcaggccctccaccggctcgaaatcgcgagccgcgaccgcacccatcgcgcggccttcgagcgtcccaagccgcgcaccccgcacacgaagcgccccgccggcctccgtgtcaccacgagcgagctcaaagaacgcgccggggtcttcgagcacaagcacggcccgctccttccccacgagcgtcagctccgtcagtgacaccggaccgccaggctgccagagctgcccctcgccccagaggagcgcatcacgctcgcgagtcacggccccaccaactcgcgaacgacacgcccgcgagaccgacgaccacaccaaacgaggccgcagcggccacatcctcgaggatcagcgcgtgctgcgcgaggccgaggttggcctgcacggcaggggccgtcacgaacagcgcgccagcgagcatggcgacgatcgggatgaccgggttccgagtccacacgtcgcgatcatggagcaccgcgatgacgcacgcgacaccggtcgtggcagcagcgatgccgacgaggccgaccacgaccaccgacgacgcaagcccgagcggcaccggagcgagcagaccacccgctagcacagcgacggccaggacgaggaggtccgctgccgcactcacccgaacgacgcgcgatcgacgcaccggcagcagggcaacgagccctcgcgagtcgaggaatcccccgagcggacgtccaacgacgagaccgagcgcgaggaccccgaccaccaccggcaccgcgcccgcagggtcgccacgtacgagcgccgccagccccgcaacggtcgcggtccccgctaggagcagcgcaacaccggccgcggcacgaccgcgtccgaggccgagccatgtactcgtggcgatcggggcacgcagcaggcccgcctccacgacaccgtgcggtcgatcggcaccgcgacgtggtcccgacggccgcacgtcaaggcgcccgacgccgatgcgcaacgcgagcgcgaggatcccgaggccgacgaccgccacggcatcggtgcgacccaacagccatgcaccgacgctcgcagcgagcgcaccgctcgggacgcgaccagccaccacgacagcgatcacgagcatgccgacgatcaccgcacgacgccgactccgcgcaccccggcgaacgatcccgagcacggcgccgagcgagacgccaaccgcaatccacgtcccgcgaaccacgtccgagcgatgtccatgggcaagcgggagcacgagtgcggcccccgcaaccacgccaacgatcagctccgcggcgaccgagcgcgcgctgtcgtgctccgcggctggcatcgcgatcccgatcgccacgagcgcgatcaccgtcgccgcgacgactcgtgccacccaagccaggctgtcaccgccgagcaggtggagatcacgctcgagaacggcctccccgacgacgagcgtcacgagcccccagagaccggggcgaaccagtgctctcgggctcacccacccgagacctggtcgagcttggtcgccgacgccaggaacggcatcattgcgcgcagatctcgaccaacctgttcgatctgggcctcgcgcgcctcacgccgcaaggcctcgaaacgggggcggcctgccgcgatctcgtcgaccagctcggaggcgaacgctccggagcgaatctcgtcgagcacgcgacgcatctcggctctggtctcgtcgttgacgatgcgcggtccgcgggtcaggccgccatactcggcggtctctgacaccgagaaccacatgccagacaagccgtgctcatagagaagatcgacaatgagcttgagctcgtgcaggcactcgaagtaggcactctctggctgatacccagcctccacgagcgtgtcgaaccctgcgcgaacgagttgcgagagtccaccgcacagcacgacctgctcaccgaagaggtcggtctcggtctcctcggcaaaggtggtgtcgagcacaccggcacgcgtcgatccgatcgcccaggcgtacgcgagcgccgtgtcgtgggcgcgaccactggcgtcgttggcgactgcaatgagcgacgggatcccgccgccctcctcgtaggttctgcgaagcaagtggcccggacccttcggggcgatcatgatcacgtcgacgctcggatcgggctcgatcaatccaaagcgaatgttgaagccgtgcgcgaacgcgaccgcgctcccgggctggaggttgggggcaacctgctcgcgccacaacgtcggcgccgtcgtgtccgggacgagcagcatgacgagatcggcccagcgaacggcgtcggccacactggagacctcgagtccactggcacgggccttgtcggccgacgcggacccttcgcggagccccacacgtaccggcacccccgagtcgagcaggttcagcgcgtgcgcatgaccttgggacccgtagccgatgatggcgacgcgccggtcagtgatgagagcgggattcgcgtccttgtcgtagtacatctgagccacgcgtcagctcacctttcctcgtcgtgccactcgtctgactggcttgggtagtctggccagcgcaatcctaccgctgcgctgcacctcgacgatcccgaactctccaaggagcgcctcgacgtcgtcaagtgccgacggcgcgagcgcgaacatcaaggtcagccgttcggcgttcacgtcgagcacctggccgcggaacaactcggcgagctcgagtgctcgtgaccgggacccaccctcggccacgatcgtcaccaacatggactcgacctcgacggcgtccgacgggtcgagctcggtgatcttgaggacgttgatgagcttgtggagctgcttcgtgatctgctcgagcggcgcggtctcgacgtcgacgaccatggtgatccgagagaagcgctcgtcgtccgtgggtgcgaccgctaacgagtagatgttgaacccccgtcgtgagaacaggagcgcgacccgagcgagcacccccgccttgttctcgacgaggaccgagagaatatggtgccgcccgtggacgggctggcgaattgcgccgatggggaccagattcgacgaggcgctcatcgaccatcccccacgaggtgaggcggcagcacgatgtcatcgttcgatgctccggccggcaccatcgggtacaccttctcgaaggtatcgacccgaaagtcgatgacgacgggccggtcgtccacctcgttggccttctcgatggcagcgtcgacctcctcgggggcgtcgacccgcatgcccaccgcccccatcgcctcggcccagcgcacgtagtcgggcaggtccggcgagagatagacctcgctgtagcgctcgtcgtagaacatctcctgccactgacggaccatgccgagatagccgttgttcaagatggccactttgatcgggatgcgctctgccgatgcggtgacgatctcctgcgccgtcatctggaagctgccatcaccatcgatcgcccagaccatctgccgaggccgggcagccttggcgccgaccgccgccggcacggcgaaacccatcgtcccgagcccacccgagttgatccactggcgtggcgcacggaacgtccagaactgcgaggcccacatctgatgctgacccacgccagccaccaaaatcgtgtcgtccggcgtcaatgctcgcaaccgctccacgacgaactggggcttcgtcgcagagcctggctcgctcgggacgtacgacagcggatagcgctgctgccactcggcgatcgtcgcacgccaggccccaaggtcggccggctcggccggcaagcgccgaagcagctccggcaagacgttgcgcaggtccccgacgatcggtacgtcggcacggcgcaccttccccaactcggccggatcgacatcgacgtggatgaccttcgcctcgggagcaaacgcgctgacacggccggtcacgcgatcgtcgaagcgtgctccaagggtgatgagcaggtcagcgcgctgcatggccatgacggcggcataggtgccgtgcatgccaggcatgccgagcgcgagcggatggtcgtcggggatgatgccccgagcgagcagggtggtcaccaccgggatacctgtgcgttccgcgagcgctcggagctctcgctcggcccccgcacggaccaggccgccccccgcatagatgaccggccgccgagccgcggtgatgagcgccgcagcctgttcgatcatcttggggtggcccttggtcacgggctgatacccgggcaggtcgagacggcgcggccagtaccactcgagctcgccagttgagacatccttcgggaggtcgatgagcacggggcccggacgtccagtggtggcgacgtggaacgcctccgccaccacgcgcgggatgtctgccgggtcggtcacgagccagttgtgcttcgtgaccgacatggtgatgccggtcgtgtcgacttcttggaaggcgtcagagccgatcgccccggtcgggacctggccggtgatcaccaccatgggcacggagtcgatcgcggcgtcggcgaccgccgtcacgatgttggtcgccgccggaccgctcgtgacgatggcgacgcccggacgaccgctcgcctgcgcatagccctccgccatgtggccagcaccttgctcgtgacgcacgagcacatgccggatgggggaatcgagcaacgggtcgtagaccggaaggatcgcgccccccggcaacccgaagaccacgtcgacgccctccatctcgagggcgcgcaccagcgcctgtgctcccgtcaaccgcatgtcgtgacccccttgtgctcggcgctcgccgccaactcctcctcagaccgtctaccgcgacccggatagcaaaagacctcccgcaagggaggtccgatgggcacgacgacggaggacgccgtgccctagcgaaggagtacgagcgaattcgtcgccatggcacccaacctagcgcgagtcgtcgtcgaatcctgccgaggtcaccgccccaacatcggcaccgcgcacgagcgccgcgaacttcgcgagcgcaccgctcgtgtagcgagggggcaagggcgcgaacgacgctcgtcgtcgctcaagctcgtccggggcgacgagtagatcgatcgcatggttcgggacgtcgatgcgaatccggtccccgtcgcgcacgagcgcgatcgggccgccgtcggcggcctcgggagccacgtgaccgacgcacagtccatgggtgccccccgaaaagcgaccgtcggtgacgagcgccgcgtccgaaccgcgtcccgcccccttcatcgcaccggtcacggcgagcatctcgcgcatgccgggcccgcccttcgggccctcgtagcggatcacgacgacgtcgccagcgcggatctccccggccaagatggcggtcagggcagcttcctcgcggtcgaacacccgggccgtcccctcgaagacatcctggtcgatgccggccaccttcacgaccgatccgcgcggcgcgaggcttcccgtcagcacggcgatacccccgacggcatgaatcgggtcgtcgagacggtgaatcacgactccatcggccgctggcggatcatacgcatcgagttcatcaccgagggttcgccccgtggccgtgagtacgtcggtgtggacgagacccgcctcggccagctcacgcagcacgaccgggaccccgccgacgcggtcgatgtcggtcatgtagaacttgccgtgcggcttggtgtcggcgaggtgcggaaccctcgcggcgatccggttgaagtcatcgagccgcagctcgacacgggcctcgttcgcgatcgccatcaggtgcaagacggcgttcgtcgacccgccgagcgccatgacggttgcgatggcgttctcgaaggcctccttggtgaggatgcgtcgcgccgtgatcccgagctcgagctggcgcatgacgagttcgcccgcctcgaacgccgcgtctgcacgacggcgatccaccgctggcgcggacgccgacccgagcggcgccaagcccagcgcttcggacaccgaggccatggtgttggcggtgtacatacccgcgcacgaaccgggcgtcgggcacgcgttgcgctcgatcgcgctcagttcgtcctggctgatctgtccggcagcatatgcaccgaccgcctcgaacaccgagacgatgtcgagccgctgatccttcagatgacccgggaggatggagccgccgtagacgaacacgctcgctaggtccagccgtgccgcggccatcatcatgccggggagcgacttgtcgcacccggcaagcgtcacgagtccgtccatgcgctcggcgtgcaccatgagctccaccgaatccgcgatgacctcgcgcgacacgagggacgagtgcatcccctcatgacccatggagatgccgtccgataccgcgatggttgcgaactcgagcggcacgccgccggctgaccgcacgccagccttgacccgcttggcgagctcaccgagcggcaaattacatggtgtcacctcgttccacgatgaggcgaccgcaatctgcggcttgtcgaagtcctcctcgaccagcccaaccgcgcgaagcatcgcgcgcgctggtgctcgcgtcggcccctcggtgacgtcccggctccgaaccttcagctgccgccgctccacgttgacaccccctgctctgcgacgtcggcgacaacgccgacagctcgtttgccgtgcgggcccgcccgaaccgcttaccctacgtcgaactacgctccgacgaggcgcgctcgtcgagcgcacggcgggcgagctgaccagggaccttaccacccgaacggcgcaccacctgtcctacgaggaaccccgcgatcttggcgtcgcccgccacgaagcgcccccactcctcgggcgccgacgccgcgacctcctctgccaacctcgcagcctcggcttcgagcccttcccgtccgcccgccacggccgcgacgagggcctcgatcggatccgaacgctcggcagcgatacgcagcacctctcggacctgctgggcgagcagcaggccgtctgcctcggccttgaggacctcgaccacgcgcgcgggatcgatctcgacgccctgcgagcgcacctgcgcgatctcgttggcgactcgcctcgcaacgagtgtcgctggaagtccggcgtcgagcgcaactcgggtgtaggcccacagctcctccgacaccgccgtctcgcgcacgtctgggctgacggccgcgtcggcgaggcgagcacggcgtgtgcgcggcagcgaggcgacgagtaggtccgacatcgcctcgacggcggcctgatcgaccacgagtggcgggaggtccggctcggggaagtagcgatagtcctcggcggcctccttggtccgcaagccgacggtcgcaccgcgagcctcgtcccagtggcgcgtttgctgcaccacgggctcaccgcgctcatagctctcgatctggcgcatcgcctcggcggcgatggcacgctgcaacgagcgcaacgaattgaggttcttcagctcgacacgggtccgcagctcctccgaaccgatcggtcggacggaaacgttcgcgtcgacacgcagggacccctcctccatgcgcccgtcgctcgcaccgacggcgaccacgatcgcacggagctcgctgacgtaggcgcgtacctcgtcagggtcgcgcagatcaggggccgacacgatctcgagcagcggcacgcccgctcggttgtagtcgatcagggtccgctcggccgactcgatgcggccccctccacccacgtgtgtgagcttgccggtgtcctcctccagatgagcccgctcgatgcgaatccgtcgacccccatcgagctcgaccgcaccgcccgcacagatcggcacgtcgtactgcgagatctggtagttctttggcatgtccgggtagaagtagttcttgcggtggaactggctgctctggacgcgcgatcccagggcggctccgaccgccatggcgatctcgacgcagcgcgcgttcacgaccgggaggctccccgggaggccgagacagaccggacacacgttcgtgttgggtgcctgcccgaatgcgttggcacacccacagaacagcttcgtcgcggtccgcagctccacatggacctcgaggccgatcacgagctcgaatccgcgctcgagccacggccacctcatcgctcggctcccgcctcgagcgctcgcgccgccaccaacatgcgcgcatcctcccacgcaggtgccatcacctggatcccgatcggcaagcgatcagcgtcgtagccgaagggcactgacaccgcaggcccaccgaccaggttcgacggcaccgtacagacatcggaccggtacatggccaccggatcggcgacccgctctcccaggcggaacgccgtcgtcggcgacgtcggggtgatcagcacgtcgacatcggcaaaggcacgagccaagccggcagccagccacgtgcgcacgcgctgagcctggacatagagggcgtcgcgatagcccgccgacagcgcgtaggtgccgagcatgatgcgtcgcttcacctcgtcgccgaagcctgcggaacgtgtcgccaccatcatctcgtcagtggtgagcgcctcgacgcggagtccgtagcggacgccatcgaagcgcgcgaggttcgacgacgcctcagccggggcgaccacgtagtacgcagcgagtgcggctgccacctcggggatcgacacggagacgacgctcgcacccaggcgctcgaggtggcgggcggccgcctcgagcgcggccgccaccgccggatccgcggtctcggcgagctccgtcaccacgccgacggtccagccagcaacgtcgcgatcggatggatcgctcacgatcgggccgcggggtgcactcgtggcgtcacgcgggtcgtgcccgctcagtaccgccagcaacgccgcggcgtcgtccaccgtcgccgcgaaggggccgatctgatcgagggatgaggcgaaggcgatcaaaccgtagcgtgagatcgcgccgtaggtcggcttcacgccgaccacgccacagagggaggcgggctggcgaatggatcctccggtgtcagaaccgagcgcaagcgcgctgaagcgggccgccaccgcggccgcagacccgccagaggagcctcccggaacacggtcgagatcgtgcgggttgcgagtcggcccaaaggcagagttttcggtcgacgatcccatggcgaactcgtcgagattggtcttgccgacgatgacgccgccagcggcgagcacccggtcgacgaccgtcgcactgtagggcgacacccacccttccaggatccgcgagcccgccgtggtcgggactccctcttggacgatgttgtccttgatcgcgatcggtacaccggcgagcggacccggatcatgaccggcccgcacggcggcgtcgacagccgccgcccggcggcgcgccgcgtcgaagtcgagatggaggaaggcatggacctcgggctcttcgaccgcgacctgcgcctcgtaggcctcgagcacctcctcggcccgcacagcaccctcgcggaccgcacgagcgatgtcgaccgcccccagatcgagaatcgcctccgagttcacgcgtcgagctccacgatcggcggcaccaccagcagctgctcctggttgaggcgatccccgctggccaacccggcggggccgagacttgcctggacgacatcagggcgtagcgacgacgactccgatgggacgtgctccatcggggccacgcccgcaagatcgagccgagcgatctcgtcgatcagcgccaacaccccagagagctggtcgcggtagtgcgcgagttcaccgtcatcgagacgcagccgcgcgagccgggccacgtggagtacttgctcagtggagatgccgtcctgcacgcgcgccatcctagcgacgcggccacgaccgactaagacgtgatcgcacgcaggatcgccgtcacgcgctcgtcccgggtcgcgaagacctgcgccagcccgagcagcttcgtgatgtcaccgttcacggtgacgcggccggcgaggaacgcctcgacggctcgctgggggtccatgtcgacgaacatggccttggcggtctcgtaatcgatcgtgatggtgagatccgcctcgtccacgaggcccaagccgatctccaagatgcccgaggtggtatcgatgtgagccgtgatcggttcggggccgaacggcgtcccactgatcagctggttcatccgcagcggcaccgacacgctgatgggctcgataccgagccgactcgtcaggttgtcgaactcctcgagccatgcctgcgacaagaactcgtgtttcgcaagcccctcgaggatttcgggatcgaacgactccatgccccacttcctgaccggcgttactgcgtgcagcctacgagttcggggcgagcaccaagttcaccgcgctcccgaccgggacctcggtgccagccggctcaccctgggcgacgacgaccgccgaggtgccgaggtaggacgcaacgccgttcaacgacaggccgcccggcgtcgtgagctggccataggtcaggtgatccgcctggagcgcagcgaccgcttgcgcaaaggtgtcgtcgaagaggttcgggaccgcgacgtcggggggaccttgcgagatcacgagcgccacagtgctgccgaacggagccaccgtgcccgcacccggcgattcgctgacgacatcgcccgatgggaccgaggtcgagtacgcctgcgacgtcgtgacggcgaatccagccgcgcggagggcggctgctgcagtcgcctctggctctcccgcgaccgccggcacggcgcgcggcggcggtccagcggacacgatcagcacgacgacgccgtgccaccggacgcgttggccagccaggggctctcggatcacggtgccggccgagacggtggccgagtaggcccgatcgagccgcacaccaagaccgacacgcgagagcgcgcgtcgagcatcggaggcgatgaagccgacgacgtcaggggcgaccaccggcgcatggccgcgtgacacgaggatctcgacgaccgcgagcggatggagggcaacccctgcaccaggcacggtccccacgacgcgtccgggcgcgaccgtggcgctgtaggtctcgcccgtccgaatgcggaagaagccgagctcggagaggcgtgctcgtgctgcggcaggttcgaggtctgccagccgcggcacgctcaggcgtcgaacggcaaggtaccaggttgcacccagggcggccacgaccacgatgacgagcagcatgagccacacacgccgccgacgtcgcgctggagggcgtgcctcgatgctcgtcagcgacgccgtgcggccctgatccggggggacgaacgcgaccgacaacgaacttgggtcgaggacggcctcaggatcgtgcgcaggattttcgagcggtagcggtgacggcgccgggagcgcgcgcaccagttcgtcgatgagacgatgcagcgtctcatcgtccggtcgctcggcgggatcccgacgcgtcatgcgaaccaccacgtcgagcagctgtcgtccgggctcagggttgaccacgtccttcgtgaggcgttggcgcgcgacctcctcgatcgacccgccctcgaacgggaacgagccagtggcgagctcatagagcacgagcccgagcgcgtaggtgtcggccggggcctcactgcgagacgccagctcgtcgtgtgcacccagggccgagcgcagctgttcgggcgctgcgtatctcggtgtgccggcgtggcgcccaccggaggtctccgatgcgtgacgcaccagcccgaagtcagccaggcgcacgtggcccgtctcgtcgagcaagatgttcccgggcttgacgtcccgatgggtcagaccgtgcgcatgggcggcagccagcgcgctcgcgacctcttgggcgatccgggcgacttgcgcatcgtcgagacggcgaccacggcggacgagatccttcagcgatccgttcggcatgtactccatcacgagcacgagcccgatcggcgggccaacgtcgaggaggtcgagcacacgaacgacgtggggatgctgcatctgcgagatgacctgcgcttcgcgccgcagctctcgaacaaaggtgccatcggtgcgcagctccggccgcagcaccttgagcgcgacgggcgcaccgagtcgaaggtcgagcgcgacgtagacgacaccggcaccaccggtgccgaggcgccgctggacgacgtagcgaccaaccagggtccgacctgtgatgtcatccatcggcgacgtcacgctgaccaacgggctcccacctcgatcccgcgatcgacggtatcacgcatccgacccgcctcgacggtcgatgagctctcggagcccatcgaggtcgatgacggggatcccccgagcgcgggcctcgtcgagcttcgaccccggtgatgcccccgccaccacgtagctcgtccgctggctcaccgacgtacgcacctggccgccgtgctcctcgatgagcgcagcgagctccgcacggccaatgcccggcacggtgcccgtcagcacgaagctgaggccctccaggggtccaccggccgcgcgcgggcgatcggctgaggctccgaccccagcacgttcgagcttgtcgaggatctcgcgcccgaggtcgctgtctcgaaacgcgacgacgctcgccgcaacgaccgggccgatcccctcgacgcgacagagctcgtcctctgtcacggttcgaaggccactgagtgagccgacgacgtcagccacgagcatgccgacgtgctgaccgacgttgtcgatggcgagggcgaagatgacacgcccgagcgggcgcgaccgcgacgcctcgatgccagctcggaggcgctcgatgctccggtggcgcaccccagggagccgtgccaggtcgtcgtccgtgagtcggtacagatccggcgggacgaccacgagccctgcctcgacgagctggcgcgcgcgttgttctcccaatccatcgatatccatggcgtcgcgactggcgaagtggatgaggcgctgcacgagctgctcgggacagcgacggttgggacagcgccagtcgacctcgccgcgatcgcgcacgaggggcgtatgacacaccgggcaggtcgtggggaagacccatggcaccgcgtcgtcgggacgcagctcgagtaccggacgaaccacctcgggaatcacctcaccggctcggcgaacgatcacggtgtcgccgacacgaacgtcgagccgtgcgatctggtctgcgttgtgcagcgtcgcgcgactgacggtcgagccgccgacccggaccggatcgagcaccgcgaacggcgtcaccttgcccgacttgcccaccgacacctcgatccccacgagccgggtcggacgctcctcggcggggaacttgtaggcgatcatccaccgtggcgcgtgcgtcgtcgtgccgagacgcacgcgatcctcgaggcggtcgaccttgatgaccgcaccgtcgatgtcgtagtcgagcccgtcacgagcctcggcgagccacgcgagcttgtcggcgagctcgtcgaggccgaccggggtggcgtgtgcttcgacctgaaaaccaacctcgccgagccactggagcgcttcgtggtggtagtcgaagctcggcccctcttcgagctggtaggcgaagaaggagagcccgcggtcgcgggtgagcgccggatccttctggcgaaggctcccggcagcggcgttgcgaggattggcgaacggtcgctccacgcgctcgttcagggcccgaaaggccgagcggggcaggaagagttcgccgcgcacctcgacgagcccaggtcccgtgacgcccttgagacgacgtgggatcgcgtcgacgacgagggcgttcgccgtcacgtcctcgcccacctcgccgtcgccgcgagtggcagcttgggccagacggccatctacataggtcagcgagagcgcaaggccgtcgatcttgagctcgaagaagagcgcagggtcgtggccaagaccgcgccgcgtccgctcgacccaggcgtcgagctcgtcggcgtcgaagacgttgtccagcgagagcatcggcgttcgatggcgcactggagcgaagctcgatccgggaggcgcgcctaccctctcggtgggcgagtccggagaacggagttcggggtgggccgcttccaacgcccgcagctcgaggaccagcccgtcaaactcatcgtcgctcatgatcggatcatcagcgacgtagtacgcctcgctcgctcgctggatgagcgagcgcagcgcggcaacgcgggcagcggccgactcagtcatcgtcgacgacccgtgccgaggcgagtacccgatccttggcgtcgtagaggacgactcgctgcccgggagcgacgcgacgagcaggctcgtcgaaggcgaccgccgcctcggacagcgacccaggaagcgcgacgccatgcgctgcagtttggacgaggccccgaagcggctcgctccggggcacgtaggacaccagatcctcgatcggctgggctgcgaccaagagatcgctcgcactgccgacgcgaacagccgtccgagacttcgcgatcacgtagcgcggggtggaccccgagcgaccgggttcgcgaagccgctggcccacggtcgccagctcgaacggcagcgtgaccccgaccggctcacccgcgacgtcgcggacgggtacatcggtcaagccgacggccgcggacacgaacgccgctcgcccgtggggcacgaaacacacgtcctgcgaatcgcgcttgtcccacaccggcaatccggccgcgtgggcacgggtgcgcacctcgtccttggagagctcgccgagcggcagccagagacgcgcgagcacctccgggggcacgtccgccaacacgtacgactgatccttacgccgatcccgcccccgaacgagcatcggccgcgacccatcgaggaccgtcgcatagtgaccggtcaccaagcgggaggcgccgagtcgctgtgcccaagccgcgagggcggtgaccttgacgtagcggttgcacgacatgcatggattcggtgtccagcctcgccgatgggcgtcgagatagggttcgaccacggcgcggtggaactccgctcgcatgtcggccacgatgtggttgatgccgagcagggctgccacggtgcgcgcgtcctcgacgtccccaaccgagcagcagccgcggtcacctgcggcttccgtcaggcgcaaggtgacgccgatcacgtcgtgaccagcctcacgcgccatgagcgccgcaaccgaggagtcgacgcccccggacatcgcgaccacgacacgcgccaccgaccctcccctcgacgtgccccacgctagtggcgtgcctgccgcgacgatcgaccgagcgcgcgcgagaggagccccgggacgtcggtgatgatggcgtcgacaccaaggctgtcaaggaacgtcgcctcggcgacatcgttgatcgtccacacccacacctcgcaaccgagcgcgtgcgcgtcccgaacgcgccgctcggtgagcagtggaacgccacgatacgaacgcggtaccgacaacacgcgccaggggggtcgacgctggcgcgaaccagcgatccaggctgccacctcactgggggcagcggtggtccgcacgccgggccagcgcgacctcacccgctccagaaccccccgatgaaagctggcgaccacgcagcgctcgagggcccccgcatccgtgagcgtcgcgatgacgcgtgcctcgaggtcgcccgagggcccatcgtcgtccttgatgtcgatggaacacgcgaggccctcggtcaccgccagcacctcctcgagtcgagcgagcgatgcctcgtgggtgccgcacgggagccgaatcgtcgcgagttgctcccaggtcgccgatgcgatggagagcgccacaccagcggtccgatccagcgtcgggtcgtgatggaccaccagcaccccatcggcactcttgcgcacgtcgagctcgaccccagtagcaccgcgcgccgctgcactcgcaaaggattcgcgggtcgactcgcacgcctctcccatgcccccgcgatgcgccacgatgagcggcgtgctgcgcccgtccacgcccgcggatcctaacgactaggctcgacgccaaggcatgctccaccacgttctcttcgacctcatcggatccctgcgcgcaagcctcaaagacgccatgcttgagggcggcggactcgacgagcagcttcacgtcgacatcctgctgggggacacaacctacgaaacgtcggcaagcctcccgggtgaggaagcgccgccacgtgtgcgcgcggacatctcgctggagtggtcgacctgggctcagagtgcctatcgatcctggacgctcggtgagggactcgacgaacccatcgacgttgtcctcgaggtcgcgcttcgcgtgtcgggccttcggggccccgccatgagcgccgcggcgttccggtcatcgctgccatcgcagtcgcctccgctcgtcaatcacgaggtgctcgagctgcgaaccgtctcggccgaaaccaccatcgaccccgacgaggatctcgaggaactcagcctcgaggcggtctacgacgtgaccttgtccctcgacgagaacgagctcgagcaccccgactcgctccacgaggccctgcggcgactctcgggctggatcgcgagcgcactcgtcgcagcgagtgacctcacggcacgacaccgcgcaccctgagatcgcgttgcgcgagtcgacgtgccatcccgtaggctgaccacagagacgagggggtgccgtgaagccaatcccggttgagttccacctggggccgcttgtgctccacacgtacggattcggcctcggcgtcaccttctggttcgcctactggtacctcggcaagcgcttccgccggttcggtctctcgagcacctggctcgagcgtggtttcatccctatcatcgtgatggccatcgtcggtgcccgcgtcgtgcacgttgtcgcgaacatcgaggcctatctccacaacccaatcggggtgttcgaggtgtggcaaggcggtctgtcgtcgtacgggggcctcgcaggcggcattccgaccgcgttgtggtatctccaccgcgacatgccgaacctccgtttccgccgggccttcgacatcgcagcaccggtcctgctcgcctcgtggtccatgggacgccttctcggtcctcagctgatgtacgccggcggtggcctgccgacgaaggcgtggtacggcatgtactacaccggcgagatcggcaagcgcattccggtgccgatctttcagtcgatcgaggacttcacctgcttcctcctcacgctctggatcgcacgccactttgcccgctggcgcatgccggcaggctccgtcgcggtcgccgccctcggattgtggtcgatcgagcggttcttcgacgagttcctgtggctcgcccgtccgcgggtctgggatgccgtcgaggtcttcgcgctcatctgtctcgccttctgcgccgccacgctcgccgtgctgacgtcacggcgaggccgtacgaccgaggtggtcgacctcccgaagctcgtggccacaggaccaaccgcgtgagctcgaccgcgctgctcaccgaccgttacgagctcaccatgctcgagactgcgatcgcgagcggccttgcagaggttccggccaccttcgaggtcttcgcacgctcgctcggcggtcgtggcttcggtgtggtcggtggcaccggccggctcgccgaggcgcttcgagcctttcgcttcgacgacgagatcgtgcgttggctcgtcgacgagcgcgtcatcgggtcaccgaccgctcgctacctcgagcactttcgcttcagcggctccatcgccgcctaccccgacggagagctctacttccctggttcgccgatcctacgggtcgacgcgccgttcggcgaaggcctgctcatcgagacgctcatcctgtcgattctcaacttcgacacggcggtcgcgacagctgcagctcggttacggctcgcggcgggcacggccacactcatcgagatgggctctcgacgcgtccacgagcgcgctgcggttgccgcagcacgtgcagcatggatcgcaggcttcgactccacctccaacctcgccgcgggtcaacgctacggcgttcccaccggtggcacgatggggcatgcgttggtgcttgcccatccgagcgagcgggccgcgttcgaggctcaggccgccgtgatcggatcctcgaccaccgccctcgtcgatacctacgacatcgggcacggtattcgccaggcgatcgaggcgttcggcaccgatctcgcggcgatccgcatcgactccggcaacccattcgtcgaggtacggcgtgctcgtacgctgctcgacgagctcggagccacgaagacgcgcatcctgatctccggggacctcgacgaggggctcgtcaggcgcctggtcgctgagccggtcgatggattcggcgtcgggaccaaggtcgtcaccgggggtggggtgcccacggcacaactcgtctacaagctcgtcgccgtcgaacgcaacggcgttgcggagcccgtcgccaagctctcggcgaacaaggagacgtctggaggccgcaaggctgggtaccgacgcctccgcaaccatcgcatcgtcgaggagttctcgatcgacccagccgtgaccgtcgagccgaccgacgactcgaccctgatggccctcgaggtccccgtcatggtcgagggagacatcctcgatccggagtctgcggcccagagtcgtcagaggctcgccgaccgtctcccgaccctcggcgaggacctcgacgcgatcctcgatgcaacggagcccctgttcgtctgccaccacctcggtccgtcgctgccacgttccgggcacggccagcacgaccagtagcgtgtcgagatggacaccacgtcgctcacgcgagcccatccgagcagcctcggcttcgacgcgcacgtgctcgagcgccttcggcgaaccctcgacacctggatcgaaacccaacgcctcgctggcctcgcggtcgccatcactcgcgacggtgaggtcgccttcgagcactacaccggatgggccgatcgagcgcgcaacgtcccggtcacgccgcagacgctctttcggatctactcgatgaccaaacccatcacctcgatcgcggcgctccagctggtcgaggagggacggatccgcctcgacgatccgatcgcaacggtcttgcccgccttcgccgaaccacgcgtactcgtctctggcggtgcgccagggggctacgcgccagcggtgacgcgcggggcgatcgaacccattcggctctggcatctgctcacccacaccgccggtctcacctacgacttccatcgccagagcgcggtggacgcgatgtaccgcaagctccagcgcaccctcgacggcgccgaccttggagcctgggtcgacgcacacgccgagctcccgctcctgttcgacccgggcacgcactggaactactccatcgccaccgacgtcgtcggccacctggtcgcgacgctgcgaggcgcaccgctcgccgacgtcctcacaaccttcgtcctctcgcctctcggcatgcacgacacgacgttcgaggttccggcctcagaggccgatcgcatcgccgcgatcgtcacccctggtggcgacgggacgctccatcgcctcgggcccgtgcagccggagacccgcgtggcgccgatcgactccggtggcggcgggttgttctcgaccctcgaggactacacacgcttcagcatcgcactcgccctcggtggccgcctcggggacgcacgcctggtcggaccgctcacactcgatgcgatgcgatccaaccaccttcccggaggttcggacatccccaccatggcgatcgccaggccacaacccggcgaccgcccagggaccggcttcggccttggcttctcggtcgtcgatgatccgattgcctcacaccgactcggtccgcgaggttcctacggttggggcggcatggcctcgacgaccttcttcgtgtggccggctcaacgcgtgagtgtcgtgttcatgacacagcttgtgccgtcgaacacgtacccgctcgccgaggaactcgagacgttcgtcgcagcagcgctcacgcggccctgagtcgcacgcccgagccgggctcgcgtgtggcgacccgacgagcctcgcggactcaggcctgtcgggcctcagccgcctgcgcctccgcgatctgacgacgcacgtcgtccatgtcgagggcaaggacctgcgagatcaggtcgtcgagcgcctccttcgggagcgctccaggctgggagtacagcaagatctgctcgcggaagatcatcagcgtcgggatcgacatgatcccgaacgccgctgcgagctgctgctcggcttcggtgtcgactttgccgaagacgatctccggatggacctcggacgcctgctcgtagatgggcgcaaacatcctgcagggaccacaccacgccgcccagaaatcgacgaagacgatgtcgttctcctgaatcgtcgcctcgaagtcgctgagcgtcagattgcgggtcgccatgatacctcttcctctcgatgagttcgctctggcctaacgccaatacccataagggtattccgtgtgcccggagcgggagtcgaacccgcacggccagcggcccggagggtttaagccccctgcgtctaccgtttcgccatccgggccttgtctcgacaccacgaccaggctagccctcggcgccgctcacgcctccacgtcggtgagcagctcggcgagcgacgggtcgagcgcgaccacggcagcagccgtccacaccccaaccggcgagaacccccctgccagccacagtgcaaggtgagcatgcaggcacttcacgccagcgcgcgcaccagcgatccgtggatgcgggacgtggcgtcgggcagaggcatgggcgtgttgggccaactcgagtgcgcgagggtcgacgagctcctcggccctacgaacccctcgtcgagcctcgactcgagcaaccgcctgcacgagtcggcgatcgacaagccaaaaccagttcgattgaggacggccctgccggtcgtattcggccagttcgatgacgatgggccaaccctcgcgagagcgtgcggcaacggtgtagggaatgctgggcaggcgaccaagctggtcggacacccacgcctcgtcctcctcacgcaccacggccacggcgtcctcgccggcgcagcagaatcgcgacgaccaccgccacagcgatcacgggagcgagcgcccggcgagcgagcggacgccagcccacaccgagcacgtcgagcggcgggttgtcggcaggcgttcgaacggcaggcgccgtcgtcgcatcggacacgggctctgcctcggtcgatgcggagtcggtggcctcacccgcctcgtcgctcgccgacgacgcttcgctcccgacctcgccgggaggcgtctgcaagaggtcggcgagccgatcggcgaactcacgcatgagctcggcagacacatccgcaaggactccacgaccgaactgtgcgacgcggccagcgatctgcagatcgaccacgacgtccacgtgcgttccctcgccgtgcggtgtcagcgtcgccgtcaccgtcgccgatgcccgtccttgtccccgctgctctcgaccctcggcgcgaaggacggcaacgccgtgctcctcgtcgagcgagacgaacgacgcctcacccttgtacgaagcggtgatcggtccgaccttgaccttcaccgtgccaaggaagcgatctgcgtcgcgcccggtcaacgccgcacccggcaggcacggagcgatgcgttcgagatcggtcaagacgctccaagcgaccgccggactcgccggcacgtcgaacgcgtttcggatctccaccgctatcctccctctccctcatcagctcgttcctcggcgcgcgagagatcgtgcctcgtatcgacgtccatcgggtcaccttgacacgagaccgacaccaccgtcaggtcccttcgggcgaagagtgctctcgctccgacgtctcctgagactgggagtgcaccgaagaggcgcctcgcgatgcgcacgggattcgctcgcgacccagcatacgtcgccaccgcgagatcgacctcctcgggagccgcggccacggcgtcccacgcctgcgccgtgatgaacggctgatctgcgagcccgacgaccatgccactcgccccgtctgcctcggcccacgccgccgcgagcgcaagcgaactcgcaaggccgcgctcgggatggggattcacgatcacctcgaaaccggtcggcacgagatcgtcgaagcgatcccgaccgaccacgaccgcgcgcgcggccagcagacgtgcgtcggcacacgcgctgagcgcccatgtcaacaaggcgcgaccaccgagaggagtccgcagcttcgcacccggtggatcgaatctggtcgctcgacctgccgcgaggaccgctccgacccacctcaccatgtgaacgcaccagcggcgtgaatgtcgccgtccgtcgccgagagaggcgtaccgctcctgccctctcgacgagcgatgatctcggcaacgatcgcgatcgccgtctcctccggcgtcctcgcgccgaggtcgagcccgatcggcgccgccactctcgcatcgacctcgtcgagatcgacgcccgcctcccgcagacgctcacgacgatcgcgctgggtccgacgcgagcccatcacaccgatatagccagcccgcgtggcaagggcagcctggatggcgggcacgtcgaacttcgggtcatgcgtcagcacgcagatcgcatcgcgcgcctggatctcgtcgcgatgcgcctccaaccacgcgtgaggccatgcgaccacgacctcatcggccatggggaagcgctctctcgtcgcaaagagcgcacgcgcatcgacgacgagcacgcgatagccgagcaatctggcggttcgggcaagcgcatcggcaaagtccaccgcgccgagtaccaccatggtggggggcggcgcctcaacggccaagaccaccgagacctcgcgcgagcgcgtctcgccgagtcgaccgagctcgcggcgcgtacccctcgctgcgtcgatggcccctgccgcctctctcgcgacgacccgatccaacgactcgttgccgaggctaccgaagcgtcgaccatcgccgaggaccgccaacgtcgcgccgaccttgggcatcgcgacgcccacgtggtcggcggcgaagtagtcatcgactgacgagtccacctgccacacgaacgcgaggctcgccgcgacaccgtggccgatggcgtcgacgacctcgtccaagaagtctggcggatcaggatcgacgagaatgtggaacgtaccgccacaggtcagaccgacggcgatggcctcgtcgtccgagtagccaaaggcgagcgtggccgccccccgctccacggagcccgtgatgccgatcgacgcaaggaccgcttcgggggcatcgagccgcgcgagcgcctcggcaacgacggccccctcgacgcacccacccgacaccgacccgacgacctcagctcgctcggagaccgccatcatggtgcccggttcccgcggtcctgatccttcgaccgcgacgacggtggcgagcgccgcgcgcacgccagcccttcgccacgcgacgaccgcctcgagtgcctcacgcacggcccgcctcctccacgatcctcaccgctgcccgctcgagcgacgcaacgctctcacccgcgaccaaggcatccacgtactcgagtgctgccgccatcccgcgcgcgaggggcgcgtagccatccaggccagccagcggattcacccacacgatcgcggcgctgcgccgacggagcgaggccatcgctcggcgcatctgctcgggatcgccccggtcccaaccatcagagcacaccaccacgaccgctgagcgcaagctgcgccgcacgccatggacgaaggcttcgatccctgcaccgaggcgtgtcccgccaccccagtcagcgaccagcgcgaccgcttcctccacggcgacgtcaggatcccgcccaccgagcgctcgactgatgcgggtggcacgggtcccgagcgcccacgcctcgaccttggcgacagcggcgaacacccacgcgagacggagcatggccacggcgtagggctgcatcgagccggaaacgtccagtagaaagaccacgggacgcggaaccgtcgtggctgctcgataccgacgctcgatgggttcgaggtcagtcgcgaaggcagcgcgcatggtcgcccgcgcatcgagctgtccgcgaggtgcggaacggcggcgcgcgctccgtcgcatcggaggggcaagacgaagcgccgcgagcgcctccatcgcctcggcgcgctcggtggcgtcgagcgtgccgaggtcggccgagtgcaggcgctcgaccgccgagtagcgaacgacacgctccgcgcgacgctcggtctcgttctcgccggcaccgtcgtcgccgtcgtcgagggccaccatggtcggcagcacgaccttcgacgcgttcggtgcgacgatcccgagataggaggccgctagctcgaggtaacgagggacgtcgtcagcacgcttgacgaacgtggcgagtccggtctcgagtaccactcgccgacttccaacgcccacgacgtccaaggcttgctcgaaatcgatcgtactcgaggtcgaaacgcgcaatccgccgctgcggaggtgatcgacgaacccgacgacgaagcgttcagctcgacccaccatcgccgtccaccacgccagcacgctcgcgaatcgtccgcacgccgatcgcctcgatgcgctcgagatcttctcgtcccttgacgacgagtccgagcgtggcatcgacgagctcatcgtcgaggtcgtcgatgccgaggcgcacgagcgcctccgcccaatcgatcgtctcggagattccgggaggcttgaacaggccctctcgccgaagtgccgcgacgacacgggcgatctccgtggcaagccgagcgctcacatccgggacgtgtcgacgcacgatctcggcctccaacgacggaccgggggcgtcaacccagaggtagaggcagcgcctcgccagggcctcgtggagttcacgcgtccgattcgacgtgagcacgacgatcgggatcacctgggccccacgagcgccgagctccggaatggtcacggtccaggtggagagcacttcgagcaggtaggcctcgaacgcctcgtctgcacggtcgacctcatcgagcagcagcaccggtggacgggcaggatcctcgccgccgagtgcccggagtaccgctcgctcgacgaggaaccgaggtgagaacagctccgcctcgatgtcatcgacctcgcgaccgcgcagagcatctcgcgcgagcgcctcgagcgtgcgcacgtgcaagaactggcgtccccagtcccagtcgtagacggcctgatggacgtcgattccctcgtagcactgcagccgctccagcgacccgccgaagacgcgcgcgagcgcataggcaagctcggtcttgccgacaccgggctccccctccaagagcagcggtcgctgcagcgagaccgcgaggaacccagacagcgccacccgtggcgaggccaggtagccaacggcgtcgagtgcacgacgcagatcctctggtcgttcgatgccgtgcgctcgaagcggctccggagacctaggcaagctcacgcagtgctcgtgccaccaggacctcggcaaggtgacggcggtagtcggcagacgcgttgacgtcgctcggcggttcgagcccctcggcggcacgtcgggctgcctcgtcgacgccagcaccgctcgcgagcgcctcctcgacgcccatcgcacgtactggcgtcggtgccatgttgacgaacgcaacccgcgtgctcccgttgcgcaccgcgacgactcccacgatcgcccagtcctgcgcccgacggttgagcttctggaacgagtagtcccgcaccgccggcacgcggatctcggtgaggacctcgtcaggcgcgagtgccgtctcgaggaagccccgaaagaaagtgctcgccgggatgcgccgctcgcccccgccgccgcgtgccaccatcgtcgcctcgagcgcgagcagcgcagcaggcagatcggcagcaccgtcaccgtgagcgacggagccaccgatcgtcccgcgatggcgtacggacggatcgccaatctggcccgccaccgcagcgagaaccggcacccgacgccgaagcacctcagaggtcgcgaggtcatgatgacgagtcagggccccgatcgcgacctcgtctccatcgtcgcgcacgtacgagaggtccgggaggtggccgatgtccacgagcaacgacggtgaggccagacgcagcttcatgagtggcagcagcgagtgaccgccagcgaggaacttggcgtcgtcgtgctcgccgaccaaggcgatcgccgcgtcgatcgactgcgctcggtggtagtcaaagggcgctggaaacatgcatcctccctgtcaggcccgatgggccgttgcatcggcgatcaggcgccagactcgttcgggggtggccggcatgggcacatcgcgcacgccgagcggagccaaggcatcgaccacggcattgatcaccgcaggtgcggacccgatcgttccggcttcgcccacacccttgacgccgagcggattggtcggcgacggcgtcacggtcgatcccatggtgaagctcggtacctcggcggctgacggcaccaggtagtcggccagcgacgcggtcacgagcgtgccagcctcgtcgtacaccgcctcctcccagagtgcctgcgcgacaccttgcacgatgcccccgtgcagctggccctcgacgatcattgggttcacctggttcccgcagtcgtcgaccgcgatgtaggagacgagatcgacccgacctgtctcttcgtcgacctcgaccacggcgatgtgggtgccgaacggaaacgtaaagttcggcggatcccacgtgacctgggcctcgaggttcggctccgtgccgtccggcaggttgtgggcggtgaaggcctcgaacgcgatggcgccgagaggaagctccttggtgggcgaacccttgacacggaaggtcccctgggcaaattcgagatcttcctcggctgcctcgagctggtgagccgcaatgcgcttggccttctcgagcacgcgttccgtggcgaggtagaccgcggtaccgccgaccgagagcgaccggctcccgtaggtgtccatgccgagtggcgcgatcgccgtgtcggagtgcaagacatcgacgtcggcgacgtcgatgccgagtcgatccgcgacgatctgggaccaactggtttcgtgaccctgtccgtgcggcgccgtgccggtgaccacctgcaccttgccggtcgggagaatgcgcacagtggcagcctcccagccgcccgcgccgtagctcaacgacgccaacacccgcgacggcgcaaggccgcacatctccacgtagcacgacacgccgatcccgaggagccgtcgctcgccagcggcacgccgtcgcgtctgctcgagacgcagctcgtcgtagcgagccagtgccagcgccttggcgaggttgtcgtggtagttacccgagtcgaacacgaggccaggtgccgagctgtaggggaactgctcggccttgatgaagttccgtcgacgcagctcggccgggtcgaggtcgagttcgcgcgcgagcgcgtccatggcacgctcgatggcataggtcgcctccggccggcccgccccacggtaggcatccgtcggcgtcttgttcgtgaacagtccggtgcactcgaatgagtaggcaggaacgtcgtagaccccgtgatagaggaaggcaccgagcaggggaacccccggggtgacgagctggaggtaggcccccatgtcggcgaggagacgcacccgtatcgccgtcacccgtccctcggccgtcgctgccagctcgatgtactgaacctgtccacgaccctgaatcgtcgctaccgtgttctcgccgcgctcctcggtccacctcaccggcacgccgagacgtcgagcgaggacgaaacacaccagctcttcggagtagacgtcgagcttcgagccgaaacccccaccgacggcgggggcaaccactcggacgtggtgctccggcacgcccatcgtgagcgccaacatcagcttgaggatgtgggggatctgcgtcgcggagtacaccgtgaacgagccgtcgaccggcgacggcacgacgaccacgcctcgcggctccatggctgacggaatgagccgctgctgcacgtagcgctcgctcacggtgaccgccgcctcgcgaaacgcgcgctcgaccgcctcctcgtccggcttcaacgaccagacgaagctcacgttcgacgcgaggtcctcgtgcgctcgtggtccgcccgctgcggccgcctcaagatcgaggaccggatcgagctcggcgaagtcgagctcgacggccgctgccgcatcgacggcctgttggcgtgtctcggcgacgaccaccgcgaccggttcgccctggtagtgcacggcgtcgatcgccaggggatagtgggcaggattgaccatgtccggcgtgaccggccatgcacacggcatgggcgcggcccactcggatgccaggtctgccccggtcaggaccgcacgcacgccaggcatcgcggccgcttccgtggtcgacaccgacgtgatccgaccatgggcaatcggcgagcgcacgagcaccgcccagagcgcacccggaacgacgaggtcatcggtgaaccgcgcctggccggtcaggaggcggggatcctccttgcgaagaacccgctgcccgatcaccccgcccgttgcctgcggctccatcgtcgtggtcatgcctggacccccatgcgctcgtgcgcggcgagaaccgcgcgaacgatgttgtggtaacccgtgcaccgacacaggttgccctcgagcccgagtcgcaccgttgcctcgtcgagcaccgggttctcacggatcagcgacagcgacgccatcaccatcccgggcgtgcagtagccgcactgaagtgcgtgatgctccatgaaggctgcctgaaccggatgaagcgctccgtcgggcccggcaagaccctcaatcgtggtcacctcctcaccggcaacctgcgcggcaaggacggtacaactcttcaccgactcgccgttcaccaagaccgtgcacgcaccgcacgacgaggtgtcgcagccgatattggtcccagtcaggcccagcgcatcgcgcaggaacgaaacgagcagggttcgaggctcgacgtcagcgtgtcgcctttggccgttcacggtcatctcgatcagcatgcggggcctcccttggccttcgatcagatcgtcggagtcgggccccgacgggggcaccgagcggaccttaccacacgccacccagctcgtcacggatctctcctccgcgagccccggctcatgaccgtcagaacgccgacttcggtccccgaggtctcgcttcgccgtggcggaccgcgagtgaccccttgctcttgccgccgagttgtcaatgtgccgtagggctacactggaagccgaggaggcaccatgctcttcgtcatgatcgcgttcgtcgcagcggccgccctcatcgccgtggcgatccactttggtccgcatggctccgtcgtctccggtgtgatcgggctcgtcctcggtctcgtcatcgcctggtccgcgcaggcagcgatcagcacggtcggcgcctgggccctcggtgctggtgtcgtcgtcgtcggccttgcgctcgccggcattggcctacgaggggttcgaggcctcaacactcgcgctgcgatcgccgcaccgtcaccgcttgcacgcctacttggtgaggaagccgtcgtcgaacgcgatctgagtcccatcggcgccattcacgtccatggcgagtcctggaccgcgaccaccgagacgggcgagtccgtcccggcgggtacacacgtcttcatcacgcgagtcgacgggctgcgcgtctgggttgttccggctgccaggccggaagatcgccaacggcactccgcctagaaggagggatcccatggccccgctcatcgttctcggcatcatcgtccttgcggcgctcatcctcatcgcacgaggtgtgcgcatcgtcagggagtatcagcgcgtcgtcgtgttcaggcttggtcgcgcaatcggcgccaagggtccaggactcaccctgatcaaccccgtgatcgaccgtctgagcctcgtcgacctgcgcgagcaatacctggagatcccgcatcagacggcgatcacaaaggacaacgcccccatctcgatcgacttcatcatgttctacaaggtgatcgacccggtcacgagcgtcgtcgccgtgcgcgatttctcgggcgctgcgctgaacgtcgccgcgacgacgcttcgcagcatcgtcggtgacatgtcgctcgatgacgtgctctcgcgtcgcgaggacatgaacgccacgctgcgagtcaagctcgacgaggtcaccgagcgctggggcgtcaaggtctcgaacgtcgaggtacgagagatcaacccaccgccagccgtccaagaggcgatgacgcgccagatgtcggcagaacgaagccgtcgagcgctcgtgaccgagtccgagggtcagcgccaagccgccgtgacggtcgcagagggcgagaagcaggcggcgatcttggcggcagaaggtcagaagcaggcggcgatcttggcggccgaggcagaacgccaagcggccaaactccgtgcccaaggcctcgccgatgcgctcagtgccatcatgcctgaagcacgcaacgccgactcgcgcaccatcatgctccagtacctggacgcactacgcgagcttgcgcgctcgggagccaccacgtacgtcattccagctgagttgaccgggttcctcggacagctcgcgggtgccctcagcgccagtccaaccgaaccctccacgaacggcgtcacaggtcattgacggcggagcgccactcgtagacacagacgggccctccgtcggtgcatcccttcgaacgacggctgaacgcgctcgctgccgaggtcgtcacgctccctgacctcagctggcggctcgttggcgcctcgatgctggccaggacaccccggtgctgagcctggccggtaccacgatgtgcgcttgtgatcgtggcgccatgacgcactgggcgctcgtgcccggcagcgatcggtaccgcgaccacttgcgaccatgtggcgccgctcagctcccgtgtgaagacgggaagctgaacggcgctctcacgcatttgtcgactaaggcccaaggtaggaccagcccaccgcgtcccgccaaccggccgaaggcacgaccccgccggcaatcctggcgcgagcgaggccgtacccactatgacggtggacttcgtcacgcgccgtccaaggcactacctcatgtcccggcgtcgcagacgccactcggtgcggagggcgcgccatcgaagcacacgacccgagacacgtcgttccgcgatcgtcgacaccggctcggcggtcctcacccgccccaaccgagctctctcgtatcgacaccaaacgcccctgccaggccaaccctggcaggggcgcgcgcatgtgaggccgcgccaggcaacgtcagcgccgtgcttcggctccctgccgacgtcgtgtcagcgaatcgacggtcacggccgcaagcaagaccagcgccgtcacgatgtactcggctgccgcactgacgcccaacaatccgaggccgttgtagatggccgcgatgatgatgccaccaagcacggcgtgcaccatcttgccgcgcccgccgaacaggctcgtgccgccgatcactgctgccgcgaccccatagagcacgagcgtgccgccgtcgatgttctccgagatcgatccgaggcgcgaggcgtagacgacccccgcgatacccgcagtcaagcccgagagcgcgaaggccgcgatccgaacccgcgagagattgatgccggcgcgacgagcggcctcggcgttgccaccgatggcgtagatgtaacggccgaaccgggtccgattcaggacgaatgtgtagagaccaagcacccccacgagaatggggacgacgaacggtacgccctcgagcgtgacggtcaccccgcggttggtgttcgccacgatcagcaacacgaccgcagccacggcaccgagcgcaatacgcagcgcaatgacaccccgcggaggcgccgagagcccagcccgccgcatccgctcggcaccgaagaacatccacgcaccccagagcgcgaccaccaccgctgcgatgacccaccctgcgaccaccgagagattgccgttgacaatatcgttgaggatgttcgacgagatcgagatcacaccgccggccgcgggcgccgcgtggtcgatcatgtagagcatgaccccttcccaccccagcagaccagccagggtgacgacgaaggacggcaagttgagcttcgtgatgaggattccctgcaccacgccgatgagggtggagaccgcaaggccagcgagtagcgcgacccaccacggctccttggcgatgatcggcgaagccaggatcgccatgacggaggccccaacaccggccacgtacccaaccgacagatcgatctcgccgagcagcaagacgaacacttcagccatgccgagcaggacgaacgtcgcgccttgcaccagcaagttgacgagattgccggcggagagaaacaaggagttctccgcctggaagatgatcacgatgacgacgaggccggccaacaccggcaacatgccgctctcacccgaacgcacgcgccgccaccagctggagatccagcttcgggtgtccgtgagcacgatctcggcaccctgggcaggtgcgctcgccggtgccgccgccggcgcatgtccattcgacgaaggggcctcctcgacatcaacggggagttgctctcgttccaccatcagactgaggcctccttcgcaccacgcggggcacccgactccagcgattgacccgtcatcagttcgacgacgcgaccaggctcgaactcggctcgatctccctgggcgaccatccgcccgagatgcaaaatggcaatccgatcggccgttgagaagacgtcttgcaggttgtgggagatcaggatgaccgacatgccgctcgcggcgaggtcacgaatgatgcccagcacgacccgcgtctggctcacgccgagagccgcggtcggctcgtcgaagagcaccacgcgcgagttccacagcacggcgcgcgccaccgcgaccgcttggcgctgacctcccgacagcgagcccaccggctggcgaatcgaacgaaccgtcacgaccgacagacccgcgagggtcgagcgcaccttctgctccatcgtcgcctcgtccaagatcccacgacgacgcggctcgcgcccgaggaacatgttctgaacgatgtccagattgtcgcagagggcgagatcctggtacacggtggtgatgcccaaacgctccgcgtcccgtggatcatgaatgtcgacccgctggccatcgatcaggatctctccaccgtcgatccgatggataccagagatcaccttgatgagggtgctcttgcctgccccgttgtcgccgacgagcgcggtgaccttgccggggacgacggtcaagtcgacgtgttcgagcgccttcaccgcaccgaagttcttctcgacgccccgcagctcgaggagagcgccggacactgcctgggtcattggacctcccatcaggctcgtgacgaaggcggggtgcgcagacgactgtccgcgcaccccgctcgtgagagacgctaggccttgatgcccgcggccgcgcacgccgaggcataggtgcccgagcacagctgcgacgccggcacgaagttgtcagcgatcacggtcgacgccatgttcttggtggtgacccactcgggcgtcagcaacaccgacgggatgttgttgcccgagaccggatcatgggtggtgccgttcaagagagctgccggaggcgtcttaccagcgcgcaggtagagcgcgagggagacggccgcctgggcctcctgatagatgggcttgtacacggtcccgcactggtaaccagccaggatgttctgcaatccttggagcgtcgcgtcctgtccggtgaatgggatcgtcttcggcgcgatgtggagcgactgcaggtacgagatgatcggcgcagcattctcatcgttcggcgtcaccacggcgttgatgttgggatgcgccgtgtacatctgctggaactccgtcaacgctaccgacggcgtccacgtccctggaggcgtcccgaccaaggtccacttgcccgacttgaagtacggatcgatcaccgaatcgtacccctcggcaaagagggtggcgttgttgtcggtcggtgcgccacgcatgaccagcacgttcggatgcgtcacgtgccacgcggcgacgcaggcgacgaatccctggccaatcagctgtccgacgcggacgttgttgaagctgacgtaataatcgctcggcgaggagcccagcgtgagacggtcatagttgatgacgcgaacaccgtgctgagcggcgtacttctcgatctcgacaccgacgcccgagtcgagcggatcgaagatgatgacgctcgccccacggctgatcgcgctctgggccatcgacagctcggtcgcgtcggagccctgggcgttctcgacgatgtactggttggacttcaggccagccaactggaaggccttcgtgaggaacggcgcatcgaactcggtgtagcgagccgaggacaccgtatcgggcaagatggcagccacgagacccttgcccttggccgccagcgagctcaggctgctcatggcggtgaagttccggttgaacgaggccgctgtcaccaccggcgtggacgcactcgtggaacccgaggatccaccgctcgagctcgaactggtcgagccacaggccgcgatcgccatcgcggccccagcgaccacgagcgacgctcgcgagaacgacgacattcgcacagacaacccccttgtcgtggcggggacggttccccgcgcctctgcgatggtacgcaggcgtgtgtaaacgaggggtaaacacttgggtcgggacgtgaaaaatctgtaaacggccttacgccgcgtcccgcaccagccgatagccagcacgcggttgcgtgaggatcaacggtgcgtccccgggcgcctcgagcttggccctgaggcgccggatgtagacgcgaaggtactcagtctcggtctcgtaaccgcgaccccacaccgcacgcaacaacgccgcgtgcgacagcagccgaccgtcgccacggatgagttcggcgagcaacgcaaactcggttggcgtcaggtgcactggcacaccatctcgctcgacgagctgacgttcgagatcgaccacgagacccgggcgtaagacgatcgtgcccttgtcggactggctcgccgcgggtcgcgttcgccggagcgtcgccgtgatcctcgccatcagctcttcgatgccgaagggtttggtgaggtaatcgtcagcgcccgcgttcagtgccgtcaccttgtcctgctcgccacgccgtgctgacaccacgatgagtcccgcggaggtgcgctcgcgaatctcgtagcacagctcgaagctctcgacgccggggatcatgaggtcgagcaggatgatctccggccgccgtgcttcgagcgcagccaacgcttccgaccggtcggaagcggccgcgacctgatagccgcgcacgagaagattcgcacggatcaggtccacgatgttcggatcgtcctcgaccaccaggaccgacgtcatgagcgctccatcccgaggacggcgtcagccgctgcctcatcggcctctgggagctggacctcgaatcgcttgccgacgtctcgcggcacgagccgcaggacgccgccgtgggcggcaacgatgctcgatgagatcgcgaggccgaggccattgccagtgccttcgcgatgacgctgcgcgagctcctcgacgctcaccccggccgggagcggcgccccgtcatcctcgaccgcgatgaccaccccgccatcgtcgtcgcgtcgtgccgtcacacgcacgtgcgttccaggcggattgtgagacgcggcgttgtgaagcaggttcacgagcacctgctcgatacggtcgtggtcgacgaagacgggcgggacgtcgtcgaggtcgacgtccaccaccacctccggtacgcaggcaacggccgcctcgacgatgtaggcaacctccgcccagtctcgccgcaccctgagggtgcccgactcgatcgcggagaggtcgaggagatcaccgacgagacgggccagacgctgtgactcggcgacgatgcgttgcaagaatcggcgctcggactccgtgtcccaacgcacgtcttcggcaagcaggctggaagcgtaccccgtgatcgccgtcaggggcgtgcgcaactcgtgactgagccgctgcacgaaggcaacttgcagtgcctgcgatcgccgcaaggccgccgcctcgcgttcggcctgctccacgcgccggcgctccagggcgagccggacggaactcgcagccgcagataggagctctgcagcctcatcgggcggggcgtcgtccccaagcgtggcgaggagcgcagtcgactcggcgccgtcgagttcgatcacgcgcgcaagggtccccggcactcggtccagccgcgcctcgatcaacgccgcgccctcgacgagttcgagttcgaccgccccgagaccatccttcagcacggacagcgccgcgtccagcgccggttcgacacgcgcaccccccgccagcacctcgaggaagcgttgaagcacctcgagcacgtggttgcgctgctcaagggcgtggagcacgcgttcgcgctccaccgtcgtggcgatggtcgcggcatagagcgaggcgagctgtgcccgagtgcgatcgtgctcgagcggacgcccgacgatgacggccagtaccccgatcgctccgcgcggtccgagcatcggaacggcccagagcgagcgacgttctccgtcgagctcgagctctccgtcgcgagctgctccgacggtcagcgcctcggcgatcgggccatcagcgtcgacgatcgcctgctcgagtcgcgtctgcgcgagcggatcgaggccgtgagcgctcacgacacggagggcccccatcgactcgccgaggagcgccgcgaccggtacagcgccgagggcgacggaacacgctgccgtgatcgccgtgacgccggtaccctcgtcgatggcggccacctgctcgacgaggctcgcaaagcgagccagctgacgtcgtgaactctcctgggaggacccggcgacgatgagctccccgagttcttccggccccaccgtgccgccgtcgaccgtcgcgacgaccttgccatggtgcagcacgacgacacgatccgacgcactcgcgacgaggccgagatcatgcgacaccagcaagactccgacaccacgctcccgaatgcgcgcaacgagcgccatcacggccgcggcctcgagcgcaccgagcgaggccgtcggctcgtcgagaaggagatagtccggctccctcgcgacctggcgcgcaatggcgacgagccgccgctgtccaccggagagcgttcgcaggggtcgcgagagatcgtcgatggcgaggccgactctcgcaaggacctcgtgggcggctgcgtgcgtccgacgaggcgacaccaggcgacgaccttcgcgaccgagaacgaggttttcggcgatgctcaggctctcgacgagctcgacgtcttgccagaccacggcgacgtcacgatcacgaggctgaatcgaccctgcctggatcgccagctccccagcgatggccttgacgagcgtggtcttgcctgccccgttgtcgccgacgaggccgacgagctccccagggtggatcacgagcgagacgtcgtcgagcaccacgacggagccgtaacccacgcgcagaccacgcaggtccaatgctcgagcatcaccgtccaacgcggccgccaccaccggctcgagtttaggtgtcatcagcgcgtccgagagacttcgtaggctggtgccgtgccgcccacgatcgatcacctcgtcgccgaagcactgagcccgcacgccaaccggatcgcccccgtacccgtggcgctcgccctcgccacgggcgcagcccgcgcccacggcgtcgccgtgagcgctacggggatccttgcgaccgcagcgcgcctcgatggggcgctcatcggtcgcccagccctccgggaactcggcgcgcgcggccgagggatcgcgacgctgctggacgccgtcgacgatgcccttggcgaccgaggccttgcccgcagggagcgagtcatgcacgacctcgtcgccaggtcggcgccggcctcgatcgagaccacggtgccagacgacacgagccttggcgtcgggctcacgctgccgacactgctcacactggcactcgtcgtcgagttcgcgccaaaggctcgcctcgcggtcgacgtcgttgcatcgcccatcggcgatcgagtcgtcgcagagctggagcgtcgttcgcgccacgctggggcgtcgatcgacctccgacctgcgccactgccgctcgagatcgatgcccaccggctgccgacgcagctggacgaggcccgctggctcgcaacggccatcgagaacacctccatggccggtcgtcgcaccgaggtggtcgccgcaccaggtgatccacttgccgacctggtcatcgctgccctcggccggcgaggtcaggcggtcgtcgacgaacgaccggtcctccttcgcgacacagcactgtggcgactcgctcgcgatggcctcatcctcggcaccctggggagcctgcccggtgagcctcggagggagcgccgcctacgtcggatcgggcccccgccggcgaacctcggcgacctcgagacctggctcgacgaggcccgctggacgctcaatgcggaggatctgccaccggagggcgcagaagaggccgcggcggcgctgctcttcggagcagcgcgggcaacgcgcgccacggatccgacgagttccgcactggcggtgatggccgacctcggtcggataggcctggagcgcgaccgtcagcccgatgccgccgttcgcgtcaccgcgacgccgcaggacggcttcgagggccaccgattcatcgtgggcgccgacgccgaacgcttcccggtgcccatcagcgatgatccggtgctgccactggatcgggcggtgcgcctcgagctctcgctcggccctgaggccgctgccgtggccgcatggtaccgcggagccatgacgctcgtgggcgcgcgatgggtgacggtcacgatggcacacacggtcgaggctcagctcacccgaccgtcaccactgctcgatgacctcggcatcgagatcgccgaccgtcaccgacagacacgcccgccgggaccatgggcacgccgagctggcgtcatctcggcgctccgccgtcgcgcgactccgagcccctggacctgggacatcggtgcgcaccatctccctcgctcgctcagcgtcacgcagctcgaagaagctgcttcgtgcggcgcacgcttcgcgctctcgaccctgctccgcgtgagcgaaccagagcccgaagggcgacaggcctcgtcggcgaccatggggacccttgcccacgccctgctcgagcaggacgacctcgtcctcgatgcggaggcgttgttcgccgcactcaccgacctcgtccgttcgcacccgtcaccgcgggtgcgcacggaactcactcgagaccccctcggcgtgcatcgactccgagacctcgccagtcaccttgcgcgagtcctcgcaagcgaggacctccgccccatcggggaggtccaccgcgaaatcccgttcgaactcgagctctgcggaactcgactccgggcgcgcttcgaccgactggaacggcagggctccacgtggcgtgtcctcgactacaagctccgtgcctcgaggcccgagtcctggccgatcgcctcctccgatcgaccggtacagctgtgtgcctacgcgctgctcgcagccaaggggtcgagccctcgcctccctgaccggcagcccccgacgagcgtgacggcggcatgggtgctccttcgcgcgcgcgacgcgcacgtcatcgccccctccctgcctgatctcgccgtcatcgacgacgagatctgcacgctcatcgagcgactcgatcgcggccagctcgacctcgaccctggcggccgcggcgcaccgtgccgtctgtgcagacgccgcgcaacctgcggtgtcgcgtggcaaggcgagggccgctagtggaactcacccaagcgcaggatcgcgccgctcgccatcagggaccgcttgccgtcatcgccggtgccgggaccggcaagacactgaccatggtggagcgctatctgcgcctcgtcgccgatggggtcgagccctcggccatcgtcgcggtcacctttacccgtgcggccgcagccgagcttcgcgctcgcgtgcgcgcagcactgctcggcaacgatgcctcgctcggtgcctcggtcgacgccgcactcatcaccaccttcgacggcctcaaccatcacctcgtccgcgcctacccgtgggcgcacgacctcggcaccgacgtcgaggtcgccgaccccgagatcggcgcagcgacggcttccatcgaggccggcgcgctcctcgctgctgcactcggcaccacgacgctcccaagctcgctgacactggttcaggcactcgccgacgaggcccagcgacaaccagagcgcaccctcgccgccctgtccgtccccatggagccggcacgcgatgatcacgtccggcgagcgcgcgcattctggcgtgacgttgcgctgcgtctcggcactgcacttgctgcgtcgaacgccgcaaccgacgcccagcgtcgcttcctcacccaggcccagctcctcgcgaacgccatcgatgcatggctcgactcgccccacaccgacgcctcgggcctggtcgcagacgcgcggtcgatcgggctccgatctcgcggcgccggcatcgaccaggtgcgatccgtcatccaggagctgcgtgaagcactcgacgatccggctcgccgctggcaggcgctcggctggaccagagccgatgaactggtcaccgtacgtcaacctcagctcgccacgatcgccgcatcggtgatccgcgcgggcgacgagcgtcgccggcgggtcggtgaggccagcttcagtgccatcgagcgcgcggccctcgccgtcctcgaagattcgaccgctcgcgccgaactctcggatcgctggcacgctctgatcgtcgacgagttccaggacgtctccgagaaccagctccgactggtggagctcctcaccagcgtggtccaaggacgcgccgccgtggtcggtgatccgaagcaagccatctacgccttccgaggcgcgcggcccgaactcgcgacaagcttcgccgagcggtcggccgtgatcgagctcgaacagtcctttcgctctctgccacgcatcatcgacctcgccaatgattatgcccagcgagccctcggggcctccgagcgcctcaggccgacgcgaagcgcgccgtcgagcgatgggtccatcgccgtggtccaagtcgtcgggggcagggccgtcgaacgacgccgaggagcagctcgcgccgtcgcggctcgcatcaagcgcgacatcaccgatggcacgctccgtgctcgcgacatcgccgtcgtcgcacgtcgctgggccgacctcgacgactaccggcgtgagctcggctcggtcggcgtcgccgccatcgcgagcggtggcggcagccttctcgacacgaacgtcgggctcctcgtgtcatccatcctgcgctggctcgccgacccgagcgacgacgccgccgcgatcgccgtcgctcgagcagacgtcatagggtttcgagacgacgagctggttgcgtacgcccacgaacgcgacctgacccggccgtggtcgacgttcctcgaagcactcgacgatccacgctcacgacgtcttcggaccctgcgggacaacacgcgcggcgcgagtgcctcctgcgcgatcgtcgcagcgtgcgagctgctcgagatcgacgacgcgctcgccgagggcccggaccctgagcgaaccctcgccgatctgcacgccatggtcggcctcatcgcgcgcctggcgacgggtcgctcgctcggggaggtggtcgcgctgctcgaacgcttgcggactacgggagtctcactcccccgaccacccgtcgctggtgcggacgccatcacgctcaccacggtgcacggtgccaagggtctcgagtggcccatggtcgtcgccgtcggtctcgaagccgacccacacccggcgctgcccgaggggttggtgctccacccgaccctcggcgtcgcctggcgcgaccgggacgaacagaacccgtcctcacgcgcgctcgagatcggcgctcacctcgcccacgagcgcgagcaggaacaacgtcgcctcacctacgtcgcgctgacacgggcccgggacacggtcctcgtcgttctcgacggcgacgcggactccgcgctgcgcgagagcctgcacgcggtcgggacgaacgagtggacgaccatcgatgtgctcgccgacgaaccagatcgcgacggcgcagccgacggcgccgatgcagtgcccatgccgtcgtcgccgccccccgatagcggggccagcgaggccgacgagcccgcacccgtgccaccgccgaccgccccgccacggtcgatcgctggtctggccgctaccctcacctgcccatggctcgcacactggtgtggccccgagggggccgacgccctacgccatccgaccgacgggctggtgcgggtgcccgcagagagcgcggcactgtgcggggtggacccgacggtcccactggcccccgtcgttcgcgacgtgcacctcgggacgtggacggtgaccgcggtcgcgctcgccgtgaccgacgccgccgtgatcgtgcccgtacggagtgtgcgcgcagccgaaccagaagctcgtctggcggcggcactcagcgcacacgcccttgagcgacggagcgccgtgctgctcgcgctggacgaaggcgtcgcgacggcgatcgaagcggtcgccccagaggacgtcccggtcgcggcggcccctccctgtcggcgctgtcgctttcgacaccgttgcccgggatcgcgagtcacgttcgactcggttgtccacaccgcggtcgtcgacgaagcctaggctggtgacgtggcagcgatcgatgtggccggtttcgtcaccgacctgaaggaccacgcgctcgaccatggattccacgtccacgatgagcgccacttcgtcgagacctactccctcaggcagtggtgggaggtcgatctccatccagaggaggggtgcggacagcccgtcgacctccatctcgcgctcgacgtcgacccgcgcgtgttgctcgcgttcgaggacaccatggccaccttgcccgatgacgccgaaccgcccgacgacttccatttcccgctgaccttcacctggtcgctgccgccgcttccggtcgacaccgacatcttgcggctggccgtcgagctcgcaggcgtgaccggtccggcgctcccgctcgagatcgcggcaaccgacgtcgtctcctccccgaccgacgctccagaacgacggatcgtcatcacggcacgctgggccatctcactgtcgcgagtcgtcagcggcaaggagtcgctctgcgagctcttcgaccgatcgcgagaggtcagcctctacttgctcgagcactacacgcgctggcaagccgacgaccgctagccatccgccgaggtcgactgcagcgaaggacaggcatggagggttggacggacgcgagcgacgcatcgctcgccgttggcatcggtcgatggcacgaagcagcgctgcaggaggcgtaccgacgctacgcgtcgacggtctggggcatcgctcgacgcgtcacgcgcgacgcgatgatcgccgaggagatcactcaagaggtcttcctgaccctgtggcgcgaaccggaacgcttcgatccggcacgaggatccctgcgcacctggctcgcaacccttgcacaccgacgggccgtcgacgccgtccgccacgacgcagccctcaggcgacgcgaggaccgcgaccatcaactcacgaggccgccgacgaccgccgagatcgaggtggtgatggatcgcgtcatcgttgccgacgcactggcctctctctccgagcaagaacgtcgcgccatcgaactcgcctacttcgacggcctcacctaccgcgaggtcgcagcgcgcctcgaagaacccgaaggaacggtgaagtccagaattcgaggagcgctgacgaagctgcatcggcagatggtctcgacgagaactccggaggcatgatggagcacgaggaagccgcatcactgcttggcgcctgggcgctcgacgctctcgaccccgacgaggccaaggccctggaggcgcacctcgcggtctgcacgcagtgtgcgctcgaagccgacgaactcagggctgcagctggcctgctcgcgaccaccacgaccgagcccgccccggatctgtgggactccatcgccggacatctcggccaatcgccagccgaacctcgccaaccaaccgtccacgcacctcgacgcccgagggcggggcaccgacgcggtcgcatcgccaccgtcgtcgcgggcctcgcactcgccgttgccggcgcgggcatcgggggcgtcgtggccctggcacacgaggtccacacattgaaccagcacgcagccagcctcggcacggcggcctccaccatcgccgcgacccccggcaccaccgtgatcgatctcacagactcgcacgacatcccgaccgccacgctcgcgctcactccgtcggggaccgcggtcctcaccgccgtacggctaccggcactcagtcgttcgaagacctaccaggtgtgggccatcacgacccaaggcgtgatctccatcgggctcctcggcgcaaatccgacggtcacggtcctgcacgcgccgacgcgtggcctgcacgcggtcgcgatcaccgcagaaccggcgagcggcagccctacgccgacgagcgctcctctcgcggaggcgcgccttacctaactctcgtgcacggcgcgcaccgagcgcgacggcactcccaggcggccaagtcagggcctgcgcgctcaacagcgcgcccgtcccaccatggtacgtcccagggagctaggcgagcgtactccgcgaccgttcgcccgggaaccgcatcgccacgacggaaccgtctcgctccaccacgagcactcgaacaccgcgggcagcttgcgccgccgactcgctgagtcctcggaatcgaacgttcgacccgagagcagccgtgaacgtgactccgtccggttcgacgacggtcacggacgaggtcgtgagcgactgcagggtcccgcgcacccacgaccaggtcacgacgcccgagggccgatcgacctcgaaggatccggagaaaccacggaaccagcgatggtgtccatgatggcccaggtgggacgtcgcggcggtggtctgcgtcacgaccggcgtgagcgccgagctcacagcggcgccgcccccacgcagctcgaccatcccggctgcaagggctcccacggagatcgcggcggcagccccgagcacgagatattgcttcttcataccagggagcctacggcacccgaagccacccgagcccgccaggtctgtcagggaactgtgagggttgctgccccgccgtggtccctcgacaccgacgactcgacgccgacagctgccgcgtggctctgcgtcatgggctgcggcgtgggctcgaggtcccgctcgggtgccccacagcgccgagccacccgcgcgccgcgatgggcacgtcggtgatgattgccgtcgggtggaccgacagggcacgcgagaacgcctcctcgtcgttcaccgtccagacgccgacgtcccagctcgccacggcgggcggccgccaaccctcacgcagcaggtcgaccccgacgaggagccaccggagaccgagctcctcgagatcgcgcagcgtcgactccgccggtgcctcctcgacgatgagtcccgcccgcgccccagaggcgagacacgctcgcaccgcgcgctcgtcgaacgacgagatcagggcgtcgcgttcgcgaaccaactccaccagccgcaccgaggcctcgacggccgcacgcacgcccgtctctggcagcagcttcaactcgatgtcgagcatcgacgaccccacgacctcgagcacgtcctcgagggtcgggagtcgacgaagcgacgtgctgggggcgcgctggatcgtgacgccgtcgacgtcaggatcgtgatggaggacgaaggcaccgtccgtcgtcggccagacgtcgatctcgatgccgtccgcacctcccctgagcgctgcctcgacagcgcccaccgtgttctccgtgagcgccgagccgtcgagacggccacggtgcgaccacagcgcgaccgcggctgcgtgctgcgctacgcccatgggacccgcacacctcggaacctgcgaacgaggcgtcgcagatgacgacgaccacgccgcaggctccagcacccttgcgcccctgcgacccggagcgtccggacgaggtgccggtgggggaaggccgtcacctcgcccggacgctccgcccgcagcccccaaggggtcgtcgcgtcacgccgaaccctcgctgagcgcggaccccgtcgagaccgaccatcctggtcgcgaacgtccatgaccagcaccctacggatgcgacgtgaacagccggcgaaggcgcagcatcaatcaggcgtctggttggtgaacgctgcgccgacgactcctgtccgagccgcacgcagcgcggccaccacacgctccggtgtcgtcggcatggcgatgtcgcgcacgccgagcggtcggagcgcgtcgaggaccgcgttccacaccgccggcgtcgctccgatcgttcccgactcaccgattccctttgctcccagcggattgaccggggtcggcgtctcctcgtgcacgacccggaaactcggcagctccggagccgagatcatctcgtagctcgccagcgtgccggtgagcggcgcaccatcgggcgcgtagacgaactcctcgagcaccgcttgggcgatcccctgcgcgagcccaccgtggacctgaccctcggcgagcaacggattgaggatacgtcccgcgtcgtcgaccgcgacgtagtcgacgacctcgacggcaccggtgtcgaggtccacctcgaccacgcacgcatgcgccccgaacgggaaggtcggccccggcggctcgaagtccaccgtcgctgcaagctggataccgcgcgcccgtgcctcggtcgcgagcgtggcccacgacaccaccgaactcgggaccccgacaacaccgataccggactcgccgaccacgagatcctcgggtgcggcttcgagcatcgtgctcgcgagctcacgcgcagcggccgcaacctcgaccgacgcgaggtgcacggcgacaccacccgtctggaccgaacgagaaccaaaggtccccacgccccgtggcacggcgtcggtgtcaccggtcaccacccggatccgatcgaggggcataccgagctgctcggcggcgatcatcgcccacgtcgtgtggtgaccttgcccgtgcggcgaggtacctgaccacaccgtgagcgtgccatcgtcggccacctccacgcgtgcgtactcggacgatgtgtagccgttcgtgatctcgacgtaactcgacaacccgatgccgagcagacggcgagcgccccgctcgaggcgccgagcctgctcggctcgcaacgtgtcgtagccaaccgcctcgagcgcacgctccagcgcgagccgatagcgaccggagtcgtacctggcaccggtacgcgtctcgtacgggaaggcatcgtcggcgatcagattgcgccgccgaagctccgccgggtcgatgtcgagctcgtgggcgagcaggtcgaccgcgtgctcgatggctgccgccgcctccggtcggcccgcgccccggtacgcggagatcggcacggtattggtgaggacggatcggtaggccacgcgcacccgcgggatctcgtaggtaccctgggccatgagggtggtgagccgcgggagcatcggaccgaggaggggccaggcccccacgtcctggaggacgtcgacggagagcgcgacgatggcgccgtcacgacgagcaccgatggccacctgctggacttgtccccggccgtgcgcgagcccgagcatcgaggcactgcgcgtctcgatccaccgaatcggacgcccgagtcgaagcgccgcagcgcacaccgcgagatcctccgggtagaccgcagccttggccccgaagccgccgccgacgtcgcccgcacgcaccaccaccgcgccatcggcgagcccgagcacgcgcacgatctccgctttgagtcggtgggccgattgggtcgatgcgaagatctcgaggcgcccgtcggccgtcggcacggcagccagggctcgggcctccatcggcgctggggccaagcgctggttcaccaaccgtgcgcgcacgacgacgtcggcgtcggcgaagaagtcctccggttctggctccccaccctcggacaccaggttcgacccctcgtgcacgagctggaggtcctcgagtgctcgctctggatcgatcacgggatcggtctccaccaggtcgagatcgaccagttcggcggcgtcctctgcgacctggggcgaggttgcgagcacgagagcgatcggctccccgacgtaacggacgcgaccacgcgcgaggagaggtcgcgcgaggtcgccacggccgcgcagcggacttggcatctcgagctccccgaggtcatcggccgtgacgatcgcgacgacaccatcgagcgccatggcctccgacacgtcgatccctgcgatggtcgcactggcgaccggcgatgtcacgaaccacgccgcgagcgagccatccaagggcacgttggcgacgtaggagccctgacctcgcaggaggtgttcgtcctcaacccgacgcacgtcgtttccgagaatgctcacccgacctcctctcctgacgacgcacgtgagcaaggacctgccaaaagccatccgttgcgccttcgggcgtgcgacgtcgtgctccagcgcccaccgggccgcgatcgcacgtgcgctccgcttgggacagctgcgaccttagccgaactcgggcgcgctgagctctcgggcccgtgcgccgggacggggagcgagctggtgacgccgactaggtcgacgacgaggaatcatcgtcggagccgtaggtgccctcgggcatcgggccagccgccgcgggatctgacgccgacgacgcctcgggagccgaactcccggcctgcgcagacggtgtgcccgggctccccccgaccccgcctgggatccaactgccgctactgcccggcggcggtgttgccggcgtcacgacgacgctgacacccttggcctcgaggtcgccgagctcgtccatgatggccgcgacgcgtgccgagtccgcagcagtcgcccgatgctggtggtcggcccagacgagccctccgagctcgagcaagagcgcatcggcttgcttcttcgcctgatattggtcgagtcgcgccgtcgccgaaccgtaaccctgctgcgcttgatcggcaagcaccgctgcctgctgcttcagtcgctcgaccgtttcaccaagtccactcaaacgatccttgaaccccatcgggccctctcccttccccgagtgccttcgccacccctagcgcccgagcatgtcgccgaggatccccccgagggaaccgcctgcaacgccaccggcgacgccaccagcgaccgcatccgaggcgccaaggtagggcccgagcgcctgggcgagcaccgccagcggcatcgactggagccagacctggccgggcccgacgagctgcaccagccaatgaccatcaccacccgcccagcgattgacgatccccggtacccgtgtcacctggaactgaaccgtctcagcgaacgcgccaacgtggccagggtgaaccagcagctgttggccctcggcgagctgatagttgaccatctcgcccccgagttcgatccatgccgtaccatgtccttcgagccgctggaggatgaacccctccttcccgaagagcgccccaccgagcgactgctggaaggccatggaagcgacgacatcgcccgtcccacagacccagccatcgcgatgcacgaggtaggcctgcccctgcgcgatctcgagcggaacgatgtgaccggggagcttggcaccgaaggcgacgaatcccggtccgcccgtggcctcgaagtgcgtgagcagcagactccccccgccagcgacgcgcttcaacgcgcccatcaagccgccccctgcagctccggtcgtctgggtcatgcgcacgttggccgacatccacgacagctcgccgcgatcgctcacgagatggtccccgggatcgaggacgatctcgagcaccggcatcgtcgaacccttgatggatgcctgcacgcctgcctccttccgccacgccgtcgccaagcgtaccacaggccgcctcgcagatcccgggaccggcccacgaggtcacacgtggcgacggctcgtcgaggttgcggacgtcgacctgtgcggcggcgcgggatcgaccggtcgatacagcggcgagctcggcagcacctggaccgcgaccgtgccccgcgggaccatcccgtcctcttgctcagcgaggtgctcctgataggcgaccgtgccgacgacagcgatctcgtgggtgaggcgcgcgttgtcggctcgaaccgtggcgagctgggctctgagtgcctgttcgctcgcgtggagatcgaggatggtcccggtgggcaggacccaggctccgtaggccagggcgagacctgcagtcagcgtgccgacgagtatgcgccgacggcccttcggcgtcatcgttgggcccgagtccagtcgacgtagcgcgcacccggaccgagctcgcgctcgatcgcgagcagacggttgtacttggcggcgcgttctgagcgagcgggcgcaccggtcttgatctggcccgtaccgaggccaaccgcgaggtcggcgatggtcgtgtcctcggtctcgccggagcggtgcgagatcacgctccgatacccacttcgcgtcgccaggtccaccacatcgagggtctcggtgagcgtgccgatctggttgagcttgatgaggatcgcgttggcgacaccacgctcgatccccttgccgagcagcccagggttcgtgacgaagatgtcatcaccgaccagttggacccgcgaagcgagccgctcggtcaagatcgaccaaccgtcccagtcctcttccgccatggcgtcctcgagcgagacgatcgggaactggtccaccaggcgcgccatgtactcgacgaggccgtcggcctcgagctcgaggccctggccgaccatcacgtaacgaccctcgcgccagaactcgctcgcggcagcgtcgaggccgagcgagcagtcacgtccgggtacgagacccgacgcctcgatcgcagcgaccatgagctcgagcgcctcctcgtggctcccgaggtctggggcgaacccaccctcgtcaccgaccgcgaccgagtggcccttcgccagcagctcgctgcgcagtcgatggtagatctccacgccccatcgcagcgcctcgccaaaggtcgccgcaccgtgtgggatgatgagaaactcctggatatcgaggttgttggaggcgtggacgcctccgttgatcacgttgagcatgggcaccggcaaccggtgcgcacccaccccaccgaggtagcgatacagcggcacgtcgagcgctcctgcggccgcccttgccgtcgcgagcgacaccgcgagcatcgcgttcgctccgattcggtgcttgtcgtcagtaccgtccgcgacgatcatggcttcgtcgatgagccgctgctccgtcgcgtccatacccacgaccattgtcgcgagctcaccaccgacggccgcgatcgcaccactgacacccttgccgttccactcggttccaccgtcgcgccgttccaccgcctcgtgcgttcccgtcgacgcaccagacggcacgattgcttctccgacggccccgccttcgagcacgacccgggcgccgacggttggattggccctcgaatccaacgcgagaaacccctcgacgctcctgatctgcgtccgtgtcccagccgccatggtgccgcctcctctctgcgggccgatgctagctcgttccgtcgccattccctgggcgccccgcatcgacgtcgacctcgccgagcgcgcgctcgaggcgacgagccgcatctcggagcgcctcatcgacgtcgacacccgagagagcggcctcgacgagcacgcccgcgaggtcatcgccccgtcccaacgaggccgcgcgcacgtcacgcgcccgggcgcgccgagccagcttggcgaggcggagcgacgccgggagccccacgggaaccggccgagacccaggctgctccgcggccttgatcgcctcccatcgctgctccacctcgccggcactgcgggcgaccgcgtcaccgaagacgtgagggtggcgtcggatgagcttgtcggtgagggcgcgagcgatcgcgatcagatcgaaactgccgtcctcgtcggcgatggtggcgtgcatgagcacctgcagcaagacatcgccgagttcctcgacgacgtggtcgcgatcgtgtccatcggcctcgtaggcatcgagcgcgtcgaccgcctcgtaggcctcctcgatgagatgacgtgccaacgaccggtgcgtctgggacgcatcccatggacatgccgaacgcaacgtgctcaccacctcgccaaggcgtcccaacgcgaccgacggtggctcgaagtcggtgagcacgacgctgctcaggtgatcgaccgcggcgagcctctcatccccggagtcgacctcggcgacgacctcatcatcgagaccgaggtggtgcgcgaggaccgcccgcgccccgctgcgctccgcgaggacgaccaggtcgcgtgccagcggctcatgccagacctgcagtgcgacgaccgtaccgctcgcgatccaggggttggcgtggagcgcttcggcgtcgaccacgctcaatccctcgaggggatcgacaccgaaacgttcgatgatcagctcgagcactccgcgtccagccagaatctcgacgtcgatgtcgtcggcccgacgcagcaacaccaccgtgcgttcggccacctgtggcgaacccgggaccacgtagcccacagggccacccgtctcgaacgcgaggtcccgcagacgctccacgatgcgctcgtagcactcctcgaaagtcgtggacgccgcgtagagatcgtcgcacgtcaggatcggagcgtccagtgtcccgagcgcctcggcgagtcccgggtgctccagggacctcgcaaccaccgccacgcacccctcgagggcatctccgagcgccgctgcctccgcgcggccagcaccacacccaacgacccgaacgatcggtttcacaccctctcaccctacctacccagaggagctgcaagaggccctcaagaaccagcactctccgtgccgattccacatttagtgacctatcgccccatctcgcttcccggattgaccaccagtcaccactggatgtggcgcatcatcgccgcgtccgtcgcaggaacctccggcgtcggcgcgacctctctcgcgctgcacgcccttaccggctcgacgacctcgtcacgtgccgcggccatcgttcgccacgatgcgcgagtcggccgtgccccggagccgatgccgacgccgcagcgccctcggagctcatcgccatcgcatccagcaccaccgaccccggctccacaggctccgtcgacgccctcacccaccagcgcgacgagcccaccagcgtcggccgcaccaccagcgacgccgccggcgaacccacccgtcgtcgcctcgtcgacgccaccgccggcttcggcgctcgcggacccaccggccaacatcgccccgaccccgaactttgcctcgatctgcgcctcgagcatcagcgctggccctgacggcccaacctgcgagagcgccgccgtcgaggcgatcgacgccgcccgcgcccaggaagggctcggtccactcaccctccctcccaacttcaccgatctcagcccgacgacgcagctgctgtggctgatcaacgaggagcgcaccgcgcgcggcctggccccggcggctggtgtcgtcgacaccctctcggcactcgccgaggacggtgccgcctcgaacagcgatccgcccctcgggtcgctcacgactgggggaccctgggcggtctccgcagaggccaattgggccgcggactactccacggcagcatccatgtacgactggatgtacgacgacggctggggtgggtcctcggccgcgacgacgaacgagacctgcacgtcgccgaccgcagcaggctgctgggagcaccgagccaacatcctcgcgaccgcccccgcgggctacgtgccggtgctcgggctcgccagccaacccgagccatcagggacgtcgctgtcggggctcgagtcggacgcgatggtcctcaccttcgtgcccacgagcgcgctcagctcactctcgttcgtcacgacctggccatagcaccgtgccgtggcggaagagcagcgtggcgagcccgacgccgcgagacccgtcagccaacccgttcgggcgtcacgatctggcgtgcgagcgccgcacccttcggcacggtgggcaccacgctgagcactcccttctggaccacgatccgaccaagggcccgattcacgtggatgttggccgtgtgaacggtgcgcgccaggtagtcgttgaggagcgtctgaccgtgactcaccatggtgtcggccgcgaggagctcggcctgcgagaacggtatctcgctgcgagaggtgatctcgaacacagcaaacccgttgggcacctgtacgacccctgatggcgtacccacaggaaggctcgtcaccgaggtcgcaacccctgatccgaagctggatgcgtactggccctcggtcccgcagccgagcgcgccaccgccagcggcgttctgggtcgacgacgacttcgccacggcagcgaacgactgacccttgtgcagcttcgcaaccaccgcttcggcttccgtaggcgtaccgaccaggatctccgatccgcagtagctctcgaaatcagccgggtgcgcgcggtagtacgcctggacgccactcgtggtcaagctcacgtggccgagcgccgcctcgagctcgacgatgtcgacgctgtcgcggatgaggcgttgctgataggagcgcggaaagccactgaagacggtttgaccgccagcggactgctccgccagggccgtgccaaggctcgttgcgacagcgctcggctggacgtgcatccgcccgagcgctgcctggacccgcatgatcgtgatccgtcgagagaggatgttgtccacgaagagcgcggtgtagctctggtcatggggaccccacaccggctcgtggctcgcgacgagttcgctcacgaacgccttgttcgcagcgacgtccgcgagctccgcttcgagctgcgacgtcgtcagcgtacggttcccgaccgtcgccgcgacgctcgcggaaccacagctcgcgagcaccacggccccggcgagtgggatgagtccgaaccagcgacgatgcacacctacctccaggagcccacggccatgctactggggagaacctactccaggcgatggcgcgccttcgaggatctccagcagtgcctcgagacgtccaagcgcgtcctcccggcgcgcaaggggaaccgcaaggtcgtcgccacgactcacgacgccatggagccgacgctctagacgcagccgggtcgccaccgacggctggagcggaccgacgacgagctcgagtcgtgcgctgcgtgggttgcgccgaacgagcgcatgatcggcaccgagggtcgcaagccgacgccgtgccttcgcgagggacaccaaggcgagcgcttcggccggcggcggcccgaagcgatcgcgcagctcttcaaggaactgatcgaactccgcctggctccgcgccctcgcgagacgccggtagaggtccatccgagtctcggcttcggcaacgtagtcctcggcgagcagcgccgataccggcacgtcgagcgccacctcccgatcgggcgtcggctcctcgacgccgtccatgcgcgccacctcttccgcgacgagccgcacgtacagctcgtagccgacctcgctgacgtgtcccgactgtcgcatgccgagcaccgtgcccgccccgcgaagttcgagatctcgcatcgcgatccggtaacccgccccgaggtcggtgttctctgccaccgtccgcagtcgctcgagggcgatgtcggagatcccgccggtggtcgaggtgagcaggtaggcatacgcctgccgcccggagcgcccgacgcgcccgcgaagctggtggagctgggcgaggccgagctgctcggcacggtcgacgatcagggtgttcgcacgcgcgaggtcgatcccgttctcgacgatcgtggtggcgacgagcacgtcggcctctccgtgccagaactgggccatcgtccgctcgagcgcagcgggcggtagttgcccgtgcgccacgagcaccctggcctcggggacgaggtcggcgaccagacgggccgaggcctcgatgtcgcgcacgcggttgtgcacgaagaacacttgaccttcgcgtaggagttcccgacggatggcctcggtcacgaccgcgggatcgaagggcccgacgtgcgtgaggatcggatggcgatcgacgggcgcggtccgcagcacggacagatccctgatgcccacgagcgacagttcgaggctgcgcgggatcggggtggccgagagcacgagcacgtcgacgccggggaacgcctccttgagctgctccttgtgtcggaccccgaagcgctgctcctcgtcgatcacgaggagcccgagcctggcgaaccgagtcgacgcgccgagcgcagcgtgcgtcgcgatgcacacgtcgagctcgccacttgcgagctcggcgcggatgctcgcagcctcacgagccgtgctgaggcgcgagagcatgcccacgcgaatcggcgtgccctcgaagcgctcccggaacacctccgcatgctgggcagcgagcagggtcgtcggcgcgaggacgagcacctgacggccctcggatgccacggcgaacgcggcgcgcagcgcgatctcggtcttcccgaagcccacgtcgccacagacgaggcgatccatcggcaccggcttggcgagatcagcgagcacctcggcaatggtgcgctcctgatcacgcgtgagctcataggggaaccgttcggcgaactccgagagcagcaccgggtccggcgtgatgctcgaaccggtcgcggccaagcgacgctgatagagcaccaccagctcctgggcgacctcctgcgccgcgcgacgagcacgatggacctgacgctgccagtctccgcctcgcagacgggtgaggcgaggctcctcggagccgacgtagggggcaacgagcgcgagatgctcgaacggaaggaagatccgatccgcgctcgcgaactcgagctcgaggtactcccgcgagacgccatcgaccacctggcgcacgaggccccgatagcgcgcgacgccgtaggcctcgtggacgacgaagctgccctcgacgaggtcgtcgaagctcagacccccggtcgtacgggtgggcaccgaagcgcgaggagccgtcggccgtacgagactcgcatccgcgatcaccaccaacgatgccggctcgagctcgacgctctcgacgaggtcgagccccgcggccactcgaacgccgtgaccctcgaggcaggtggcgaccgaggccagctgcacgtcgatgccctcctcgccaaggcgttgggcgacatgacgtgcacgttccgagccatgcgtggcgacgacgacgtgaactccgtcgcgccgcgcactccgaatgcgaccgaacacccctgcgaggtcgcgatggctcacaccgaggcgagcaccaaagccggctggatctgccgatacgaggcgggcgcgcactgcgcgcagccgttccggctcggccatgagactgaccgacccgagcgcgtcagcctcgagtccccaggtcggagcgagcgcctcccgaatggagcgctcctcagcgacgaggcgatcggcgatgaccgcgtccatacccttcgccgggacgagaacgaggtcggcctcgtcgacgatgtcgaggaccgtcggtgcgacatcgccgagcacgagtggcacgagcggctcagggggctctcgacccgcgagcacggcctccacccgatcggccaccgctggaacgcgtgcagccagggcctcgagttgcttggcgaggtcggtgtcgatccgaacttcgcgagccgggaagagctcgacgcgctcgaggtcgccgaccgagcgctgcgtcgtcggatcgaagaaagcgagccgatccacctcgtctccgaacaggtcgatccgcaccggcgacgccaagcccgggtcggcgacgtcgacgatcgatccgcgcaccgcgtactcacccgcggccgagacctgaggctcacgcacgtagccagcgtcctcgagccaagtgatgagctcgtcacggacgagctcatcacctcgcgccacgatcagacgctccaggcgcgccgcggaggcgacgagcttcgtcaaggcggctcgcacggtcgtgaccacgacgatgccctcgtcaggcggatcgacgatggacgcgagcgctcgcagacgcgctgcggtcgtgcccatgctcggaaccacgcgctcgaacggcaaggtatcccacggtggcaacagcgcgacagggatccgaggcagccaccaccgcagatcgttggcgatggcctcggcttctcgatcaccctcggccacgacgaccatccgtcgcggagcgagtcggtgccaggcgagggcgacgccagccgcgctcagggccggcggatcttccaccgtcgccgcgagctcttcgacgagcgcggcgagcggcgcctcatgcggatcgatcgacgccacgggcgttgtaggtggtcatggcgcgctccggaccaagcgacacgagatcgacgacggcatcggcaccccgctcgacaccgacgtcgaaggaggtccgctccgggccgcgtacctcggtgaggacccaatcgacgacggcctgacggccggccgggcgtccgatgccaatacgcacgcgccagaagtctcgcgtgccgatgtgggcgacgatggagcgcaggccgttgtggccagcgagcccgcccccgtacttgagctgtacgcgaccgagcacgagatcgagctcgtcgtgaaccacgaccagctgcgtcacagggtcagcgtggaagtagcgcagcaccgccccaacggcggcacctgagtcattcatgtaggtctggggcactgcgagcaccgctcggtgatcgccaagtcgcccactgccgacgatcgagcggtgacccggcgtcaacctcacgtcgaggcgtcgagcgagcagatcgacggtcagcgcgcctgcgttgtggcgagtgaagcggtaacgagcgccagggttcccgagaccaacgacgatgatcggctcagcgggtgctggaggcgtgagctcaggcctcctcgaccgtcgccaccaccgtctccggcgcctccacgaggctcaccccagccggaagtgggagtgcccccgccgtcacggagccatcggcgagcaggtcggcgccgacgtgaatcgacgacggcaccgatgtcggggtgccggacaccgccacgagacccacgaccagccgtactccctcgcccgcctcgagcgggacctgcacctcgaccgtctccgacgcaccgaccgcaagaaaatcgaggtgagagagttcccgtcggacggggtgtcgaacgacagcctggagcttgaccgttcggacctcaccgtcgatctcgatgtcgagcagttggccgacgaccgcgtgctgaccgagcgccgtgaggaagccatgccggtccagcgtgaccgcaactggctcagtgagcccggccccgtagacgatcccgggtaccttgcccgctcgacgcagacgacgtgccgcggccgagccacgagcatcgcgtcgctcggcgaccaccttcaccatcgagacctctcctctgtgccgggcgcacggcgcctccgcgcgcgagggagcagcctaccgccccagtcgggacctcgatgcggctaggagaggttctccccctggaacagctccgacaccgacccatcctcgaagacggcggcgatcgcgtcggcgatgaccttcgcgatcgagaccacctcgagcttggcgatggctcgttcgggtggaaccggcagggtgttcgtgaccacgacgcgcgagatgggcgcgtccatgagccgcttgggcgcggggcccgagagcacggcgtgggtcgccataacccagatctcatcagctccgcgcgagcgaagcagttccgccgcggccgtgaccgtgcccgctgtgtcgatcagatcgtccacgatcacgcagtgacgacccgccacgtcgcccacgacctcgagggccgtcacgacgttggccgttcccttggggcggctcttgtggaccaacgccagtccagcgccgaggcgctgtgcaaaccgctcggcaaccttcacacgaccggcatcgggagcgacgatgaccgcgtcacgaggagcgaacgcacggaggtactccaccagcacctgactggccgtgagatgatcgaccggcccatcgaagaagccctgaatctgacccgaatgcaggtcgacggcgatgatgcgatcggctcccgctgcgtgcagcatgtcggcgaccaacttggcggtgatcggctcgcgacccgatgccttgcggtcctggcgcgagtatccgtagtacgggcagaccgcagtgatgcgcttcgccgaggcacgcttcgcagcgtccaccatgatgagctgctcgaagattgcgtcgttgacaggcccagcgtggctttggatgacgaagatgtccttgcctcggacggactggtcgaatcgggagtagatctcgccatcggaaaactcccgcagcgtgatcgcgcccaactcgacgtcgaggtgctcggcgacctcccgggcaagctgcggatgcgaacgtcccgagaacagggcgagtcgcttgcgggggacgagctccatgcctcacctttcgtggcgcgtcgacgccgcaccatcctaggctccgcgtcacggcgacgtaccgccccctgtggctgtcgcagagacgcccgaacgctcgacggctacgaacggtgggagagcgcgcgtcgatgacccgggctgcgtgggcccgatggctcgacggtgcagtcgatcgctcagaacatgccgaaccgaacgctcctcgcgctggtgttcgtcgggccctctcgctcacctcggtcgatgcgttgctgacacgggcgagttcttgagggtccgctcgttcgggccgaggtcgcggacaacgtcagcaagggcgcggtggttggtctcgttcatccccttcctcctgcacctggagcaggtgtcaaccgggaagggcacggccatccctctgcagctgtcgacgccgttcgaaaactgaacgatttcgccggtgaaaagtgaacacccgagcatggaggggtgatcactgtggaagactgggcactcatcaggcggctggtggccgagggcgtccccaaggctcgcatcgccaagcggctcgaggtctccgatcgacagcgtgcccggtcgcgagccagccaagcgccacgcatcctcatcaccacagccagagtcagaaggtctccgcgccccaggtcatcgacgcctccggggcccaggcgggaggcgtgagcacatcgagtctcgcatcgatggtggcctcggttgcggagcgacagccaccgacaccagcgcatctggccacagcccctcagggaagcccctccatgatcgtcgggacgcatgcgatcgtggtcgcacggtgcgcgagacgagacgctccgttgggggtagcaatggtttgttcccgaggcagtcgatcgccgacttcccacccacggtgcgcagctcgaggaatggggactctgcggcgcggcaccagtggcaaccccgatgctcaacgccgccatgggagccgcggcagctcacggggtccggccgcgatgagtgcgacgaggtcagactcggcgacagggtaaccaccccatgcatcgacgccgacgttgatcatcctcccgtgctgtcgccacttctcatggacatgaccgtgcaggagccaggcccctcgatccttcggacgcaacgctgggaagcgttccacctcttgactatcgccttcgtatgggaagtgggatacgaccacctccacatgcccaagctgcagcgcaagctcgccatcgaggaccgtcaagcctgcagcctcgtagctacgacgccaccgatcgacctggttcttctgcttccttcgcaagccctcccagcacttgtcatggttccctggaacgagaaacttcgtgccattgaagagctcgaccaactcaagcatctccgctactggacccatggcgaggtcgccgaggatgtagacctcgtccgcaggatcaacgcgctcgttccagcgctcgatgaggtcgacattcatcgtctcggtatcgccataggggcgctgtgtatgagcgaggattcccgcatgaccgaggtgcagatctgaggtccaccaccgccgactcatcgatctgagtgtacttcgaggggtgggcacgacgatgatctgccacaggcggcgtcaggaccctggcacttcacgaccacggcacttcacgaccacggcacttcacgaccacggcagagaggccgttcggcattctccctctccagtcttgcgtccttgacgacctctgaccattgcgatccaggtcgccgcctgctcgcggaccaagcgtcacgtcagactccggagcggtcccggacgagcaacctgcagctcgccgtcgaaacccttctaccagctcctcgaggatgcgcgttcgtcgcaggacagcagcgacaagcgatgaccgacggtcccagcgcctgcgggttcaacgacgagaccatccgtacgggtcgacgggcgcgtcgaacgctcccgcctcggcggtcgactgacgtcgggcaccgagcacccgctcaccgccggggccagtcgaccacagctcacgatggaatcttggacgtgcgaacggtcacctagggcaggcgcgcgaacggcggaaccgtacccttcggttcgacgaccgctccagtctcgagcacgctgaaggggcccacggtggcccactctccaatcgtcgcacagcacgcatccaccgcccggagctgggcgccctggcccaccacggtgtcgacgagacgagaatgagcgccgatgagggcattggcctcgatccgtgtcgctccgagcaaggcgacctgcggttcgatgaccacgccctcggccacgcgcacgcgggcgtcgacggtcacggtggaggggtgctgaatctggacaccctcgtgcaggagacgacgtacgatgcgcgcccgcatgcgctcggcgacgtcggcgagctgcagccgatcgttgacgccgagcgcttcggtcgggtcatccaacacgagcgtcccgacccgatagcccgactcggcgagcagggcgatcgagtcggtcaggtagtactcccgctggcgattggtcggcgcgaggagccgcaacgccgaggggagcacagcgagatcgaagacgtagacgcccgtgttgacttcgcgggtggcctcgccccgatcatcgtcgaggtcggcctgctcgacgatggcgcgcaccttcccgtctcgggcccgcaggattcggccatagcccgatggatcgtcgagctccatcgtcaacaccgtcgccgcgttgccttgggctgcgtgggttgcgagcaaggccctcagcgacgtcgccgtcagcagcggcgcgtcggacggcacgaccaccacctcggcaccgctggagccgacaccaggcaggagatccggcaaacgggtgagcgcgacccgaaccgcgtcaccggtcccgcgttggtcgaactgataggccgtcacgacctcgacgccgctcggagcatgtcgctgcacctctgcctcgacggcctcggcctcgtgaccgacgaccacgacgatgcgcgacagatcatcaaggtcgcccagcgcagcgagcacgtggccgaccatgctgagaccgcacacctcgacgagcggcttcgggcggtccgaccgcatgcgagtccccttgccggcggcgagcacaacgccgtagcgcatagcgcaacctcctcgtcgcaaggctagcttcgggcagtccgcaccacgtaggtcgtcaccgaatcgggcgtgagcagcgccaccacgctgtgcgcgtcgacgtccggcagcgccgtcggctggagcgacttggtcggattcgtcaccaccgcgcccatggcctggaccccgtcaagtcccgggggaagctgcacctcgagaggcaagggggctgagccaggggcggtcaagttgatggcgatcagtacgagacgcccaggtgcacgccccgcgagcatctccacccgcgcatccgacgtcgtcaccggcacgagacccatgcccggacggaggtagcgagagaactgtcccagcacgtcgtagcgcttggtcaggtagagcgtgtggtcgccgtcgcgtgcaccgttcaggtcgaagtagatgagtccgtcgttgcgcccgagtgggttgatgtctcgaaagcacccagggtcggccgcaggactgcagccgagatccggtgagagtgccagccaccagtcgaacaccgaggcgttctcgaccatgaggtcgttgtagatcgtctgggcgagccagaggcccgacgtcatggttgggtcgtactggtagccgaacccctccccgtcatagcagcagatctccgtgtcccagatcggcacgccccatcgacgtccgagcaacgcgacctggtggagcaccgcccgcgaggggtagtcgtagccatggaccgcgagggcggcgagcgaggcacgcacgcccggatacgtcagccaccgtggcgcctgccggagcagttgcgtggcgtaggaggactcgtcggcgatcacgcgcgcccacggcgcaacacgcgccagatcgcgcgcgaggtccacgacgagcggaccacgctctgccaccggaacagccattccctcttggcgacaggccgcttgcgaacccaccggctcgttcatgggcgacacgtagcgcagcttgacgtggtcgacgcgccacagacccgccacggtcagcgcgagctcgtccgcgtacgcagcgacatcgccagcgaggagcgtaccgccgcagctgcggtggttcgatgtgaactgcgggggtgctgcgttgacgaaccccacaagatcgcgcaccccccacgaggccgcttgacgggcaaagagcaccccctggggatcggcgtggaagtcgaacgtaccgttggcttggtagaagctcggcggcgccttccaccacgtcgtcacacccacgccgccgccgccgatgttgaagcggaactgcgacagctccaacccgcgcgacgagtagagcagccggcccacctgcgcgatcgtggcggagccgagcgctgcgaccggtcgcgaccaccaggcgccactcgccccgatcccgaccagcgtgtggcttggacgtggccccacgtctgcgacgacgagcggctggcgcggcggcgacgacggcgaggcgggcggcggagcgagcacgttcgcgccagcgacgatggcaaccccggccgcgacggccgtggtgacggacacgacggctcggaccaggctccctacgaccgcccgccgacccacgtcacgcatcgccgcgccacgctacccggcacggggtgagggcagcctgatgcccctgcgacctggcccctcgagcgccaaccttgcactaacctcgacgcgtgaacggagccgaactcgccgcgttgaccctgagcgatctcggcgtcggggtagtcttcgccaatcccggtacgagcgaactggttctcgtcgatgccctggagcgacgtgggccgcgcccgattctcgttacccacgaactcgtcgcgatgggagcggccgatgcacacggtcggctcggcaggctcggggcggcgctcgtccacctgggtccgggtctctcgaacggcctcgccttcgtccacgacgcgcgccgagcccacaccccgatgctcgtgctggtcggcgaacatccgcgctcccatcgggcgctcgatacgccgctcaccatgcggatcgcgtcccttgccgaggccatcgacgtcccgatgatcgcgatcgacgaccctgcgctgatcgccccccaactccgcgcagccgcgaccatcgccaccacgcagcgcacgccggtcgtcgtcacgctcgatgccgtggcgatggaacgcgaagcgacaccctccgaccccagcgccccacccacgaccgcgcacgaggcgccttccatcccccgagcgcgcctcgaagccgcgatcgacctggtgcgcgctggagagtgcaccttgctcctcggcgctcgcgttctcgagcccgacgcacgcgcgctcgcacgtgccatcgccgatgacacgggcctgcggctcttggcggagaccttcccggcgtcgcatcgctacggagaaggggcggggcgcatcgagcgccttgcctacctgcccctcatggcgcgcccgcagctcgccacggcgcgtagcgtgctcgttctcggaaccgatgccccgtcggcgtggttcgcccacctcgagcaggatccgcggctctggccgctcgctgcgcccctcgtacgcctcgacggccaggacgaggacccacgcgtcgtgctcgagcacctcgccaaggcgctcggggtcacaccggctcctccaccgacatcgcaacccattccggcgccggacccccacgcagcgctcgacgggtcgacgctcgcagccgtcatcgcacgagccgtgcaggccgacgacgtcgtcatcgacgaagcgcgcacggctgcccccgcgctctacgaacaactcgccgacgcgcgacgccaccactacatcggtcaccctggcggtgccatcggggaaggggcgtcgctcgcgctgggggcagccacgctcggcgcttccgtcctcgctgtggtggccgacggagggttcctctatgcgccgcaggccatctggaccatggttcgcgagcacctcgacgtcaccgtggtactcgcggtgaacggcggctaccgcatcctcgagatcgagcagaccatcgctgggctcgacctccacccggagctcacccgcctcgacgacccaggctgggacttcgctggcctggctgctgcgatgggcgcacgaacgacgaccgccacaacggtcgcagagctcgaggcggcgctacgagatcgacatggcgtccacgtcatcgtcgcgaccgtctcccaatgaccggtgggcgcccaccccacctcggaacgagccccgtcacgaggcggcgagtccaaggtgttggctgaggaactcgacgcgagccctcgctaccgcctcgagatcgtcgggtcgccgtggcccgtgacgactctcgaggagcgggaggaatcgtaggtcgatcccgaggtgcgcggcacgctcgagcagtcggagcgagtgaccgacgtgcacgttctcgtcgaccatgccgtggatgacgagcaccttgggagcatctggacctgcgagtccttcgatcccgtgcaggacgctcgcctgctcgtagcgtggatcgtcgaccaagccgaggtagcgctccgtgtagcccgtgtcgtaccagcgaaagtccacgaccggtgcacctgcgaccccgacccggaagcgtgacggatgtcgcgaggtcgcgagcagggtcaggtacccgccgtagctccacccgaagatccccacgcgagtggtgtcgatgccgaggtgggccgctgcccaatcgatggcggcgagctggtcgtcgagctccacggtgccgaatcccctggcgatcggctcctcgaaggcccggccacggttcgccgaccctctcccgtcgagcttgacgacgacggcgccgcttcgtgcgagccactggcaggtgagatctgcggtgagcgaccatgcatcttgtaccagctgcacgtgcggccctccatagaccgcgagcaccagcggacgaccctcggtcgacccttccccttggtagaccgcggcgtagcgccggacgccatcaccgaagtccgcttccacgaggcgaggggtcggcacgacgacctcgggctccgatcgcacgagcacctccaggtcggctccgatccgaaggagctcgggagcacgctccacggacgacctgaccgcgacgattgcccgatcgccagcggcagcgaccccgaacacgccgcccgcgagcacctcgtcgggcgacgacccatccagcggtacgcgccacagggagcgccgtgtcggatcgtcgacgtagccgatcgcgaccaccgacccaccgaccacgccgacgatggccgtcgccacgagtgccggggccagcgcacgtgcaccctcatccgtgatcgccgtcacgcgccagaagccgtcgaaacgctgactcctcgtgacgaggacgccgtcggcaccgatgagcacgcccggcacgtcgacccagggttcgtggtgctcgcgatcgatgcgcgtcgcttcaccatcgcccatcgacacgcgccagcgggtgagctcgtgctgcgcccgatcgaggatccctgccacgaacgtctcgtcgtcgagccagagggcctcgacgaggtaaccgtcaccgatcggcaggtcgacgatcgtcgcgccacctccgtcgagcgtggcgatcgcgatctcgaccaccgcgttcgccgcgccgacgaaggggtagcgatgccgctcgacacgctcgggaaagggtccgtgatgcacgatgaggtgctcagggaccttggactcgtccaccacggtccaggccactgaacggccattcggcgagagccagagcccgtcgtgacgatcgaattcctcctgagcgatgtagtcggcgagcccgatggtgcgatccgtggcgatcgcgagacgttggcgctcgcccggccccgcaagccacacctctgagccactcgccgcgaccacacgatccgagccagcgcacgtcgccacggcgaccgcgccatcgaggtcatagcccacgactggccgaccagtccgatcgaccacgctccaacgaccgccggtcgacaccgcaagtcccgcggtacccaccagccgaaacgagctgaccccatcccaggaacgtcggaggcgctgggcttcgagctcgtcggcctcggtcggtcgcgcctcgtcgtccggtccaaccagcaccacgggcgaggagtctcccgccgcccaccgaacgagcgaggcgcggtcgtcgtcgccggtacggagcgcgaggaccgatgcgccatcgatcggatcgatggccacgagtccgacctcgaccacgcccggcaaccgtcggcgccacaggtcatcgaaacgaagttcgcgcatcatgcgagcaccttacgtgccgaggcgccctggtgcgtcagcgtacgagacagcgaaccagactgcgggccgcctctcgtgcccaccgactcggctcgtacaatgacgccaaacctcgtggtcgaagacccgggccggttgagcgctgagcggttctcgtggtgacacgcatggccggagacgatcctccgaaccctcaccaatggcccacgccaggactgcactcccctggggccgggacgaggcggcgtccgatctgagggggaggtctgcgaaacggtcaccacgctcgctcccggccaccctcaccatcgactcgatccggcggagcttgagcgctaggtcgccgacgcctcgtcacgcggctccggccgcggacgctcgggcagcgcgtcgcgacgccacaccaagaccttgcgccgaaaggagacgacctcctgaccatcttggttgtagccgcgggtctcgacctccaccacaccgcggtccggcttcgatcgcgacggcacgaccgcaaggacggtgctctcagcgtagatcgtgtcaccatggaacgttgggtacaggtgacggaggttgttgacctcgagattggcgatggccgagcccgacacatccggcacgctcatgccgagaacgagcgagtacaccaggttccccacgaccacgttgcgcccgtgcaccgtggcgagctctgcgaaccgctcatcgatgtggagcggatgatggttcattgtgagcaggcagaagagatggtcgtcggcctcggtgatggtcttgcccggccagtgccgaagcacgtcaccgacgacgaagtcctcgagacagcgcccgaacgggcgctcgtgggtggccaccgaactagtcgagtggtcgtggccccgagggcatcggtgctggacctgtcggaccgttcgcgggtcctccttgctggggcatctgtggtggcgcgagcgtcgagaacgacgcgtaccagtcctcgcccgactcaccgtcgaccacgagctgccaacggtaccgcgagttggcgggaagcgggaggggcccgatcgtcaccgccagattgagcgggatatccgaaccgagcggcacgccctgcggggtacccaactggaagtcaccacggatctcgaccggctgagggccctccggagtctcgatcgtgacctgttccccggcttcgtcctggaggaacagctcccagtgatgcggattcggcgcttcgccccaggcgagctccagtcgcatcgcgatcgccatcggcgcaagaccagcgacggtcatcgaccaaccgcctccgaggatgtagagcttgccgtcgcagacttgcgcggcgtcacagagcatgagggaagccttcacggcgccaacgctagccgccggcacacctcgggtcagcgcacgagagcgcccgtgccgagcagggcgaccacggccgtgaggttgaacgccgcgtgcgccacgatggatggtccgagtcgtccggtacgcgagacgatgatggcgaggatcacgccgaagacgaacaggccgagaaattggagcggctcgaagtgtgcaatcgcaaacagcagggcgctggcgacgacgggaaccccgatgcgaagcagcgagggccacccggccgcacggagctcgtagagccgcagggtcacgccgcggaagaagatctcctcacacaggggcgccccgatgacgatgatcgcaacgacggcgaggaaatcgtggccgacgccgacgccgagcagctggacggctggcttggagatcgaccgacgcgcagccgggtcaacggcctcgacagggagatagagcagcggaaccacgacgagctggccgaggacgccgacgccgatcccgaccggaaggtcgacgaggcgcatccgaaagcgcacgaagcggaggaacgaccccgcgccccaccagcgcgcaccgagcacagcagcgccgacgaacacgacccacaggcccgcttcgtcggcggcgagcaacgacgggctgaggccagcgaccgtggtcggcaccgctcgatgctgcagcgctgcggtgccgtcgagcgccaggatgctgcacacgaaggcgaccgcgagagcgacgacggggaacgcgagcgcaccccagctgacggtgccgagggagtcgcggtcttccgtcacggcttccctccttgcgcagcctcgatgggtaccacgccgttcgctgacgaccgtacacgagcccaaccccacggagtaggcaggcctgcctcgcaccgcatcacgacatctcgaacgtgagcagcaaccctgaggcatcgctcaatgccgcctccagggtaaccaggactcctcgaccgaagctcccgtacgtgcaggaactcgcctagcataggcagggtatgatgccatcgtcccaacgcccctcgccacgaggctcgcgtcagtcgccgtcgcccgaccagcgcgggcgcattgccttcgcgatcctcgcaacgctcgtcgtcgccgtgctgctactgactctcttcagccacgccccgagcggacagccccttggctacagcaccttcatccacgacgtacaggccaagcaggttcgcacggccgtcctcaacaacaccacgggtcagatcaccggctcgctgacgaacggtactgcctacagcgtcaccggtccgctgccctacacctcgagcgaactcagcacgctctcgaaggcccacgtccaggtgagctacatcacccccgggcctggcatcgcgtccaccatcatcgagtacgtcatcttcttcgggatcttcatcgggatctgggtctacctcacgcggcgcacgcaggggtcggtcaacggcatcatgagcgtgggtcgctcgcgcgcgaagacctacaccacggaacgcccgaagacgacgttcgacgacgtggccggctaccagggcgtcaagggtgaggtgaaggaggtcgtcgacttcctccgcgatcccagccgcttctcgcagctcggtgctcggatcccgaagggcatcttgctcgtcggtcctccgggaaccggcaagacgctgctcgcccgtgccgtcgcgggcgaggctggcgtgccgttcatgtccgtgtccggttccgacttcatggagatgttcgtgggagtcggcgccgcacgcgtccgcgacctgttccagacggctcggcgccagtccccgtcgatcatcttcatcgacgagatcgactccatcggtcgtaagcgcgggacaggtctcggcggcggacacgacgagcgcgagcagaccctgaaccagatgctctcggagatggacgggttcgatccggctgagggcatcgtcgtgatggccgccaccaaccgtcccgacatcctcgacccggcgctgctgcgcccgggacgcttcgaccgtcagatcgtcgttccgctccccgatctccccgaacggctcgccatcttgcaggtccacacgagaggcaagcgcctcgcgcccgacgtcgatctcgaggtcatggcgaagggcacgccggggatgagcggtgccgatctcgccaacttggtcaacgaggctgcgctcaacgccgtccgcaggggcgcgaccgacatcgccatggcagacttcgactctgcacgagatcgcatcatcatgggccagcgccgcgaggccaccatcctctccgacgaggagaaggagcgtgtcgcgttccacgaaggcggacacgccgtgctggcctatgtgctcgattactcagatcccgtccacaaggtcaccatcctcccgaccggcatggccctcggcgtcacccagcagctcccagagcgcgatcgacacctctatccgcgcgagtacatcgaggacacgctcgtggttcggatgggaggtcgcgtcgccgagctgctggtctacggggatctctcgacgggagccgccaacgacctccagggcaacaccgagctcgctcgcaggatggttcgcgagtggggcatgagcgagcgactcgggccgatggcgtggggttcgcagaacgtcgtcttcctcggcgaggacctcctccactcggccgagtactccgaccgcacggctcgcctcgtcgacgaagaggtcgaacgcatcctgcgcgaacaggaggaacgcgcgaccgagctgctccgccagcacctcccgggcctcatcgcggtggcgcacgcactcctcgaacgcgagaccatctcgggcgaagaggtcgggcgtctggtggacgaggcggcaggccacccgatccaccccgacggcaagcgggtcctgccgatcgccaagctcccggagtacgccgagctcgagcagttcaccgtcacgaacggcaacaatcacgctgcatcgcacgacgacaccgaccccgtcagctgagacacccgtgcgcgagttggtcgtcgtcgccgagttcctcgggttgacggaggcgcacacctccgggggtttcctcgccctcgaccgtggcctcgcgaccagtgctcgactcgtggtggcgggcccgtgggcccccgaggtcgtccgtcgctaccgaggccaggaccttggtgtcacgctgacgctgacctcggcccatccgatcctgcgactctccccgctcaccgcggcaccaacgctggcgagcggggatggcggactcccggtcgcggccgccgacctcgtcgaacacgccgacgccgaggaggcagcgctcgagttgcgcacccagctcgaacgggccatctggtggggcatcagcccgagccacgtggcactcttggacgaggggatcctgcgccgcgccgacctgttcgacgtggtcgcctcgctcgccgaggagtacggtctcgtccttcgcctcacgccgagcgccgacgaggcacacctcggctacgacgcctgggggatcgctcgcgaccgcggcatccgcaccatcgacgccgcgatccccgtcgacccggcgacgctgaccgacgcgggcgccctgctggatctcgtccgctcgagtgcccacgccctcccagagggcatcagcgagctcggcctcccactcgcgatcgacagtcccgagctcgcggcctgggtcgcgagcggcggtgccgccccggcccccgtccggctcctcgagcacatcgaacgcctctggggggcactcgagcagcgctccatccaccggacgagctaccgcgacctcagtcgccgagtcgatcgaagtccgtccgacgggcgagctcctgctcaagggttcggtacgccggcgacgccgtaatgggcagcagagccacgagcagatcgaggttgccctcgacctccaggcgcccttcgagaaacgccgtcgtcggatcgagctctccccgctgcatcgcacgcgcgatctcgacgtccaccgtgatcgagacgtccgggttcgggtgctcgccaagcccggcgtcggcgagctgcccgtcctcgatcacccagtagtacggacgctcgacgtcggcaagcacgtagtactgcaccacgccgttcgcaccctcctggcgaggcatcgccgcaccgagttccttcgtatcggcgacccacgcgctcgagagccatgcccccatcacatcctcctcaccatcgggtctcgaggctcgccggctccagcagcagatcggcgaagagatcgtccaccacgacgccggctggctgaccgacgatgtggtagtcgtccgtcggccacagctcctccagctccgaagcccccagcgcgaaccaccacggcgatgccgggtccacctgcgatgcgtgggcacggagcgcctcgtgggcacgctcgatgaagccggtgacgtcgacacgcgccccgacgagctcgtcctggcccgggcgatccgtgcgagcccaaggaacctcgatcccccgtgcccgaagcgcctcggcaatgcggacggagcgctcccggacccacagtgaccacgcccaccgcggcactcgccacggtgggccgagctccggcaacaccgtgggctctggcgccaaggcgagcgcgaggcgcgtcgcttcgaagacacggagatggtccgggtgcggatagcccgcctggtcctcgggataggagatgacgacgtgaggtcgcacgcgcctgaacgtggcgatcaagccacgcgccgcctcaagcagtggcaccgaaccgaaggcgcgtggatgacgcgccgtgggagagcccggcatcccggagtcgcgaaacccaaggcgcacgatctcggcatagcccgcgatggccgccgccttgtcgagctcctcacgccgcatccgtgccatgcgctccggccgctccgtcgcgagctgagggttcaggtacgaaccctcctcgcccccggtcgccgtcacgagcacacagtggacaccggcatcggcgtagcgcgcgatagtggccgcacccttcgacgcttcgtcatcgggatgagcatgcaccgtcaccaggcggaacgttgcgatttggcgcgccgacgtctgggaactcacgccgccagcctaccgaggaaccactcctccagggcgccgtgctgccctcgaggcttacgccggcaccagcgtcaccgacccgctcacgctcacggtgccgacgccaggtcgaccggcgatcgcagcatcgaggacccgagcgagccccacgcgcgtcggcgttgcgccaagggcgtggatcgccccgaccatgttcagcccgaccacaacgccgagggtcgctgcacgagttccccctgcgcgtgcggacaaggtggcgacgagcggtgcccacgacggtggcagcgtcgtcggcacatcgctcacgaccgagaggcgtcgaggatcaatcccggcgctcaccgccagccatgcgccgtctctggcgggggcgagcatcgcgccgacgacaacgacggccttcggtgtcacgccagcctggacgagatcgtgcagcacggtcgcgtcggcgacaagatcgtcgccgacgacaagcgtggcgcccggattcgcgcgcacggcactcgcgagcgacatcgagctctcgccgatcgcgtcacgcacgcccgccggcagcacggtcatcgtcgtcccaggagggagccacagcaacgggcgcgcgcccagcgagccgtcgtgcatgagcacctggagctgcgcagcgaggggtggcagccagcctccagagacgatcgggaaggacgatgatgccccgatacgtgacgccaccgttgcaaccgtgctcgtcgctggcccgagactcgcgccgacgacggtgaacgcgtccaccgtcgtcagcgcatcgcgggtctcgatggccgctgcactcgacgtagctggcaccgtctccgcgatgaggtcgatgcggcgacctgcgacgccaccgtgctcgttcgcccacgtgagcgcctcgtcgatgccacggcgataggaggcagcgccaatgctccacggagactgagtggccgtcaccgtcgccactgcgacagagctcgcggtcacgccaggtgcgctcgccgccgggagcggcgtcgacacctgcgtactcgtgcacgccgcagcaacgaggccgagggcacaggggacgacgagatgacgacggcgcatcgcgcctcatgctatcgagcgccctactggaagtccctggagccaagggcgatggcctcaggaaggctcacgatccgatcagcgaccacggtcacgacggtcccggcccgctcgatcacgccgtcgaccagcaccgcgctgtggagtgcctgcgatcgatcgcgacgccagagccacggcttgaccaacacgttgacgaggcccgtctcatcttcgaggttcatgaagacgatgccacgcgccgtaccagggcgctggcgatgcgtcaccgtaccggccacgcgaacccgccgaccatggcgctggctcgccagctgatcggcgcgcacgacgccaagtgtcgacaaccgctcccgaacgaacgccatcgggtggtccccgaccagcaggccgagcgcgtcgacttccagcgctgcccgctcacgagggtcgagggcagggaagacgggctcgctcgagggaaacccgaggccatcgagcatccgatgccgacgtgccagctcgtcggcgaaccagatggcgcgctgccccgacggctcgagtgcacgcagggcaccagcgccagcgagacggcgaatctgctcgggcgtgagttcgacccgctggacgagatcgaggagcgagtcgaacggacgcatcgcgacgatgctcgacgccgtcgccgctgcgatccctcgaacggcgtcgagaccgagcgcaaggagctgctcgccatcgcgtacgacgacgtcggcgcgtgcgctcgaccgcgtcacatccggaccgaggaccccaacaccatgacgccgcgcatcgcgtacgagtgtctgcggcgaccagaaccccatgggctgagctcggagcagcccggcgtagaacgccgccgggtagtggaccttgaaccatgcactcacgtagaccagccacgcgaacgacgccgcgtggctctcgggaaacccgaagttcgcgaacgcctcgagctgcgtgacgacctgctcgcgcgcggccggatccacgcctcgagcggccatgcccgccatgagccggtcgtggagccgtgccatgcgcgcgctggagcgcttcgcccccatcgcctggcgcagctcgtcagcctcggcagcactgaaacccgcgacgtccatcgcgagctgcatcagctgctcctggaacagcggcacaccgagggtctttgcgagtgctcgctcagcgagcgggtgcggatagaccactggctcctcaccggctcggcgacgcaggtagggatggaccgacccaccttgaatcggaccggggcgaatgagcgcgacctccacgacgaggtcgtagaaccggctgggacgcagccgtgggagtgtcgccatctgcgcacgcgactcgacctggaacacacccaccgagtcagcacgagcaagcatctcgtagaccgccggatcctgttccagcgtggcgatgtcgacctcgacgccgacgcgctcgcgcacgagatcgaccatctcgtggatcgcctcgagcatgcccaacccgaggagatcgaacttcacgagacccatgcgcgcgcagtcatccttgtcccactggagcacgctgcgaccctcggcccgtgcccattccgtcggacacacgtccacgatggggcgatcacacaggaccatcccgcccacgtggaccccgaggtgccgaggagcgccctcgaggacgctcgccacctcagcaatcaccgcagggacctcgagcaacgggcgacccgcgccgtcacgttccgcgagtgagcgcgcgaccgaacctcggtgctcgacccccttcgaccacgccgcgagcgtggcctggtcgacaccgaagacccgcgcgctgtcgcgcagtgccgaccgagcacggtacgtgatcacgctggcgacctgcgccgcacgcgctcgtccatagcgggtatagacgtactggatgacctcttcacgacgacggctctcgatgtcgacgtcgatgtcgggaggaccgtctcgctcgggcgagaggaaccgctcgaagagcagaccgagcgccaccggatcgacgttcgtgatcccgagtgcgtagcacaccgccgagttcgccgccgagccgcgcccttggcagtagatgccctctcgcacgcaaaagtccacgatgtcagtgacgacgaggaagtagccggcaaaaccgagcgagcggatcacgtcgagctcgtggtcgatctgctcccacgcaccggggatccgcggcgcagctctcggaccgtagcgcctcggtgcccgctcggccacgagcgcgacgagggcctcgtcatcgtcgacgcccatcgcgacgacgtcacgaggcaggccaggggccaccagatcgacgttgaaggcgcaccgagcggccagctcgacggcggcgtcgaccacgccgggatagcggccgaaccgcgctcgcaacgcgcgcgctggccgcagcaccggcggccctgcgcctgggaggtagccatcgagctctccgagggtgcgccgtgcacggatcgcagcggcaactacggcggctcgctgggttcgcacgtcgatcgcgtgcacagcctgggtcgccaccaccggcaggccgtggtgcgcaccgatcgccgcgaggacgtcgttgcggaccgtgtcggcagggtcgagggtgtcgacgagttccaacaccaacgcatcgccgaagcgctcccacagcgagcgcacactgcgctccgcggcgctcggcccagcgtgcgcgagcgcacgccccggagggctcttgcgccaccccgcgagcacgaaccacccacctgatggggccgcctcagcgaggtcgtcgatcgtgagatcgaagcgtcccttctcgccggtacgcatgtgaccggtcgcgatgacacgcgacagcgctcgatagccctctggcgaggctgcgaggaccacgaggtgctccccttccgggtcggtcgcgccagctcgaggcgtcgtcgtcgccaacgtaagttcggcaccgacgagtgggacgacccccacacggcgagccgcctcgaggaagcggggtactccgtagagaccgttgtgatcggtcagcgcgagcgcacggtaacccgcgaccgccgcggcctcgacgagatcctctggatcgacgacgccgtcgaggaagctgaacgacgaatgggcatggagttcgacgaccgcctcgctcactcgtagctcccctcgagccaccatcgcccgtgctcccgtcgaacccagcaccaccgccgctcggtcgcgagcacgagtcgggcgtagcgagcacgacggcgctcccaccaccgctcgcgcaccacccacggcccatgagccgcctcgatgcgctcaggaccctctccgtcgtcgagcaccgccggtggagcgctcaagacgccatcacgatcgacctcgacggccataccatgcgcatcgagcagcacgacggcctggaggcgctccggaacccgcgtcggcgtgagtcccggaacatggccaggccacggggcgccagttccgaccctgtcgtcgacgaccggccaaaccccggtccaggacacccaaggacgtcgatcggcgaacccgcgacccaccggtcccggacctgcgacccgaaccgcctccggtccatagcgctgctggagcacgtgaaatgcctgacgtacggcctgacgtcgcgcgccaggcacgccatcgagggagagctgcgggggttgtggcacactccacgcaaggatctccacgccgacgcgtaccggtcgcccccgagcaccctcggcgcgatcgctcagcgcacgcaccgattcgaggatctccgccgccgtccctccgaccgggcgctcgacgacccgctcgagcgccacggctccctcgaggtcgacgaaggagcgccatcgggcaggcgcgacgtctgcgtgctcggcgagcacgagatcgagcgccccacggaggcgaaaccgcacgctctgggcatcctcgccttcctcgacgtcgatcgccaccgcgtccggctcgagtggaggggtgcgcacgagcggaagatcggcttccagtcgcacgagtcggtgccagcgcaggccacggtctccgaagcgagcggccaccgcagccgtgtcgatgcgctggaagccaccgacgcgacgcacgccgacgtcacgaagcggaccagcgagccaccggggcagcagctcgaccggctgggcagcgaaccacgcccgcgagcccacctcggccccgcctccatccgtcgtggcgccagcgacggtggcgatgagtgcgcccgcgatcgaagcacccagcgccactcgagtcggcacggtgccgtcgagggctgcccgcacgcgctcgacgagtgcgtactcggtcccgtagaagcggcgggcggcacgcgcttcgatcgcaaaggccccacgcacgcctgccacctgacccacgcccggcgagacgctccagagtgcccggtgcacgcgggccaaccaacgtgcctctgcgatcggatcgaccgcgaccacccggccatcaccgaggcgggcacgcaccatgggggcacgtgccccgagggggatcccagcagctcgagcacgggacccgacggcgacgacccgatcgcgacgatcgacgacgacgtcgaccgcatcagcaccaccatgtgcgatgagctcgagatcctcgatccacgcaacgacccctggccgcgcagcgaccagctcgatgccgtcgaggtcgatctcgtcgaggtcgatcaacccgccacctcgacggccgtgggcgtcgtcgtcaccagcgacgaacgacgcaagctgacgcgcacctcgcgcggcaggccagactcctcggcgaccgtcatcgaggcgacctcgagcgcacggatcgatcccgctgcggccagcacgcggtggcgctcgcgactgcacgcgcgttccagcaccacaacgatccctcgtcggcggcgcacacgcccgagaatgcgcggccaccggacgtcgacaacccgatcggagacgacgagcacgtcgaccacctctgcaaggttggacgccacgaccgccagctgcgctgtcggcaccgacacctgtgccacgtgtgtgagcgaccacccagccgcttcgagcgcggcggctggcaggtcctcgagaccgagcagcgccaccgccctgccctgatgagtactcggcgcgatcgcctcgagtgcaccccaacgcgcacccgggccgccgtgcatcaccagcgcggttccaggcgggacgccgtccccgaggcactggcccgccgagccgcccagctcgagtcgctggtctaccagctgcccagcagacaggaaggaggtcacatcgtgattttagaacatttgttcgttcatcacgacggctccccctccatgcgcccccactgcgcgatgaagtggatccgctcgggaagcagcagcgaccgccgatactcgaccggtcgcgccccggcgaacgtgcgccgctcgaccagcaagagcgcttgaccgacctcgacaccgaggagacgagccacctcgccgtcagcgttgacggccgagacctcgtccatccccgccgacacgtgcacgccggcgtgctgctccaagatctcgtagatcgatccctgctggagcttggcctcgagcaacacctcgccctcggggagcacgacgctcgcctcctcgagtgcgacgacgtcctcttcgacgccccggaggcgccggaccacgacgaacgactgcgcagggatctccaggcgctccgcagcccgagcatcgtcgcgcacctcgacactcagcagcgtcgcgacctccttgcccacgtcggcaaggcgcgccgccagcgagaatcgctgctgctggtacccctcgaactgcctcctgggcactacgaaggtacctcgtccctggcgagcgtcgaggtagccctccatgcgcagctgacggatcgcctcgcgaacggtcgcgcgcgacaccccgaaggcatcgcgcaattcgggctcggaggggagacgatggcgcacccgaccatcgtcgatcgccgagcgcagctcatcggcgagctgcacccacagcggcaccggcgaccccggatcgagacgagccggctgtagtcggtcagtcacgagatcccccatccgttcgaagcagccctgcaggtgtgctcacacccggcgcgctgatccgcccaacccatcggtccagcatacggtcggcgctcaacctgcaccgtcgagcgctccacgcgccagacatcccagctcgttgccccaccgcctggcggcgacacgagtcactgagaccaatgcatcgagacctcgtcacggagggcgatcgacacacgacgcctacgcgatcgcgaccgaccgctccggcgtacccgtcgcagagacgaccacgacgacaccggcgctccagcctcagcgatcgatctgacgcagccgtccttgatgcacctcgatgcggcgctctcccgcgaggatggcctggatcccacgtcccacgacgtcgtagcgccacccttcgagcaggctcccctcgccccgagacacgaagagctccacctcttcacgcgaaccgagcaacgagggctcgagttcgagctccagcgccactgcatggacgagcgcttgtgccgtgagcacgagcggcacctcgtggggatcgagcgcgcgatccatacgcacggcgccccgagccacgatggcatcgtcgtcacgcgcagctcgtacgacctcgagtagctcacgagcacgttccttcgccatgcggccgtcgaagccccgcacgctgcgcagctcggtgagcgagctcggacgcgccttggcgacactcgccacggcgagatccgagagcaccgtgcgcaccggaacgtcgtcgcgttgggcggtgcgctcgcgccaggccgccacgctcgctgcgatccgtctccccgtaggatcgaggccacgacactcccggatccgtgtccatgcgagctccggttcgatgtcccgacgccgccgctccacgagacgagccatctctgagcgagcccagtcctctcgtccacgagcgtgcagttcctcgagaagccggtcggcgagcgcagcgaggtagcggacgtcgttcgcggcgtaggcgagttgcccgggctcgagaggacgacgcagccaatccgaggtgcgctcagccttggagatgctcacgccgaggtagcgatcgagcaacgcgccgagactcgcgtgaccggccccgaggaatccacctgcgacctgggtgtcgaagatacgccgtgggcgtgcgccgaccgcgcgctcgatgatctcgaggtcctgatcggcagcgtgaaatacgagctccacctcgtcgaaccacgctgcgatcggcgagagatcgacccgcagcggatcgatcaaccacaccctccgatcgatcgcgacctgcaccaacgcgaggcgtggatagtacgtccgctcccgatggaactcagtgtcgatcgcgatgcgtggcaccccgagcccgacgccgacgagttcgtcgaggtccgactgtcgatcgagccagacgggctcgtcatcgctcacgaccgacgcactcagcgccatcagcacgacccgcccgtcgcccacacggcgctcgccgtcactctggccacgcctccagcctaggagcccttcgaaccagccctcccgtggggatggggctggtcagaggtgacctcagctcgcgagcaggccgagagcatcgtcgtgacctcgcctacagtccttggcaactcgggcaccatcgcaagatttccggtgttcgcggcggccaacacgggttgcctgctgcaccacaccacggcgaagacgttccgagtcgagagcgatcacctgagcgaccgacccaatgagccaccgccgcaggctgggcttccccccacttgcttgacagcctgattgaggccacggccgcctcccgacgggtccaggagagctcgtactcgacgggtggcacgtacccgaggctcgggtgcggtcagaccgcgctgtcgcacttgatccagacaacgagagcatgaccgagctcagggaggttcgccaaccgacgccgagtgaccagctcccgaatcgcgttcgcgaacgcgatttcggcctcaacgcaccaagcgcccgggacgaagcacagccccttcacgcgtgcgcagaccgccgtgccacgagagctcgtgcctgcgtccgtccgagcatgactcggccacggcggtcccccgccctacgctgtggccgtggaaggttgcgtgttttgtcatctccttgccacgagtgacccctatctcgtcacggcggaccacgacgtcgccgtcatcttggatcgcgcgccggtggctcccggtcacgcgctcgtcatcccgaccggccacgtccccaccttcgatgacgcgagccctgctcagttggcttccgtcacggtgaccgctcaacgactctcgcggggcttgcgctcgcacggcatcgcggacggcgcgctgatcctgaccaacgtggtcgtctcgcaatcggtgccgcactggcactgtcacgtggtgcctcgacatcgcggcgatgggcttcgaggcttgctctggcctcgacgtcgctacggcagcgacgatgaggtcacgctctggcgcacgaccctgcacgcgctcgtagcaccacagagctaggaaccctggctggcgcccctcaaacaagaccacccgcttcgtgagcgaccagaatggacgagtgggagggagaccacatgaagggcccgaagcgccataggccggagcagatcctccggaggctggccgagggggacagctgctgaaggcgggcgccacggtcgtcgaggtcgctcgggccttcgcacatcaccgagaccacctgggagcggctggctggccttcccccctccaggttgacacctgctctaggaggaagggatgagccagacaccgaacccaccaccgggcgacagccccgctcggcgacgacgcggccgctacccgagccagttcctcaaaggagccgcagcattggtcctcgaccagcgtcgcaccatcgctgaggtcgcccgcgagcttggcgtgaacgagcagacccttggcaactcgcgtgcaccaggaacgcatcgaccgcggtgagcgcgaaggtctcacgagcgccgagcgcgaggagctcactcgtctgcgccgccagctcaagcaggtgacgatggaacgtgagctgccgaagcgttgcccggcctttgcggatcctgcgagggcaaccagtgacccgctaccgctccggttgctcgtcaggaggccgatgggttctccgtagcggcagcggcacgagtcatcggagtctcgcgccaggcctacgacgcctggcgacgctggcgcgagcgcggccctgaccccgagcacctggtgctcgcgagcgagcttcgcgccatctggcgcgagagcgacggcacccacgccaagtcccagagtgacccacgagctgcgacacgcggtgagtgcgtcaaccacaagcgagtggaacgcatgatgcgcgagctcgagatagccgcctgcccaccccggcgcttcgtgcgtaccacgacgcctgcagaggacgcacccctcccggacctggtccagcgggacttcgcccctggcgagccagggcgttgctctgcgagcgacatcacctgcgtccgaaccgatgaggggttctgctacctcgccacggtggcagaccttggctcgaggcgcatcgtgggctgctcactccagcatcgcatgcctgatgacctggtggtcgaggcgatctgcggagctcttcggacccggggcagcgtggctggggcgatctttcacagcgatcgcgccaaccagtacctctcccggaaggtttgccagctctgcgcgacgctcgggcttcgccagtcggtgggcagggtcgcgacctcgcgacgacaacgctgtcgccgaggccttcttcggcagcctgaagcgcgagctggtgggtcgctaccgcttcgcgaacctcgccgaggcccgccctgccatcgcgagctggattcagcgctacaacacggtccgcctgcactcgagcctcgggtaccgaccgccaatcgagtacgagctcacctgggcccgtgcggaggcggccgtggcctacattcagactgtcaagcaaatggggggaaggccagcgatctggacccactagtgggtggtcgccactttctcggcgacctcggacagtcgggcctggaccttggacagattttcagccctgacaggattctcggtactcacatgcagaccaggtctcatgtcggcactatcaccgcgacgccgtactgggaggccgccgccgccatacggttgtcgtaggtgacgatgccgtcgagctcgtcacccagttccagagctgcggcaagatggagcgcgtccagactccgcaactcttcggggtcaagggtggccgcccgttcgagcgtggcagaggtgaggttgaacaaggtgagagcgtcaagtactgatcgagcgcgctgcatccgatcgggggccgcgcgccgggtcgcccgaaggagctcggtgcgcagcaagtcactggcaatcacctgggtttcgtggctggccgcccacgatgccatggcttctgacgccggttcggcgacaacgagcttggccgccgccgacgtgtcgaggtagaagaccatcagtagcgctccccgccacgcatggccgctacgacctccgacagcctgggctgctccgcacccgcgtcgggaggcgcgccgagagctgcgagcgagcccttcgccggccgagcccgacccgacgcgacgaaggcagcgactcgcccctccgggaccggaacgagctgggcgaccggtcttccccggtcagtgatggtcaccacctcgccggcggcggctctggccaccacctgcgaggcgttctgcttgagggcgcggatgcctaccgtactcatgttctacattgtagcactctgtcgctgaccgctccagggatcgatgtgctcccaggcgtgttgaaccgccccgggtttcgtgcacacttcgttatgtgtgaacggtctcggactcggccgccaggcggccatagtactcctgctcgacctcgacgggtggacggcgccccagccggtgcatgagcctccgcgtgtcgtaccagttcacccaggctgaggtcatctccttgagctccctgcgcagcctgatgagctcggtgcgctcctgcgccgtgaggggcgggctgccagtggcgctcgctgcctcgatccgcctgcgctcctcccgcacccatcgaaagatggctgtactccccgatcgcgagctcccgggccacctccccggcacgctccggccgctatcgataacccggtgggccgcctcgatgcggtactccagggtgaactgaccttctcccctccttctgacatcgtacgtgtgacgaacgacgtgtctacggaatctggggcggctcagacgtcggatctcacagtgagggtggactcggtgtggggggacggtcagagcgaatcagcgcacagcgcaagcgcaagctctctggggcgaggctgcgctaccgaggactcgtgcgcaaccgcctgcacttcgagctgctctgtgcgacctggaacctgagggtgctcccgcgtctcgggctcacccgagtaggtggcggctgggtgcttgccacctgagaggcgctcgggcccctcccctccttgcctccgaaggaggggacgaagagaagagggtgaggagctgggcgagcacgggtcagctggatccgttctctggcagggttggtgccctcagccaccacccgggaggggcttggtggggaggctgctagttcgcatcgttcagccgcaccaccacccaatcgcgcttgccgcgacgcagggtcagatggccatcggtgagatccgcctgcgacacacgctgaccctcgagtgctcgacgtccgtcgacatagaggcccccttgtgcgatgaggcgtcgtgcctcggaccgactcctcgcgagccctgctgcaagggcgagatcgatcacatcgatgccgtcgccaaacgccgcgcgctcgagggtgacgacgggcgcacccgcctccgcacgtccaccctcgaagagcgcacgagcggcctctgcagcctgatcggcagccgcctccccatgcacgaagcgcaccacttcccacgcgaggcgccgatgggcgatgcgccgagagggatcgtcctcgtgggcagttcggagcgcagcgatctcatcgaaagagagaaaggtgtagagggccacgtactccatgactttctggtcctcagcccgaacgaagaactgatagagctcgtacggcgacgtgcggtcttcgtcaagccagacgttaccccccatcgacttgccgaacttggtcccgtcggccttcgtcacgagcggccacgtgaggccgtggacctcgtgcccgtcgagacgtcgcacgagatcgatcccggcggcgatgttgccccactgatcggacccgccgagttgaagcgtgcacccgtagcggcggtggagctctacgaagtccaccgcctggaggatcatgtagctgaactcggtgaacgacaggccctcaccgccgaggcgcgtacggatcgactcgcgcgccagcattgcagagaccggcacgtgcttgccgatgtcacgcaagaacccgatcagggtgagcggctcgagccacgttcgattgtcctcgagcgtcacggcccccggcaccacgtcgccgaggagtcgttggagctgaccggcgatgcgggccgtgttgtgtcgcagtgtcgccggatccagcaagacccgctcgctcgagcgacccgagggatcaccgatcatgccggttgcgccgcccgcaacgaggatcgcccgatgacccgcatcgatcagtcggcgcgccagcacgattccgagcaggttgcccacgtgcagtgagtcggcggttggatcgaagccgatgtagaagacccgtggcccggcatcgaggagctgctcgagtggcgccgacgcatcttgaaccgcgccacgccacctgagctcctcagcgagcgacacttgatccccctgtcacgaccgtccggcagcctggtagagcctatcgagctcggcgttggtcgcctcgcgagtcgtgcccacgcgggccacgacgaacgcgcccgctcgggcgcgcgagagggccgtcttgacagaggccgcatccttgagcgtcatcacctcatggccgaggccttcgaggatgcgtcctggcgagtaccgtggcggcgtcacgaagaaggagcgctgcgtcgtggggtcgagcaagcgcgccggagcgacgcggtcgaagatgacgcctccttggttctcgagcaccacgaccagccctcgctcgggcaacggcagttgccacaaggccgagagtccgtagagcgcggtgaggtccccgacgacgaggacactgagcgctctcgacgcgtgggcgacgccgagccaggtggcgagggtgccgtcgatgccgttcagacctcggttcgcgaggacccggacgccagcaggggcgcgaccgccgaagacctcgaggtggcgaatgggcagcgacgacgcgacgacgagcgactctccgtcgtgcagtccctggaggacgacccgggcgagggcgacttcgccagtgggcccatccgcgaccacctgctcgagcgtcgccgcgatggtgcgatcgcgctcacacaacccacacggctcgcccgcgtggccgcccggcacggtcagcagcgcacgccgcagggcgtcgccgacgtcggcgaccaccgccgtcgtggcgaggcgcgctggatcgcgccagcgcgatcggctctggatccacgccacagggatgccccgtcgtgccgcaacggcgatgcgctcggcgaccacacgcgaggcgtgtggggcgccgaggacgaggacaacctctggggaggcgtcggggagtgagcgcaggacgagctcggggtgctcgaggacccacgggccgcgctcgacgccagcgagcggatcggccagcacgggccagcccaggtgcgcggcgacgctggcgagggcatcgacatcgatcgtgtcgtcctcaccgacgacgagccagcctcgacgctgaggatcgaaccactgcgcgagccatgcatccgccaggctgggacgactcgggatcgtcaccgagcgcggatgccaaggtccgatccgaacctcctcgtcgacgagaagcggttcggcgatcgcaagattcagcacgcacggcccagggccgaacggcgcggcaaccgtgcgcacgaggagctcgtgcgcgacgccagcgagctgctcggcgtccacgacgtcggagagctccagatcgatgacgctggccaccgacgcgagcgtctgggcctgctcgaccgtttgtgcagcgcccacgccatgggcccagcggggccggtccgccacgatcgccacgagcgcgacgcccgcctcgcgagcctcggcgagcgcgggaacgagctccagcgcagcggtcccgctcgtcgtgacgaccgccaccggtcgacggagtgccttcgcccacccgagcgcgaagaaggcagcttcgcgctcgtcgaggccgacgacgaccgacgcatcgctcgcactcagcgctgccgcgatcggcgtcgaccgactccctgggcagagcaccgcgcccgcgagcccaccgagggtaagggcctcgacgagcaccgtacactgagcaacgctgcgtccaaggagagacgatgaccaacgctcgtgcacgcaacctcctcggaccgaccggtgctgtcgtcgaggtcacgagcaccggcggacccgagcgacgcgccgtcgtgctccacggcttcactcagtcgcgctggagcctcatcggcacgctgcttcccgtcgccgagggcattgccagcgagatcgtgttcctcgacgccccaggtcacggcgccaacctagggccctccagtgtacgggcgttcctcgacgccgttgcggagctcgacccagacatcgtcatcggctactcgatgggtggtcgcctcgccctctggctggccgcggtgcaccccgagctcgaggcggaggtcatcgccttctccgcgcatcccggcatcgaagccgccgatgcccgcgccgaacggcgccgccgagacgaggccctcgcagaccgactcgaccagctcgctcgaccacgagccctcggtgccgatgcgagcaacgtcgacgccttcctcgacgagtgggactcccagccgctcttcgcgcgccgccggctgagcgagcggcgacgcaggggccgggccctggccgatccgagcgggtgggcccacgccttgcgtgcctacggcacgggcagccagcccgacctcaccgaggcgctcgctcactcacgagcgcgcctcgcactcgtcgtcggcacgcgcgacacggcctacgtcgcgcacgcagcgcgcctcaggcaccgtgcgcacatcgtgaccgtgcccaacgtgggccacgacgtgctcgccgaggcgcccgagatcgcccaagggatcgtgctcggactcctcgccgcccggcgcgcaccgacgtcggctccctaagccgcgagccacgctgccagcgcaaaggcgaggccgagcacgagggtcagccgcccggttgcagccagcgaagcgacgagcggacggcccttggcaccgccaacgaccggcgcgatcgcgctcggagccgcgacgagcccgaccacggctaccgcggccaccgcaaccagccgatcggtggcgagccaggttgcgagcgccacggcaacgacggaggccgccacgagcgtcacgaagagcgcgcgagtcgtcgactcgccgagccgcacggccagggtgtgcttgcccgcgagacggtccccgtcgacgtcacgcacgttgttgaccatgaggatggcgctgatcgcaagcccgagtccgatcgccaggatccagccatcagccgggagcgcgtggacctggatccacaacgtcccgagcgtggcgagcagcccgaagtacgcgaaggcaaacagctcaccgagacctgcgtagccatagggtcgtggtccgccggtgtagaaccaggctgcagcgatcgcactcgcgccgatcacgagcagccaccagctcgtctcggctgcgacgaccaccccggccgccgcggcgacggcgaacgaccccagggcggccgcacgaacgtgcgcggggctcgcgagcccctggccgaccaggcgaaccggtccgacccgagcctgatcggtaccgcggataccatcggagtagtcgtttgcgtagttgaccccgacctggagcgcgagcgcgaccaccgccgcaaggatcgcgcgcagcacgacggcgtgatggagatgggccgcgaggccggtcgcagccagtaccggagcgaccgatgccggcagtgttctcggccgagctccagcaatccacgcgcctacctgcgccatcgttcctcccttcgcaccatgccagtctacggaaggttcggccctaccatgagagatcatgtcgtcgccgtccaacgtaggtcgacgcctcgtcgcgctccccgcccgtcaggacgcctggctcgtggatgccatcgcgaccgcgtgggaacgtggcgaggccgtgtgtgtcgtcgacgtctcgtcgccgatggttcgccaacgcctcgacgcgctcggcgcccacgtgcttcgcctcgagtcgtcggagatcacgctcgacccgtcggcgccacccctccatgacgacgcctggatcgtgcaggtcacctccgggacgaccggcgcaccgaaggccgtggtcctcaccgagtccaacgttcgggcctcggcccatgccgtaggtgaacggctcggcatctcgagccacgaccactggaccaccgcgctctcgcccgcgttcatcggcggactcgccaccatcgcccgcgccatcgtcgcgggcgtgccgatcacgctactcgcacgtcaccgacccgagcacttcgcccgtgccgtcgccgctggtgcaacgttgaccacaaccgtggcgagcgccctgctcgagatcgatacccgtccgttccgggccgtcatcctcggcgcccagcccgccaccggcaacctggcccccaacatgcacacgagctacggcatgaccgagaccggctccggcgtggtgtacgacggcgtcgcgttaccgggcgtcgaggcgaggctcgtcgacggcttgatcgaactccgcggacccatgattgcgcagacctaccgcactggcgccccgatcctcggccccgatggatggctcgcgaccggtgatgtgggcgtgctccgagcagggcggctcgaggtccttggacgagccggcgacctcatcaactctggcggccaccacgtgccccctgacccggtcgaggccgtccttcgccgcaccctcgcagaccgcgtcgtcgatctcgcggtgtacgcgacggccgacgatcgactcggagagaccgtgaccctggccgtggtcgccgagcgcccaccgagcccagctgatctgcggaggtcgctcgaaggtctcatcgagaccccatggatcccgcggcgagtcgtcgcggtcacgtcgatcccgaggacggaaaccggcaagccactgcgcagactgttgcctggcgcagtggctcgcacaccacaagcgtccacgaccgacggctccgccgcgtcgatcgccgcggtctcctagtcgacgagcggttctggcgcctcgccgacgtcgtcgaggtgcaccacccgctcctccgggctcggcatgcggaagtagggccggcctttggcccagtaaatggcgatagggatgatgccgagcgcgatggccccgataccgaccaccttcgtcgtggtattgagccctgggaggctctgctcgaacatcaccgccatgaagatcgctccagcgagcggccagagtccggcgaagatgaaatacgagagcttcgtgaacaggagcttgcggtacaagatcaccaccgagaaccctgcaaggccgtagtacacggcgatctggagaccgattgcgttgatggcgtccgacaagacggtaccgacggagccgacgtagttcgacgcgatgagcagcccgaccgagacgacggcaacgacgagcgtggcggccacgggcgtgagccgcgtccgatgcgtacgaccgaggatcgagggcatcgtgccgtcacggcccatggcgaacaacgtgcgtgacacctggatgatcgtcgtctcgagcgtcgcgatcgtcgagagcgcgacggcgacgacgatcagcttgcccccgatcccgggccagaccacctgcccgagcgcatccaggacgtcaccggcgttctggctgatctgatggcccgtgagcaccatgttggtgccgatggtgaacacctcgaacaagatgaacaccacgatgacgccgttgatggccccgagacccggggtgacccgcgatcccttggtctcttcgttgaggttggccgtaacgtcccacccccagtagtagaacgccgccaccagggcacccgcgaagaaccctgccgaaccgtggaagatcgacggggagaaccagtgccagctgaagctcaccaccttggggctgtgcaccagcatcaagatcgcaaagagcaccaagatcgcaagttcgatcgtggacatcgcgacctggagcttggccgtgatggtcaccccagcgatgaccgcaccgaccatgatcaagaacacgacgatgccgaggaacgtcacccacccggtcgagttcgcgagccgctgcgagaacaggccgaggatggtcgatcccgccgggaccgaacctgcaaccatgaagatgagcgccgacaccacgaggcaccagccggcgatgtagccgagcacgggatggagcgcacgtcgcacccacgcgtacgtcgcgcctgcgttcgcctccgatcgcccgaggtagttgaacgcccagacgataccgaacatggcgattccgcagtagagcagggccgccggccctccgagcgccacggcgccgatcagggtcgccgtcgatgctgcgatggagtaggcgggggcgacgcctgcgacccccatgaccgacgagtcgaagagcgagagggcacctcgccgcaggcgatggtggtcccgactgttggcgtgctccagtgaatccatacctcccccttctcgagtccgacgccgaggctccccgaggttccggcgttactcgattcgcggggaattctacgctcgaccatcgaaatcggcaaggatttcacgaattacgcacgaattcgcaacaatcacggccccccgagccgaccgatcgtcagcgtcccgccgtcgacgacgaggttggcccccgtgatccagcgcgcctcgtcggagacgaggaacgcgaccgccgccgcgacgtcggcgggctcaccgatccgccgtgccggcaacgagcgagccagctgcgcctcgagcgcatctacgaggaccgccgcaaaggatgtgcgcaccaggcccggcgagaccgcgttgacgcgcaccggtgcaagctccgtggcgagctggcgggtgagatggatcaacgccgccttggagacgttgtagagcccgatgccgggctcgggctcgagccccccgacgctcgcgatgttcacgatcgccttgtcgtcaccaggcgcgctcgcgaaccgagcggcgagcaatgcgggggcacggacgttgaccgcccagacgaggtccatcgcttccggctccatctgggcgatcggaccgaacgtcgggctcgccgcagcattgttgacgaggaccgacaccgacccgaacgcagcgacggctcgctcgaccacgatggtggcgacctcgggatcgcgcaggtttgccgccacggtggtcaccgcgacgccaccggcgcgcaggtccttctcgaggctcgcgagctcctcctcgcggcgcgcgaccccgacgatcggatagcccttcgctccgagcgtctcggccacgctgcgaccgatcccgcgcgttgccccggtgatgatggcggcacctcgatgcatgtccccacgctatcggtcacgccgagcgctagcctggcatcagtcggcaccacgagggaggcgccggtggggaatcgccttgccaccagcgacagcctgtatctgcgcgatcatgccgacgatccggtcgactggtggccctggtcgagcgactcgctggcgacagctgctcggctcggtcggccgctgttcgtgtcgatcggctacgccgcatgccactggtgtcacgtcatggccgagaccacgttccgcgatcccgcggtcgcagcgctcatcaacgagcacttcctccccgtgaaggtcgaccgtgaggagctccccgacatcgatgctcgcttcatggcggccgcgctcgcgatcaacggcagcggtggatggccgctcaccgccgttgccacgtcggatgggagacctgcctgggtcgcgacctacctcccgccacgctcgacgagtaacctgcccggcctgatcgagacgctcaccacgatcctggacgcgatcgcacgcgacccccgcgcgctcgagcgtgctgccgacgaactcacgcgcgcacgcctcgagcctcgcagtcggcgaccaactgcgccaccgaccgacgagatcacgatgcgcctgcggacggacctcgcacgtcagctcgatcggtccgagggtggcttcggaacggcaccgaagttcccacaggctcacgcactcctcgccctctgggagctcgtgcgcaccggggatggcgtcgagacagtccgcgtgcgagagctcgtcctcgcgagcgtgcgccgctacgccgagagcggtctcgtcgaccacctcgacggaggcatctttcgctacgccgtcgatcgcccgatggtggacgtgcactacgagaagatgctcgtcgaccaagcctggttcatcctgctcctcgcggtgatcggtcccgatcgcgaggatctcgacctgtacttcacgctcgagcgcacgatcgccttcgttcgacgagcgctcgtacgcttcgacggcctgctcgcaacctcgctcgacgccgacgcccacggagtggaagggggcgcctacctcctgcgcgccgaggaggtccgtgccgtgctcggcgacgaggccgcctgggtaatcgacgagcttcacctacctcccgatcgcccccaccacggccaccggatcggcgcttcgacgctccgattggaagggaacgcactcacccgcttcgatgcgctcgccgcatggcggcgcgggcgcggcagtgcgcgacgcgacgacaaggccttgtgcgaccacaacgccgccgtcgcgaccgcactcctcgtcgccggtcggcgctcgggacgcgacgagtggatcgtctggggtctcggcctcgcgcgtcgcgtgcatgcgacgttcgtcgatgcgagcggcgcccgtcacgtcgcctacggcggcgaggcccgcggagcaacgagctccgacgagctgtgggtctcgatcatggccctcgccgcatgggaggtcacgggcgcgactgcttggctcgagcgcgcgcgcacgagcgccagtcgcctcgtcgaacggttcctcctcccagggctcggcatggtcgtctcgagcacggagcctggtgaggccgtccccgaccgcctcgacggcgcccacccgtccgtgagctcactcgccctgtggcacctcacgcggctcgtcgcggtgagcgcggacgaccgcctcgcccacgcacgcagccagctcgccgatgcgctcgccgatgtcctggaggccgcgccggccgcagctgccctcggcgccctggcgatgggacacaccgaccgcgtgcgcaccgtcgtcgtcgcgacccccaacctcaccgaactcgcccgtgtcgccctcgccgctgctcgtccgctcgacgtcgtcgtccgcgatccgacccacccactcgcgaccggagcggctggcgaccgggccgaggtgtgtgttgctcacgcctgcctgctcccgacgagcgatccacgcgtcctggctgacgcgctctggtccacgctcccgtgatgcgcaccgaagcccagctcggccgcgagcggtctcgtccacggagcggccaacccgagctgtgacgccggccgagcctcgacgaccaccgttcagcacgccgactcgacgacctccggcggcaccatcacgtcggcatcacgacccagtacggagccccccagagcaccgtcgactcgccgccgccatcgcgcaccagctagcctgaggtccaccacagtgacctgcggaggagggcgcgtgcatcgttggccgccggtggaagcctgagatgtccacaccgtttcgacatgtgctcctcgggacactcgacgtgcctggccacgaacgcgagttcatcatcctcgaccgggccgaactgcgcctcatccgcgtgatcgcacagcgctcgggcgagctgacgaacttcggctacgtcgtcctcgagcacgagcacgcacccgacgaggcagatccggctcgccccgatctgcgtatcgccgccgaggtctccccgaccgagcaggtcgccaagcgtcgccacctcgtctcgtggctggaacgcctgagcgcgagcgagcgcctcgccccacttgggcacccgggccccagcgtgccgtacgcccgcttcgatgggacccgcccctcgctcgcggtcgtggccctgcgcgatcccacgcttgggcgcggacgcaacgacgaggccgtcctcgagttctcctggggatcccttcgtcagctgatgccggtgaccaaggagctcgaggcgcgactcggtggcgggccgaccattacgcatcgcaagggttggcagcatgcgttcggacgcgtgccgcgcttcgcgctcgccgcctacacgccgccggatcacggctactgccgcaagctcatcgtcacgctggtgtgacgagcggtgaacggagaacggagaggcctatgacccgcataccagagtggttcggccgcctggaccccgaccccaacgcgcccgacgatgtccgcgcgcgcaacgacgccgtcgccgaacggaccggctttctcccgacgatctttggcgccctctcgtggcggccggaggagtatcgagccttcttcggctaccacgatgcgctcatggaggtcccgagcggtctcacgaaggctgagcgcgagctcatcgtggtcgcgacgtcggcgggcaaccactgcctctactgcgtcatcgctcacggcgccattcttcgtattcgggcacacgaccccaccatcgccgaccgggtcgtcgtcgatccagagcgcgcagacctcgacgaacgatcactcgccatcgtgcgctttgccttcaaggtgcgcgacgaagccaacgcgatcacgcccgaggacttcgcgccgctctacgaggttgggctcgatgacaccgacatctggctcgttggggcgatcaccgcgttcttcgctctctccaatcgtctcgccggcttcgcgaagatcctcccgaattccgagttctatgccatgggacgtacgccgcgaagctcatagcgcagcgaagtggcgtcccaccacgtcgtgcactttccgggcgccacgaaccccaagagggcgggccaccgggcgatcgctggcgtgtcagccaacagcgagccagaggagccacgcgagtggccccgacccgttccgactgtacccgcgtgctctggcaccatcagggcaggcgatgacatcgacgtcatccgagaggaggtccagctcgtcctccaagccctcatcgagcaggaggcagcagcagtcatcggcgctcgccgcgaaaacgagacgagggacgccagatgcagcgccacggtgagcgcagaccgtctgctcatcaccaaggccggcacgtggagctgcgtatccgcacggctccgccagaagagcgtgtcccgagcatcggcgagcgctggcgcctgtgtcgatcgtgccctcgacgccttggtcatggaggcctgcgtctgagggcgtcagcacccgcacggtcgatgacctggtcgcggccctcggtgggacgggggtcacaaggagcgaggtctctcgcatcgtcgcaacctcagacgaggagctggcggggttccgtcgccgcaggctggaccatcgctgcgttctgctccctcctcgccgatgccaccgacgcgaagggccgccttgcccaccgggtcatctcccgcgccgtggtgaccatcacgggcgtgcatgccacctgagacgcacgaggtcctcggggtcgtgcgtcggggacgggcagaccgagagcttctcgcccgagtactcgagggagctcaggggtcctgaggcctcggtggtgtgtgcctcgtcatctccgatgtgcgagcgcgggctcaccaccgccatcgcgaggtgcttcatcgggacgagctggcacaggtgccggatgcagcgtgcgcgacgtgctcgctcgcatcgaggaaggggagcctgggagacatgaacctcgcctcagatccgcacgatcgtcgctcgagccttcctcggcagcgctccgtacccaggacgaccaggtcatcgactcccttgccctcgaagctccccgcggttgtgaccgtgctcgccgaggccaaggaggaggtcgctcaccttctgagagcttctcggagggttgctggggaacgatctggtcgacgaacccgctcagagcgagtgaaccatgagatcaagcggcgcaccaacgtcgtcggggacttcggcaacgacgctgctctcctgaggctcgtcaccgctgtcgtgctcgagcagcacgaggactgggccgttgccgagcgacacggccgctaacaggagtgaatggcagagctcggggctgcaacgagccgcgacgacgacacggcgggcacctcgccgacgcttggggcccctggcgctccttgcgtgctggcgtcgctcgccgaggcggcacctgctgtgagaggaggaccagggagtgaactgacaccactcggtgggacgtgatctcgttgcccgagaacctcagaaccgctggcgggccagcgcccagtacggcgccgggcgatccggggtaagacttcccccctcggccagcctccgtggatctgctctggcatgtcgagctccccgcgctctgtgtggtctgccttacgtgtccatgctgatcagagtcctcgcacggcgggtgggctcgatggggcggccagcctgagtggttgcgattctggcgatttctacgattctggcgatttctacgattcttgcgattcttgcgattcttgcgattcttgcgatttctgctacagtgttgtcgtggtgtcaaccaaccaagtcggcaacgaagcctcgaccactctcatgcaccccaggccgggcgaagacgtcgtcctgccccccacggacctcggcccgctcgtccacctggctcggttcctggaagctcacaccgaaccagcgatgctccgtggtccagacggcgagaacatcccactaccacctgaggtctacacggtcttgcgccaggtggtcgaggtcatgcgacagggtaaggctgccctcatcgccccccaaggactactcctcaccacacaggaagcagcggatttcctcggcatcagtcggcctaccctcgtccgactcctagaggaaggggccataccgttcgagaagccgaaccgtcaccgccgcatccgcctcgaacacctcgtcgacttccagcatcgtcgctcgacagatcgtcgcgcggtcctcgaccaactcacggagcaagccagcgagctggggctctacgaggagacggaggccacctacgccaaggcgctgagggaggctcgtcggagcctggccaggaagaagatcgcggactgacgtcgtggctcgctacgcggtggtcttggacgcgtgcgtcctcgtgccggttacgctcgccgacactctccttcggctcgcagagctcgggctctatcggccactctggtccaagcggatcctcgcggaggccaccaaggccaccgtcgaggtccaccccaacatccctcgggaggtcctcgagcagcggttccgcgagatcgagcgcgcattcgaggatgcttgcgtccggggctggcatccgctcgagcacggcttgaccctccccgacccggacgaccgccacgtcgtcgcagctgcgcttgccggcggagcagacgccatcgtcacgaggaacctccgcgactacccgaggggcgccctcgccgatctcacgatcgaagtcactcaccccgatgacttcctcctcgaccaactcgacctcgcgccgaaggcagtacttgacgccatcgagcagcaggctgccaacacgcggcagccctcgctcacgccacgcgatgtcatcgcccgactggcccgctgcggtgtgcccaccttcgccgacaagatcggccgaatgatctgaccgaccggcacccgaaaccgagtccaccttcactgtcgaaccgacattctcacacgaccgctcactggtcccgctccgcttccgtgacgcagagcgcgccggacttctgacacctggtcaataccgcgcaagtccgtcgccgtccgcgacgtcatgctgattcagacaaaccagctcgagccacctcggacgtgaggcctcagtcgaatgagtgctcgagccgggctgcgcctcacgcggcacgcgggtcgtactgtgagccattggtcactcacgcaccgtcgagcgctcatgtctggcgcgacgagccctcgtgcgcgcccgcatcgctttgcaacggacctgcctaggagcgtcccgagcgagatccacgtggtcgtcgatcagcgccgacggatcgtcactcgccgctgcaagccgaacgatgggcaatccgagccgttcgaggcgtcttcgccgctcacgacaagccatccgctcacgccccggagacgtgctctctggtgagtcggcccctaggtgcaaccgaagcccaccacgcgcatgacagccgccaactcccggcgggaggcttcgagtccgtcaggccgtctcgagagcattgccgatacactggcgcggaccagtcggcgcaccgttaacccggccacccgcggcgacggacgacacgatcgccagcaggctcgtaccggtcaatcgagcgcacacgccactcgacctctcccagcggcccctctcaacaccgcgacgacagcgacgaaggccagcaatcgctcccctcccagcacgacgggagctaccagcgacgacgaccccacaacgacgagcgcccgagccgcggcaggatgcgaaacgccatccaccccatccaggcgaacgcaacgaccatgaggagcatcggtcgcaccatccatggtgccgttccaatgaacagcacggcggcatacaccaggagcaccgtcctgagaacgtgcgtccgatggcgacgctgcacccgtacgggagcttccgcagccacggggagcgtgcccggagccgtaacggggggaaggaacgggagcgcgtgcggaacgtcggtcacgagtgcgccgagatcacggtaggtccgcgcgacgtggagatgctcgagtcgctcttcgaactccatgggatcgagccggccctcttgaaacgctgagcgcagcacctcttcgaccgcatcgcggtctgcttgcgaacaccgcacctcgtcgaagtcgctcacgcagccatcgtatcacgaccgctcgtcacgcgtacgagagcccgaaccgaggatctcacggcgacctcacgagacgggccacccgtcacaggcgaggccgcggggcgcaggtagcgtggtgccgtgcgctcgttcgtccacctccacactcacaccgagtactccatgctcgacggcgcgtcgcgcatcaacgatctcctgcgtgccgcagccgccgacggccagcccgccctcgcgatcaccgaccacggcaacctctacggtgcgctcgagttctacaaggccgccacacgcaccggcgtgcgccccatcatcggcctcgaggcctacatggcggggggctcccggttcgagcgcccgcaacgtcgcggacgcctcgacgacacgggcggcgagagcgagcgaggtgagaagctctactaccacctcacgctgctcgcggagaacgagaccggttaccacaacctcatccagctctcctcgcgtgcgttcctcgagggctactactacaagccccgcatcgacttcgagctcctcgaggagcaccgcgagggactcatcgcgctcaccgggtgtctcggtgggctcgtcctccagcacctccttcgcggcgacgaggagggagcgcgcacggtcgccggaacgctgcgcgagatcctcggcccggacaacgtcttcgtcgagctccaagatcacgggctggccgaacagcgccgaaccaacccccaactcctcgagctcgccaagcacctcgggctgcggaccgtggccaccaacgactcccactacacgcaccgcgaggaccacgagacccacgatgcgctgctgtgcgtccagaccggcgcgaccatcaacgaccagaatcgcttccgcttcgagggatcggagcactacctcaagagcgccgaggagatgcgtgagcgcttccgcgaggtgcccgaggcctgtgacgcgaccctcgacatcgccgagcgctgctcgttggagctgacctttggccagccggcgcttcccgagatcgacatcccggtccggatcacgggtgcgacctacgacgagcgcgcaggtgagtacctcgccgagctggtctggcagggcgcgcgggcgcgctacggcaacgatctcgacgagaccacgagcgagcggattcgctacgagctctccgtgatcgagtccatgggctttccgggctacttcctcgtggtctgggacctgatccgtcatgcccgcgaggctcacattcgcgtcggcccgggacgaggtagcgcggcgggcagcgtggtcgcttactgcctcgggatcacccagatcgatccgctcgcctacgacctcatcttcgagcgcttcctcaacccaggccgcaagcagatgcccgacatcgacatggacttcgacgagcgctaccgaggcgagatgatccgctacgcggccgagcgctacgggcatgatcacgtcgcccagatcgtgacgttctccaccatcaaggctcgagctgccgtacgcgacgccgcacgggtccttggctacccgtacgccgtcggcgacaagatcgccaaggcgatgccgccgctcgtcatgggacgagacacgccgcttgctgcctgcctcgagctcacgcccggccacgaggacggctacgctcaagcggcggcccttcgcgagatggtcgagagcgatccggacgtggcgcgggtcgtccaggtcgccaagggcctcgaaggcctgcggcgtcaggacggcatccatgcagccgcggtggtgatctcgcgtgacccgctgacggagtacctgcccatccaacgcaagcccgatccaggccaggatccatccgaggcacccatcgtcacgcagttcgagatgcatggcgtggaggaactcggcctcctgaagatggatttcctcgggctgaggaccctctcggtcatcgatcgcgccgtggagctgatccgggcgacgcggggcgtcgacctcgacatcgacgccatcgccctcgacgacgaggccaccttcgcgatgctgcgcgcgggtgacgccatcggtgtcttccagctcgaaggcgggccgatgcgccagctcatgcgccagctcgccccgagccgcttcgaggacgtggccgcgctcgtggccctctaccgtcccggcccgatggcggccaacatgcacgtcgactatgccgaccgcaagaacggccgcaagccggtgagctacctgcacccagacctcgagccggtgctccgcgacacctacggcctcatgatctaccaagagtcgatgatgcgcgtcgctcagcagatcgcgggctactccctcgaggaagccgacaacttgcgcaaggcctgcggcaagaagatccggaccctcatcgccgccgaacgcgagaagttcatcgccggttgcgtcgcgagcggctacggacccgaacttggtaccgcactcttcgacatcatcgagccctttgcggactacgccttcaacaagagccacgccttcggctacgggctcgtcagctatcagacggcctacctgaaggccaacttccccgtccagttcctcgcggccatcttgacgagtgtgcgcgacgacaaggacaagttggccgtctacctcgccgacgccgcagcccaccacatcgcggtcctcgtgcccgacgtcaacgcctccgacgtcgacttcagcgtcacgagcggtcctgagggcgagcagatccgtttcggccttgctgccgtgcgcaacgtcggggagggcctcgtgcgctcgatcatcgacgagcgcacgcgaagcggtccgttcacgagctttgccgacttcttgctgcgggtcgatgcgagcgtcctgaaccgccgcaccttagagtcgctcatcaaggccggggccttcgactcgttcggacacccacggcgggccctctacgaagcgctcgagggcgcgctcgaacgggtcaacgagcggcgccgccagcgcgaccgaggcctcgggtccctcttcgaagagccctccgaggacgagagcgtcgtcccggatctgcgcctcgacatcggttcggtggagtggagcacgccagagctcctcgccttcgagcgcgacatgctcgggctctacgtctccgcgcacccgatgcacggcgtcaacgtcgaccggctcggacgggacgtcacccccatcttggatctcatcgaggccgatacgcctcccggcgaaccggtgacggtcgtcggggcgatcacagcgctcgcgcaacggacgacgcgcaagggcgacctcatggccaccttgcggctcgaagacctgcaagctgggatcgaggtcatggtgttcccgaagaccatggcagatcacgggctgcacctgaagcaggatgccatcgtcgcgatcaccggccgtatcgacggccgcgaagacggccgcacgctggtcgcgctcgccatcgagcccgtcgatacggccgcgctcaccagtgacgacgcggcggacggcgccactgacgcggtggtgctgcgactgcccaagcgcctcgccgtcccagattcgctcgttcgactgcgtaacgtgctcgcggatcacgtcggcacggcgcgtgcggtcctcgacatcgaaggcatgcgcttcgagctcgccagcaccagcgtccgccccggatcgagcctggtggggcacctgcgcaacgtgttcggagatcaggtccgtgtcgactgacggcccacgcatcgccctggtgggatcgggcgagtacctcccggcgatggcgcccctcgaagcgtcgctcatcggtcggggtcgcaactacgtccagattccgctcgcggctggccaagagagcgatgaacgcttcgcctactgggtcgacctcggacgtgagcaggccgcgcgcctcggcgtcacggcgcacacggtcctcgcacgctcccgagccgacgccgacgaccctcgctgggcacgtctcgtcgccggtgccgatctcgtctacctctcggggggcaacccattccacctcgccagcagccttcgcggaagccggttgtggtcggcgatcgtcgacgcgctcggtcgcggtgtggcgctggcgggctgctcagccggggcgatggtgctcggcggcctcatcggatcgctgcgctcacccacgcagcacgccgagcccgggctcggtgtgctgccggggaccagcattctgccccacttcgatcgagctcggcattggatgccgaccgagctgggggccgtcgccggcgccgaacgaacgatcggcatcgacgaactcaccgcgctcgtcggcgagggcacgacgtttcgtccctggggaaccgggcgctgctgggtcgtcgaggggacctcgacgacaccgatctccgacgccatcgacctgcccgtcgtcatccccgccacgtagccgcggacgaatcgctcagtggtggaaggactcccgcacggtcggatgcactggcggcggggtcccgtggcgctcgagcacctcgacacactcggcgaggtcatcgaggaacagcgttgccatgtccgcggagaactcgctgcgcaccacggcgcgcatcaccgtgacgtcgctcatcgcatcaggcatgggataggccggcacctgccacccataagcgcgcagctcgtgtgagaggtgattgaggtcccacggtcgcacctcacctggccgcagacgccacgccacgacagggatgtcacgcccgtcgccgatcacctcgaacggtccgagcgatgccagctcgtcggcgatcatgcgagcgactcgttgggcactcgcgtgcacggcggtgaagccctcgcggcccagtcgcaagaaggtgtagtactgcaggagcacctgcgcccccgggcgagagaagttcagcgccagcgtcggcatgtcaccgccgagataggcgacacgaaagatcagctcttcgggaacgtccgtcgcttggcgccatacgacccagccgagtccgggatagacgagcccgaacttgtggcccgatgcgttgatcgagacgactcgcggtaggcggaagtcccagtcgagctgtggctcgaggaacggcgcgacaaacccgcccgaggcgccgtcgacgtggatcgggatgtcgagacccgtacgctcgtagagctcgtcgagggcacgcgcgatctcggcgaccggctcgtagacccccgtgtacgtcacgccaaggatcggcacgacaccgatcgtgcgctcgtccaccgccgcgagtaccccgtcggcgtccagcgtcgggtgctcgggcgtgaccggaacgtaacgaggctcgacctcgaagtagttagcgaacttctcccacaccacctgcacggcggagctcacgacgatgttcggccgatccgtcggcgcccccgtggcgcgacgggcgatctgccaacgccgcttgagcgcgaggcctgcgagcatgcacgcctctgacgaacccgtggtggagacaccgatcgtggtgtcgggatcgggcgcatgccacagatcggcgagcatccgaacacagcgaccctcgatcgctgccgtctgcgggtactcgtccttgtcgatcatgttcttgtcgaccgcctcggcatagagacgatcggcttgcggctccatccacgtggtcacgaaggtcgcaaggttgaggcgcgcgttgccatccatcgcgatctcgtcgtgaatcacctggtaagcgaggtcgggaccgagaccatcgctccgcagccgtgcacgtggtacaccctcggtgagctcgcggacgaagagcggattgatcgggaggtccttcgagaacgtgtgtcgccgtggtgacgagtgccgtcgagccaacctgatcatctccttcggtcatccagcaggcaccgcccggtgctcccgatcacgtgacgtgagaggcgcgagcaacgctggaacccgctgcgaccctagcaagcccgtccggtgccggtcggtcagtgcgtggtcgatggcaggccggaccttcagcatgcgagcgctgcgccctctgcgcgatcgcggcccgcagccacggacggcaccgtgcgagcggccctgtgagcgcggcgcgagtcacgcaccggcgaacatggccgggagccgtcgtcgcgcggcgtgcgagcagcgtggcgagagttcaccgacgacaagccaccgctcacgcctcgtgatcgccgcggcggccatggacgtccgtgacgtcaccgacgtctcatgctcccctcgccagttcggcctggatccgggcaaggacctcggggtcctcgaggccggtgacatcaccggtcgccttgccatcgacgaccagttcggcgagcaggcggcgcacgatcttgcccgatcgagtccgcggcatcgtcgacaggacgtacaccgcgccagggcgcgcgatcggaccgatctcgcgctcgagcgccgcagcacacgtggcctcgtcgacaccggtggcgccggcggcaaccgtcacgaaggcgacggggacctggcccttcagtgcgtcactgaccccgacgactgccgcctcggccacacccggtacgaggaggagcgcactctccatctccatcgtcgagagtcggtgtcccgcgacgttgatgacaccatcgacgcggccgacgacccagacgtggtcatcgtgatcgaggagggcggcgtcggcggtgtcgtagcgttccgcaccgaagcgcgtgaagtactgcgcccgatagcgcgccggatccccccagatcgaccgcgccagcgtcgggaacggcgccgtgagcagcaggtagccgactcggtctcgacccaccgttgcgccttcatcgtcgacgacgtcgaaccgatgaccagggagcgccatcccgcacgacccgggcttggcgggcgtgatgcccacggcactcgaggtccacgccgaaccggtctcggattgtccgtaggtgttgttgatctccacagtgcccgtgccaacgtgctcacgcacccagtgccaggtcgtcgcgtcgagcggctcgccgacgagcgagatcagacgcagcgacgagagatcgtggcgctctgcccagctcgcgcccgctctcgcgagcatgcgcaagaacgtcggggcggtgaagaccttcgtgacgcggtagcgctcgatgatgtcgtaggcgcgatcgggctccggatagtccagcgcaccttcgtaggccagcatcgtcgccccggcggcgaggccaccgacgagctcgaagatcgggaaggtcagccatccggtgtctgcggtgcaccagtacacgtcctccggcccgaggtcgagcgcccactggacgttgtggtaggtcccgatgagaaagcccacgcctgcgtgcacgagccccttgggtttggccgtcgtgcccgaggtgtaaatgatgaagcccggctcgttcgcctcgaccggcaccggctccgctccgtccggatgcgcggcgatgagttcgtcccatgcgtgatcgcgccccggttgcatcgggacctcaccgtcgccgagccgacgcacgacgatgacgttgcgcaccgacggcaaccgatccaggatgccgtccaaggtctccttcaatgggatacgccgcccccggcggtaggtgccgtctgcggtgatcaccaccttggccccggtatcgacgatgcgatcgaacagcgcttgcgccgagaagccagagaagatgatgttgtagatggcgccgatccggtagcacgcgtggaccgcggcgaacgtctcgagcaggttcggcaggaagatcgcgacgacgtcgcccttcgtcacgccgagatcagtgagcgcggccgccatgcgtgcggtctcggaggcgagctcctggtacgtccagctgcgctcggcgccatcctccccgatccaccgaatcgccacgcgctctggctcgcgcctcgcatggcgatcgatgcagttcacgctcacgttcatacgagccccggcaaagaaccgaaatccatcggcaaggctgccctcgagggcgggggcttcgtcgaacccatcgatccactcgaacgtggctgcaaccgaacgccagtagcccccgagatcctcgatcgagcgttcgtagagcgctcggaactcgtcgacgttcgagaccggcagtcgaccagacggtgacagggacggctccaccagttcggcggttcgcaccatcgggggtagctctggcattggctcgctcatgggcagcacctccctcgctccacgctgggcggatgttaccacggcacggcacgcgcggcgaggacccggggcgcgacgcgccgtgcgaggcaggcggccgcggcgaccgctcgtggctcgctggtcgcgaggaactccacgccgagcgaccggtccccacgtcgtacggggatgctcgtggctgcaagcttcgccaggttcgccacgtgcactcgacccacctcggtggtgtcgtcgtccgtcacgacgacctcaccagctctcgtcctcgccccgctcgacccgacggtgctcggtgcaagcagcgcgtcgaactcgccggccacccgacgcacacgcgcgctcgccgctcggaccgcgttctcggcggctacgaatgccgccacgatgccggtcgcgacctcgcgagcggtgcgctcggtctgcgtcgttgcgatcgcctcgagcgcgcgccgtgcctcgacgagcgaccaccacggtgcgcagaacgcgtcgtcgacgtcgatgcattcgaccccgtccgcttccagcgcggaggcggcctcgtcgaggactgcgtcttcgtccgtgcgagcgcgtccgggcgtcacgcggccccagaccccgatccgcgtcggacgccactggccgagcgtgaacggggtgaggagccgtccccgcccctctgggtctcgaagcacatcgatggcccatgcagtctcggacagcgtcgcggcgacgacgccgtcgctcaggcgctcggcgtcaccgagcacccacggtcgcacgtgcacgctcgcgagtccgacgtcggctgctgccacccgcagcgacccgagggcatcggggaccaacgcgagcgggaccgcaccgagtgcgacccggctcaccgcagcgtcgaggacacgggtcgcgcaagactcgtccacgacaccgggatcctcgagagcaggaagcggccccgagcccgtcgtcgaccacacgcgaccgacaacgacggctcccagactccgggccctcgcgacgactccctcgccatctgacagacgagcatcgacgagcacggggacaccagcgagcgggcgagacggcgacggggcgacaccgtcgagcgcacgagcctcctcgagcgccgcgtcgtcgagcgacacagcgatggggtcggggcgttgctcgagggagcgaagctgcgcgcgagaggcaacgacgacctcgctcgcgcagcgacgtcggtggacgaggtcgtcgaggacctcgaagagcacgtgctcgacctatgcgccctgaatcggcgggaggctgccgtcagcaaggccctcggccatcgcccagccgaaggcgatgagcacgtcggcgtcaccctctttgcagcaggtgaacacctcatcgaaacccgtcggcgtcgcgtccgagagacggtagaccacgaaaccgaccggccgctctccgctcaccgcacccgaggtgcggtcgtcaaggccagaatcgagcccaaagcgcttggcgagccgtcgcgaccaggctcgctcctctcctgtcggacgatgcccgggtcgcggaaccacgtcctcaagaccagcaagcaggtcgtagccggtcggggagccgagcttggccgcgacgagcacatcctcgtcagggaacgcgagcagcgcgcgctcgtaggcctcgtggagcagactggccaaggtgaggggctcgtgctccttcggcgtcgtgaccgccagctcgatgagcacgcagggcgtgccgccgatacgttcgagggtgaagagcatcccgccaacgagctgctcatcatcggcggcgagggcacagagcacccacgcttctcgctcggcctccaagaactcaggggtcaaggtcacgccgtgcgctgctgccagcgcaccgagcgcgtgcagctcctcgtccgtcagtgcggtgcaatccttcgtgatcgtctcgatcgccatggcgctcctgctccctcgagtcgacggcccctccagtttacccgccctggcgtcgcggcgagggcgatgccacccgcgccgtaggctgggatcgtggacgactcgatcacgctgcaggcactgggttcatcgcggcagacgtatgcctacgacgaccctgacccatctgtgctcgagaccttcccgacgccacagccctccggcgggctcgtcatccggctcttcgccctcgagttcacgagcctgtgtccggtgaccggccagcccgactatggccagctcgacatcgtctacgtgccggggcctcgttgcgtcgagtcgaagagcctcaagctctacctcatgcgctttcggaaccacggagccttccatgaggcctgcgtcgcgcaggtcgcgcaggatcttgcctccgtcctcgctcctcgctatcttcgggtaatcggccgcttcaacgcgcgcggaggcatcgcgatctggccgctccgtgaggtcgtcgccgaccacgaggacccggctgccctccgagcgctcgtcgatctggacaacggagcgcgtccatgagaggcatcgatcgatcgcgtctcgcactcgccatcgcgggtgcggcggtctacgtgggatccatcgtcctcgccaactggatgctgctccacgtcggcgctccgggcccgggggcacgtgtgctccccgtgggcttcgggctcgaggccccgagtggggtctacgtcgcagcactcgccttcatcgcgcgcgatctcgtccagcgctacgcgggtccgagggtcgccgtcgcggccatcgtcatcggagcggcgctctcagcgctcgtctccacggcgacgctcgcgttcgcatcgggcgcgacgttcctcttgtccgagtcgaccgacttcctgctcttccaaccgctccaacgtcgcacgctccccggcgcggtgttcaccgctggactcgcagcgatcgtggtggactcggtggtgttcctcacgctcgcaggcattccgctccacgctgcgcttccagggcaactgctcggcaagttctggatcgtcctcgtgggcagcgccgccaccatcgggctgcgacgcgtgacccccgcaccgtcgcttcgtcctcgcgccgcgtcatgaaccacctcgaccaccgtcagcgaacgctcggcatcatcgccctcgctggtgcctcggcgatctggggcggcatgtacgtcgcgaccgccgccctcatgcgccagaccccgccactcgtcgtcctcgagctgcgcgaggcgatcgcaggtttgatcctggttccgatcgcatggcgatcagggcggttgcgcatcgctcgcggcgacctcgcccttgcggcagcgatcggcatcgtgggtttcaccgtctcgatcggcctgcagctcgaaggcacgcacatcgctggggccgcactcggttcgctcatcaccgcatcgtcgccggtgctcattgcgctcctcgggagggtctggctgcgggagcgactcccatggcccaagctcgtggcgatcctcgtcgccgtcgggggtgtggcgctcatcgccggccatccgccagggggaccccaggtcgagcccgggatcatcgacctcgcaggggcggccctcgcttgggcgatctacacggtcggatcggcgcacctgacccgccgctacgacgccctcggagtcttggcgatcgcctgcatcgtcggctccgtgacgagcctccccttcgcactggcgtcggccagccacgcagcgcatccgctcccgacgacgctcgtggcgtggctcgaagtcgcctacatctccatcgcaggaatggcgctcgccttcttcctctggaactgggggttcggtcgagtcgatgccgccgtcgggggatccatgctgctcttccagccgctcgtgggcgtcgtcctcggcatcgtactgctcgcagaaccgatcactctcaccctggtgttcggcggcttcctcgtcgtcgccggcgtctcaggagccgtggcgatcgccacaccgagagtccagcttgcgacgaacgcgtcacctgaggcaccccagtcggggattcgcacgtagccgtcaccccgtcaggccccgaccacatgctcgaccgagttcgcgacgctcgcgagaccacgccggagcgggtacggccctggctcggagcacatcgtccttgtcagcgagatcggagccatctcgcacgagcaggacggaacctacggcagccccaggatgacccacgagatgcgactcgtggcggctgcttcttcaaccaccagtgcccgtgaccggccctgcgaccgagtccaccctgaaggcgagacttgacgccctcccgccacggctcggtcacggcgggcgccgatgaccgagagcgcgtcgagcctccgactcccggacgcgaggatccgtcgctgggtggcggcgtcggggtggcagcgcgtggccgagctgaggcaggcgacagatccgtgggctcgcgtcgtgttggcgcgatgccgttcgtgtgcgacgagcgcccggggctcctgcacggcggcggacggtccccgtcgagcacctcctctcggacctgggcgttcagcggcttgcctcgcagaggccgcgctgccacggcgatgcggcatcggggagccacggagtcaccccgagttccgctgctcagtgagcgagcacgcccgcgacggacaggcgcaaggtggagagcgggtcggagtggccaggtcggacggccatgttatccgtgacgaagcggaccgtgacgcccttgtcattgagctgggggacgagggctcgcaggtcgtcgaggttgcgcgccgaacgatccagcgagtggacgacgacctcgtcgccctcgcggaggtaggcgatgaggtcgcgcagggccgggcggtcgacccgagcgccggagacgtggtccacgaagacacggtcggtgtggacgccgaccagctggcgctcgaccgaccgatcaaccgaactcacatgaacgtagccgacgacccgccctgaggcctcgctcacgagagcgcgcctaccctcagcgtgagccaggagacgagtgccacggtcgggagtggacggtcgcggcgacgaaggctcgcaggtggtgggccaacgtctcacggtcgatggctccctcggcgaccttccagacgaggtcctcgagctcgttgtcggacgccagcagcacgtggccgttgagccggacaaacagctccgtcgtcacgaccgcacagcgcttgttgccgttggggagtgggtggttggcgaccaggcgctcaagcagcaccgcggccttggtaggcacggtcgggtaggcctccacgcccccgaggccggctcgaggcgctgcgagcgctgagtcagcgagttgacctgccgggccagcgaggatcgaccttaccgtggcctcgtcgaggccgagcgtggcctgcacgacgacggcgtagtcggcgaggtcgaggtagcggaccgtcacatcgtggcgaggcgctcgaggagccccttgcgctcctcgatgatgcctcgtagcatcgccaagtacccggggtcggcgcggcgctcgcgcgcacgagcgatgacgtcgtcgatggtctcgacgggcctgggtgcagcctcgacacagcgggtgaggtcctagctggccatgatcgaacacaccccctccctgcgccgacgtccgccaactcatcgagccgatgtcagcacaccgtagcagaacgagctggggggcgtcggcggctgctgtcgcctttggtctacaacatcgccgcgacagctgtcgccacaggaggagtgaatcccacggcgacaggatcccgtggggagcgcgagatcgcggccggtacaccctgaggcgacgtcggtggaagctcattgctgggggcgaccatgtcgtcgacgagtttgcataccttggtcgagcgctcgaggcggtagtcaagttccgaccacgcctcgccaagttcctcggcgcgtcggccctggtagctcttgatgaagcgcccgacgcgggcgtcgaactggatgcgatcgccaggctggagctcgaggcgcgcgagcgacgcgccgtacgtgaaccagaggtggtccgtgactacctctcccgtcgtgacgagacggacatcgaggagcagaatcgagcgctctggccccatccagccaggtttggagtcgaagagccctacgtcgcctcaaagcgtgatcgttgtccgacgtgtcgtgccagtcgttccctcgtgtccgtcccattagggcgggcctggcctatatctccccgggcaagaccgatgcgctcgctgcgcggccgtcctcagggatttccatctgcgtccagggctcgtcacgcacactctcgcgagccacgaggtcaaagagggcgtaggcaagggcgcagagcgcgtagcgggcgatcgtgcaagcgtcacgtgtggagcgtggcggcacgacgatctctgccgcgttgtcatcaagcacgccaacggtgatcgcgtcgtcgtccggtcgctcggcaatcctcgtcgtgacgaggcgctgggtccactcaccgaacacgcgacatgcgatgcccgcctcgtcgcagagggcctcgatcgtccgcgcaccgtcgagatcgatgtgctcgacgtagcgaggcgccggccagaacgaggtggccttcttgcgctccgagttcgacgagtgcggcaagagccgctcagcggtagaccgcgcgctgcgcgccctcgtcgacgaggaggtgctcgtgcgcggcggctggggcatctacgtgcgcgcgaggcgcgtcgggcatcgctgctcgcgccgaccggcacgatcggggcatctacgtgcgcgcgaggcgcgtcgagtacttcggcaggaccggcatcggcacggcggtgatcttcgatcgccggtaccccgaggtgctcgccaagctcggtgtcacttgggaggccgacagcgcacgcaaggcgtacaacgaggggcgcaccacccaggtcccggcctggaccgcggtcaacgtcggccgccagcgcatcaccaggcggatcgcgttcgggaagcgagtgttgcagtatgagcggaccacggggactcgacgacggaacgtggcgagcgctcgaggaggcgcgagcgaacggtcttcttccgctacttcctgagttcttcgagcagaactcgcccgtctgaacaggaccatcgacttccgggtggtgctgccggacgacctgcccggcaccaaccactgccgcagctacacggtgtgctggaatacggcctgctcgagccgacggaggcgctcggcgacgctcagctcgccccctccctcctcggtgcggagccgatcgagtgcccagatgcggagcagcgtggagactggtaggtgctcctgagcggcggcccgttggagccgggcatgctcgtcagcggacaaccgtaccgacaccacggttgggcgagtgaggttgggccgtgcgaccgtgatgtccgtgggcatcgtgtcggcgaggtcgtgctgctccgccgctgccccctcttcagccaggatttcctcgatcttgctgctcatcggtcctcctccgcgtagatccgtcgatctcgtgggcctgcgacccaggcgttggcgccccaccactccccggcaggccgctccgtctcgtcgacgtcggcggcgaccaggatcacaacgaggacatctcgagcgctcggcgagtagccgatcactcgtaccgatcgaccgctccggctcgcagggtccggcgtgagccagaccgcatggtcctcgttgatcgcttcgtcagcccagcctggttcgatgccgtggcgtgagcggatgtaggcggctcgcttctgccagtccactcgcaccacacctacatagtactacactcgactacgcttggtggctcggcgccgaccgtgagaggacggttgtgaggttcgcggcagcagtagcacccgctcccagggagcggctcggaggtcgtcacggcgcagctaccactcgtagagtggcgtcccaccaggtggtgtaatttccgggcggcctgaactccaggagggcgggccaccgggcgatctctggcttgtcggtcaagagctcgccagaggaggtacgcgagtggccctgactctttccgacttcacccacgtgctctggcgccatcagagcaggcggcgacatcgacgtcatccgagagggggttcagctcgttctccaagccctcatcgagcgagaggctcgagcggtcattggagctggccgcgacgaacgaggcgagggacgccagacgcaagcgcaacggtgagcgcgaccgtctgctcgtcaccaatgctggcgacctggagctacgcatccgcaaagctccgtcgggggagcgtgtcccgagcatcggcgagcgccgccgcctgcgtcgatcgcgtcctcgacgtgcgtggtcatggaggccgacgtctgagggagtcagcacccgcacggtcgacgacttggtcgcggccctcggtgggacggggatctcgacaagcgaggtctcccgcatcatcgcatccctcgacgaggagctggcaggatttcgtcgccgcaggctggaccatctctgagttctgctccctcttcgccgatgccacctacgcgaagggtcgcctcgagcaccaggtcatctcccgtgccgtggtagtcatcaccggcgtgcacaccgccggggaccgcgaggtcctcggggtcgtgcgtcggggatgggcagaccgagagcttctggaccgagtgcgagagggagctcagggatctcgggcctcggggtgtgcgcctcgtcagctccgatgccagagcgcaggctcaccaagccatcgccaggtgcttcgtcggggcgagctggcacaggtgccgagtgcagcgggcgcgacgtgctcgctcgcatcgaagaaggggagctcgggagatggacctcgcctcagatcccaacgatcgtcgctcaagccgtccccaggagcggtacgtacccgctacgaccaggtcatcgactcccttgccgcgaagctcccagcggttgtgaccatgctcgccgaggccaaggaggaggtctgcaccttcacgaacttcccggaggcccattggcgaacgatctggtccacgaacccgctctgagcgggtgaaccacgagatcaagcggcgcactaacgtcgtcggggtcttcggcaacgacgccgctctcctgcgccttgtcaccgctgtcgtgctcagccagcacgaggagtgggccgttgccgagcggcaatacctatcacaggagtccatggccgagcttgtgactgccacgagcgacgacgacacggcgggcacctccgagacgcctcggccccctagcgctcctcccgtgctgccgtcgcccgccgaggaagagcctgcagtggtaggctgagagcggccagggaacggatttacaccactcggtgggacgtgatccatcgcaccctgctgtcgcatctggtccgagatttcaccgcgatagctgtcgccacaggaggcgcagatcccacggcgacaggatcccgcggggagcacgggattgccccgccggtacgtcaggagacgaagccggtgggcgcgtcgagatggcagcttcccgggtcgggcgtgatccgggagggggcgtggggaggtcgtcgggcgaggatgcagcagtgctcgtcgctgcgcgaccagtcccgcctcgtcgaccaccacgactcggacgcacgcaggcaatggagtctcgaggagatcgaaaccgatgggcgaccgaacgcgaccgctcgacccggcctcaccgattgagcgcaccagagctgcctaggccttctccggggttgcgttcctactcatcgacgagaaaacgccacgcgagctcgcccccgcggctcagcccgattcggccagtcgccagaacacccgtcctgcgttcgtcggccggctcgaggtcgaccgccccgccgagcacgaggccattgtgctcgcccgtcatgccgagcgctcgtgcgacccgccctggaccgagcactcgacgcccgtcgtcgagctcgatgccgcgcacgaggacggcacctggcactccttcgggtgccacgacgatgttcaccaaccagtgcaccccgtagcacaggtacacgtagaggtggcccggaggaccccacatgatctggttccgcggtgtcgatcctcgccacgcatgacttcctggatcctcagcgccttcgtacgcctcgacctcgatgagtcgacctgcgccgagcggcccgacgagacgtgcaccgaggagccgcggagcgacgtcgtgtgccggaccctcgagcagctcacgcagggcgcgtgtgcctgagtgcatggaggcgctcccgacgctcgccgagccggacgcgcagctcgtcgagctgacgccgcaccgactcaagactcgccatcccgttcgcgccgcgccgctcgatcgcctcgtgagcctcgatgaggcgcaccgcctcctcgccgagctgcggatgcgccgccacgagctcggcgagcgcgacgtggcgctccagcgagtcacgcacgagccctgccgccaccgcatgcgcacgtcgaaagggcatccctcgacgtaccaggtactccgcaacatcgatcgcttgcaggtaggccgatgacgccgcctgtcgcatggcgtcgaagtcgaacgtcatcgtcgcaagcagcccctgcatcgccgacagctcgaggcggaactggtcgaccgcgtcgaagagcggctgcttgtcctcctggagatcccggttgtaggtgagaggcaaccccttcaagacggtcaggatggtcacgaggtcgccgatgtagcgaccggccttcgcgcgcgagagttcggcgatgtccgggttcttcttctgcggcagcatcgacgagcccgtggcgtaggcgtcgtcgaggcggatgaagcgaaactcctcggtggtgaagagcacgatctcctccgcgagcctcgacaggtgcacccccgccatcgtgatcgcaaagatcccctcggcgacgaagtcccgatcgctgaccgcatcgacgctgttcgcaaacgaacgcgagaacccgagccgggccgcaacccacggtgggtcgagcggcaaggtcgaacctgccagggcaccggcaccgagcggcgagacgtccatgcgcacgagtgcgtcgagcactcgggcgatgtcgcgctcgaccgcccaggcgtgagcgagcaaccactgtgcgaccgggatcggctgagcgcgctggagatgcgtgtagcccggcatcactgcgctgcccgcactctcggcgagctcacgaagcacgtccgcaaacccgatgagccctccggcaacctctgccagtgcgtcacgggcccagagccgcagatcggtcgcgacctggtcgttgcgcgagcggccggtgtgcagcttggcgccgacgtcaccggcgagctccgtcacgcgtcgctcgatggccgtatggatgtcttcgtcggaggggaccacgacgaaggtcccctcgccgagttcggcctcgacggcccggagcgccccgagcagcgtctcgagctcatcgtcgtcgagcaagcccgcgtggtggagtccctcgacgtgtgccctcgagccctcgaggtcctcgcgccagagacgctcgtcgatcgagaggctctcggtgaacgagagcagggcatcggcgggcggcgcacccatgcggtgctgccagagcgtcacggccgcagccctccctggcgttcggcccaggtacggatcccgagcccgaagatccgtacgaagccctcggcgtcaccatggcggaaccgatcctcgctggcataggtcgccagttcgtagtcgtagagcgacgaggggctgcgacggccatccacccagaacgcgttcggcgcaaagcgcacccgcacctcaccggtgacgggcttggacgcttcgtcgatgaaggcgtcgatggcgtgcttcaggggcgagaaccacagcccatcgtagacgagggttgcccaccgcagaccgagttcgatcttggcgtgcgccacctcgcgctcgagggtgatgtcctcgagctgccggtgcgcctcgagcaacacgaccgcggctggtgcctcgtagacctcccgcgacttgataccgacccgtcgattctcgaccatgtcgatccgaccgacctgccacgatccggcgatccggttgagacggtccacgagagcggcgagcggcaggcgctcaccgtcgagcgacaccggcacaccctgctcgaaaccgatgacgacctgatcggggagcgacgcaaggccacctgcggtgtaggcccagacgtccgatggtggcgccgcccagggatcctccatctcaccgcactcgaccgcacgaccccagaggttctggtcgatggagtatgggttctccttcgactgggtgagggtgaccccgtgcgcgcgcccgtactcgatcgtgtcctcacggttcatgccccaatcacgcacgggcgcgagcaccgtgagatcgggagcgagtgcggcgagcgcaacctcgaagcggacctggtcgttccccttgccggtacagccgtgcgcgacggcgctcgcaccgtagcgccgggccacttcgacgagccgctccgagatgagcggacgcgacagcgacgagacgagggggtagcgattctcgtagcgcgcgtccgccttgatcgcacgcgcgatgtagtcgtcggcgaaggcgtcacgcgcatcgaccacctcggcggcgatcgcgccggtcgcgagggcgcgggtccgcaccgcctcgaggtcttcctgctggcccacgtccaccgagagcgcaacgacgtcgaaaccacgctcgacttggagccacttgagcgccaccgacgtgtcgagaccccccgaataggccagcactaccacttcagccacgagtcgactccttgctgttccgtcttgtcttcgtcctgtatcgagcgcgctccgtgcgacctggcgccacgaccaggtcgatcccgtcgatcgatccgagcagagccgacgcgcgcagtcacgggagccagatccgcgccgatgcccgcgtcagcctaacctctgggttcgcccgggagtccggcgaggttgtgcagcaacgcggcgacctccggggcggtcgagccctgcgacaccacgatgagcagggtgtcgtcacccgccacggtgccgagcacgccatcgggcttggcgcgatcgagggcagcggcaacgacatgcgcgcaccccggcggggtcttggcgagcacgagatccctcgcaaccgcgacctccacgagccactccgacagcacgcgacgaaggtaatcctccgacgtggtctggtcccgcgggagatccgggatggcatagacgctctgaccctgcggaccacgaaccttgatcgcgccgagctcgtcgagatctctcgatacggtcgcttgcgtggcggagatgccctcgacggcgagtaggtcgacgatctgctgctgagagctgatcgcctgctgactgatgagcttcgcgatccggtactggcgctggttcttcgcgaccatggcgatcaccaccgctcgatcgagccggagccggcacgatcgacgaggaacgccaacagtcgcaccatggccgtcacgcgatggccggcctgacgaaaggcccacgagtgcgggccgtcgaggaccgacgcctcgatctcctcgccacggtgcgccggcaaacagtgcaagatcccaacctcgtcgctcgcctcggcgaccaacgcctccgtcagggcccagccctcgaaggcgctgcgtttggccgggtcctcgcccatcgagacccacacgtccgtggagagcacatcggcaccgcgtgccgcactcgtcggcgagtcgaacagcgcaatcgccccccgcgcccgccctgcacgctcgaggtaggcatcgatctcagccatgtcggcctcggagaactgaaaccccgccggcgccgcgatgcgcacctcggctccgagcgcgccagcggccttggccagcgatcgagcgacgttgttcgcatcgccgatccacgcgatccgcacaccctcgagcgtgccgagcgcctcgtggatcgtgatcacgtcggcaatggcctgagtcggatgcgcgcgatcggtgagcaggttgacgaagggtcgctgatgcccagcgaacctgggagccatccgctcgaacgtggcgtgacgacgaagacgcgccccaaccacccgatggtgacgcgccagcacctcggcgacgtcctcggccgcctcccgcgtatcgatcccgatctcgtcgccggtgaagaacacgggcgtcgccccgagcgcagccgcagcgacgccgagcgccgagcgagtgcgcatgctcggatgctcgaagacccctgcgatggtgccgcctcgaagcggcccgctcgctgcgaccgcctcggtgacgaggcgccgcatgtcctcgggagcaaggtcgtctacgtccccgaccacgagcgacgtcgcgcgctccatgttcagacctcctccaggacacgggccagggcacgaccgaggcgggcaaacccctccgcaagctcgtcggccgtgatgatgagcggcggcagcagccgcaaccgcgtcggaccggtggcgttcaccacgacgccctctgcgagcgccacgtcgacgacgcgcgctgcgaccggagcggcgagttcgaggcccaacatcaggccagagccctcgacgagccgtaccccaggcagcgcccccgccaacgcgacggcctcgtcacctcgcgcgcgagcaagcgcgggcgcgtcaaggcgaaccagctcgttcgccaccgcctcgacgaccgccatcgcgagggcattaccgccgaaagtagagccgtggtctcccgggcgtagcgcctcggcgaccggcgcacgggccacgaccgccccgaccgggtacccgttgccgagtgccttggccagcgtgatcacatcgggctcgagcccgaccacctccgaaccgagccacgcacccgtacggccgaggcccgtctggacctcgtccacgacgacgagcgcgccggagacccgccgtgcccgctcgatcgccgcgatcgccgccgctggcagcggatggacgccggcctctcccgcgatcggctcgacgaccacggctgccgtcgcctcgtcggcgacctgcgcctcgagcgcagccgtgtcgtgcggatccacgtgcacgacgtcgggcaccagcggctcgaacggcgcttgcttgtcgggctgacctgtcagcgagagcgagccgaaggtacgcccgtggaacgcgccggtcatcgcgaccacgcgggtcctcggagcgcgcgcacgccggacgagcttgaacgccccctcgaccgcctcggtccccgagttggcgaagaacaccgacgcgtccccgagcgaggcgagcggcgtctggagcgcggcgagcgcgcgctcgcgcgcgtcagtgtcgaagtagttcgacgcgtgccacagacgcgcagcttgggccccgagggcctcgacgagacgcgggttcgcgtgaccgagcgacaccacggcgatgccggcaagcaggtccacgtagcgctggccgtcggcgtcgatgagccaggagccctcgccacggacgaaccgccgcttgggctgcccgtagacgccgatgagcccgagcctcgtcatgacgcgctccgacggatcatggttccgacccccgcatccgacaacaactcgacgagaagcgcgtggcgttcacgaccgtcgacgaagtgcacctcgtcgaccccggcctcgagcgcggcccgtgcggcagcaagcttggggaccatgccgccccgtacgctgcccgagctgagccaatcctcgagctcgccgagggtgagttcggagacgacgctcgccggatcgtctgggtcggcaagcaggcccgggacgttcgacaagaacacgagcttcgtcgccgagagcgccggcgcgagggcggcagcgaactgatcggcgttgacgttgagttcacggccctcgtcgtcggcggcgagcgacgccacgatcggaatcatgccgtgtgcaaccagcgcctccacgaggtcggcacgcacctcgaccacctcgcccacccgaccgagcgacggatcgacgacacgcgcacgtgcgagcccaccgtcgacgcccgagaggcccacccctctcggcgctccggagacctggttcacggcgcgcacgatggtggggttgacggcaccgagcaggccgagcctcaccacctccagcatcgcgtcgtcggtgaccctgaggccgccgcgacgctcactcgacaccttgagtcggcgcgcgagatcatcgatctgcggacccccgccatgcacgaggaccgggtggatcccaacgtgagcgaggagcacgagatcggtagcgagcgaggcgagcgaccccgcctcgtcgccgagcacgttgccaccgtacttgatcacgaccgtgtgacccgcgaagcgctggatgtagggcagagcctcgacgaggatcggggcgcggagacgaggatcgaggtcgatcacgaggtcctccggttctcttcgaggtaaccgtgaccgatgtcgctggtcaagacggtggcgctcgccgatccacgcccgagtgcgacggcgaggtcgacctccggttgggccatccgccgcgtgagctcctcgtgctcgttcgcactccagccgcctcgggcctcgaggccaccctcggccacgagcatcccctggtaccagatgcgcacaccgctcggatcgacgccgcgtcgcgcggcccccacctcggccaggacacggccccagtagggatccccgccgagcaacgacgccttcacgaggagcgagtttgcgatctgtcgcgcgatcaggagcgcttcgtcctcgtcgcgtgcctcgagcacgcgcaccaccccgacgcgcgacccaccctcggcgtccgcaacgatctggtgcgcgagctgcgcacagacctcgcggacggcctcttcgaactcctcgccaggcgagcgtccccgaccagaggcgagtgcgacgaccgtgtcgttggtcgagctgcatccgtcgatcgtgatccgattgaaggtcgtctcgaccgccgcgcgcagcgcagcgtcgagacgctccgcctcgaccgccgcgtccgtagtgatgacggccagcatcgtcgccatctgaggcgcgatcatcgccgcacccttggccaagcccccgacgcgaaaaccatccccctcgacgagcgcggtcttcggatgggtgtcggtggtcatgatggctcgagccgcggtctcggcgctccgctcgtccactccgaccgacgcagtgagggccccgaagcccgcgagcgccgcgtcgatggggaacgagatcccgatgaggccggtctgagcgatgagatagtcctcggcccggcctccgaaggcgtgggctgcagcctcgaggaggcgccgagcggctgctcgtcccgcttccccggtggcagcgttcgcgttgcccgaggtcagcacgacgccacgaacgcggcggcccgagccagcgaggtgcgctctcgacacctcgatgggtgcggctggcgagtcagtcgtcgcgaacaccgccgccgcgacgaccggctcaccgtcggccgatccgacgaaggccgcgtccaacgcgccgcccgccttgatgccgatccacgctccacctgcacgaaagcctgccggcgcggtcacgctcacggccacacccccaatccctcgagcccgagtacttcatccacaccgaccatcaggttcgcgccctgcactgcgtgctgcgccgcgcccttgccgaggttgtcgatcacgctcgtcgcgacgatcacgccgacctcgtcgtcgaccgtggcggccagcacggctcgattggacccccgcacctcacgcgtcgacggaggcgtctctcgcacctcgacgaagggcgaggttccataggcccgagcgaggacgtcgcgcaccgagtccgcatcgacggttgcgtcggcgaccggcagcgtgatcgtcgcggcgataccgcgtgaatagggcccgagatgcggcgtgaagcgcaccgggaccccgagcagcgagcgcatctcgggcgtgtgtcgatgccccccgagggcataggcgcgcactccctcggcaacgttgacgaaatgcgtcgtctccgtggctgcactgcccgcgccggtgacgcccgagatcgcgtccaccacgacgaggtcacgacgagcgagaccagcgtcgatcagcggcttcgcggcgagcaccgtcgcggtgacgtagcaccccggaaccgcccagacctgtgcgctcgcaagctccgtgcgcacgtgctcggcgaccccgacaacggcagacccgaggagctcgggcgcggggtggtcgtctccgtaccagcgccgccaggtcgcctcgtctgccaggcgcaggtcggcaccaagatcgaccacgcggacaccccgagcacggagttctcggatgatcccaccactgtgaccgtgtgggagtgcacagaaggcgagttcagcggcgacggcacgaggatcgatgggctcgataggccgctcggccaagtcgacactgaggccaggcacgagctcgcccaggcggcggccagcgcgctggtgggcctggaacgcgacgggctcgaagacggggtgccgcgccagcacccgaacgagctcttggccaacgaagccgcttgcgcccaccaccacgacgtccatgtcgagagtctatgtccactactgcataatcatgcgcaccctgcccgaagaatcggcgccgagctaagcttccttcgatcgagggaggcgcccgtgggtccgttcgtcgcctatgaacagttctggctgcgctacgtcgacttccgaggacgctcgagccgggccgagtattggtgggtcttcctcatcaacctcgttctcgagctgctcttcaccttgggtgcacgctccacgtcactcgtcagcgatctcggtctcctgtatgggctcgccgccatcatccccaacctcgcgctcgtcgttcgacgtctccatgactccgaccatcgcggctggtggatcttcatcgcgctcgttccgatcgtcggcgcgatcgtgttgctcgtcttcgaactcctcccgggcaccccagggccgaaccgctacggggatccgtcgacgccggttcgctctccccggttctagatcggctatatcagcatgggaacgcttcgctagaactccagctccccggctgaatggatcgttgctgagaacgaatccactcgcgtcggagctcttccccgaacgaaccgcccgacggcgggtagggtgggcactcgtgcgcggttcgtcgggcctgagcggggccacctcgcgatggctcgaacgcttcgaagtgcttgcagtgcgagccttcggcgccgacacgctcctctacggcgtctccgcagtcatcgccgggctgaacctcgtcgtcgcctccgggggcgactaccgcgcctgggcgatcgtcgcgacaccgctctatgcgatcgcagcactcgccagcctccttctcgaccggatcggcgacgtcgagcaagcgacgcggtggcgtcaccgtctcgtgctcatcctcctcgtcggcgtggtcgtcgtgccgctcggcgatgcggtggcagcgcgcgcccttgcgctacccggcatccacgcccaagccgaggtcgtcgtgatcgagcgctgcggcgaccgcgtgctccacggccacgactgctatctcacccacccgacgaccgctggcagttccgtgtcatcggcgtcgcacgcactcgacgcgaacgcgttcgtcccctacctccctgggatggccctcttcggcctcccgaacggcctccccctgccgaccgtgctccgcgacgcccgagtctggatgagcaccttcaccgtggcggtgctggccttcggcgcgtggctcgctcgactcgcgcctgcacagcggtggcgcctcctgctcctcgtcgtcgtgctccccgcaggagccctccccatggtcaccggcggcgacgatctccccgtcatcgcgctgctcgcgaccggcctgctcctcgtcgagacgaagccgcgcacggcggggatcgcgctcgggctcgccacggccttcaagctcaccgcgtggccgatcgtcgcactcctgctgctcgttcgcgatcccaccgtgaatcgtcgccgcctcatcccgccgatcgtcgccatcggtggcggcctcaacctgctcggtgccgccatcaacctgcgagcgttcatcaccaacgacatccgcttcccactcgggcttaccagtgtgcgctccccagcgcagagtcccctgcttggccaggcattggtgcagctcgcaccgagcgagcaccgcctgatcgtggtcggcctcgtcgccatcggtctcgcgggcacggcgctgctcattcgagcggcttggccgctcaccgtcgatcgggcgatcctcgtggcagccctcgtgctgctgcttgccacggtgctcgctccgcagacgcgcttcggctacctgctctatccgttcgatctcctcgccgtgctcgtgctacgtcgaaccacacgcgtgccgatcgacagcgaccagatcaatcccgacctcagacagacagcgctcgcgcgactagagcgctgacaggcagactgcgcggccacgactggaggcgcgtcgccgacgtgtcactcagtcgtcacgaatccgggccgggacgacgcccacgacgaggcagagtcgaggcgtggttcgcgttcgtccctcgactggaccagactcacgggtcgatcaaccgtacgacgagttctacgacgccgacgggtgcgttcggcccgtctacgaacaactcgctcgcaccgtcgcgagccttggcgcagacgaactcgcggtgcgcaccatcgagcgcgacatggctcacgccgatcggggcgtcacgtacgatcaccaaggggtcgaggccgtcttccccttcgatcccatcccgcgcattctcaccgagtcggcctggcgtcacatcgcagctggcgtgcgacagcgcgtacgcgccctcgaggccttcctcgacgacgtctacggcgcccagcagatcctcgccgacggcgtcatcccgagggcactcgtgctgcgctcgacacacttccgccgcgaggtccacggcctgcgacccgcgaacggcgtacgcgtccacgtcagtggtgtcgatttggtgcgcgacgccgacggcaccttcctcgtgctggaggacaacctccgcgtaccctcaggcgtctcctacgcgctcgacaaccggcgcacaacgacgacgcgtttcccagagctcctgcgcggctaccacgtggaatcgatcgacacctacccgtcgcagctcctcgccgcccttcgtgcgagcgctcccgacggggtcaacgaccccaccgtggtcctcctcacacctgggccctacaacgctgcctacttcgagcacgcgtacctcgcgaggcgcatggggatcccgttggtccaaccctccgatctcatctgcagcggcgggcgctgctatctccgatccacgcgacgctcgaacgaggtgcacgtcatctaccggcggatcgacgatgcctacctcgatcccgtcgcctttgatccgacatcgctcctcggggtcgccggcctcatcgtcgcggcgcgtgagggcaccgtcaccatcgcgaacgccgtcggcaacggcgttgccgacgacaagctcatcggcacgtgggtgccgaccatgatcgactactacctgggcgagcagccactgctgggcatggtgccgacctaccgcctcaacgatcccgacgaggtcgcctgggtcatcgccaatctcgaccgactcgtcgtcaagcccactgacggcgccggcggtaagggtgtcgtcgtcggtacgacggcgaccgacgaggaactcaccaacctcgctggagagcttcgcgcccatccctaccgcttcatcgcgcagccgatcatccctctgtcgacccaccacacgctcgatggacgcgcgctccacgtcgacctccgccccttcgcgatcaaccacggggaccacatctgggtcatgcccggaggccttacgcgcaccggtccggcaccgggagtcctcgttgtgaactcgtcccagggcgggggatcgaaggacacctgggtcctgcgtccgggcaatggtcgagtacggacgagtcgctccgtgatcggcctcgtcgaccaggtacgcgccgacatcgacacgccgaatcccgaggcgacccagtgatccgcccccgcgcggcggcctccacgtactggctcggtcgctacctcgaacgcatcgacgcaacggtacgggtactcgaggtccagatcgacgcctccgtccagcaccgaagcggtctcccgtcggctgcgctcgcgaacagcttggggatcgccatcccagagcagctcgcatctcgcgacgacctcgtccggcttcttctcaccgacccggcggtgcccggctcggtaccgttctgcgccgccatggcgctcgcagacgctcgggacgtacgcgacctgctcacgagcgagctgttcgaggcgatcaacgccaccgcacgagccatcgccaacacggctcgaaccgcgagcaccatcccgtgggcacgcgtcctcgcgaccggacgcgacgtccacagtcgcgttgcgacctgcttcggtctctgcgagatgacgctcgcacgcgacggctactgggcgctcttcggcatcggctccagcatcgagcgcgtcgagatgacggcccggatcctcggcgcgtggcgagcacacgcctccaccgaggaggattggcacaccctgctgcgctcggtcggctccctcgagatccacctgcgacgccacgggatccgcgggagcacgccccaccgtgtgctgagcgacctcgtgggcgcgctcgacaacccgcgtgcgatcgccttcggcctgaacgaggttgcgcgtcgagcgcgcctgctgccacgcagcctggtcggggcccgtgtcgccaagacggcagccgagttggcacacgagcttcaccgcacccccgagaggatcggcacccgcagcggcgaggtggctgcccttgaggcgagccgaaccctccatcacctcatcgagaccacgatcgccctgccgagccagccgccccgctggcagctcagcgatcagctcgcctccgaggtcacccgatgaggagatcccgttccaccctcgccacctggcacaccaccgaactcagctacgacacccctgccgttcggtcctattccgagctgcgcatgagccccacgacggggagcagccagcgcgtgctccgacaccgcatcgagctctcccagccagcgcaccgagtccgctaccgcgactactggggctcggtcgtcacgtacttcgacatccaacgcccacatagcgagctcacgatcgtggccagctcgaccgtgcgatgcgcgccctggagcacgggatcggtcgtgacgctcgcgacgctcgcgcggcccgagacccagcgagcactcctcgagtacctgctcccgacgcccttgacgaccattgctgagcccgcgatcgacctcgaggtgggcacggacccactggagcgggcggaggccctcgccgccatcgtccatgacacgatcacctacgctccgggaacgacgaccgtcgacaccacggccgacgaagcgtgggcccgacggtctggggtgtgtcaggacgccacgcacgtactgtgtgcgctgctgcgtcatgcaggcatccctgcgcgctacgtctcgggttgctttgctccgcatgctctcgaggtctccgaggccgccgagggcgcaagtcacgcctgggtcgaagcgtgggtgggccactggcacccgctcgatccgaccaacctcttcgcgccgtcagagcgctacatcaccgtcgcccgggggcgcgactaccgcgatgtggccccgctgcacggcatctacgaaggtccagggcgacagacgatgcgctcgagcgtacgcatccagcgcgtcagctgagacgcgctccaccgccgctccctcgacctggttgcccctgcgacgcgaccggcgggcagcctggcgatccgcacggtgagtgagcgagcggacagcatcgcatgtgtggagcctcccggagaggccgctctctgccgtgaaccagccccgaccggtcaactccgaacgatgagccccacatcggccctccgacctctggttccctggtcgatccgacgaccaacgcgcacgcatccgcgtgcaccccgtgcaaccctgagcgccagcacgcgcaggttccaggtcgcgctgggacgatcgacgtcgagccgcttacgccatcgccggcagtgcggccgtacgacatgcaccgcgggacttgcgctcgagccgcccgcagattcgctcgacaggaggcgggtggctcgcctgccatctgaggtgacggtgacgaaggtgcgcaggtgcccccggagcgagcggggacggcgtcccaccgaccggaccgtggcgagaaggccgaggctcacagagccgcgtgcacgccgacctcgtgggccagaggcggcccaggtgccgctcggcacgcgagcgggaccctggtgatcgcccggggcagccctccacgtaggaccgcgcgagcgtgtcaggtaccgaaaggtgagcccatcgctcctcgtctgtcgcgggagcggaacgtcgggctagaggacgaccgcagcgaccacgaggatcgccagcaccaccgtcgccacagcagccatccgtccgacgcctgcggtcgcaaagccgatcacggacgccacgacgccagcgaggggggtcgcgagcaggatgaccgcgccgagcagcacgatgccttccccgcggccgtgccgaagagcccgtaccagcccgccgagccccaccggaaagtgcgcacggcgcccgacgaggacgtggtagctgatcggaccgacgacgaagtgaggatggctgacgagggtcaccacgagcccggccacgaccagcacgaccgcgatgacgacgccagccccgaggacgcgtccgacgacgttcgcgacctgcgcgtccggatcctcgacgcgtcgctctcccgacgcgctcatccgatgcccttctgcaacatctcgacggcgacgaccacgagcaccgcgatgaagacccagcgcaccacggtcacgttcacccgcgtgagcaggcgagccccgagcgttgcgccaccgagcacaccgaccgcgatggggccggcgaggatggggtcgatctggcctcgcgacaggtagatcgccgcactcgccgcggctgtcatgccgatcatgaagctgctggtcgccgaggccaccttgagcggcacgcccatcaacatgtccatcgtcggaacgttcaacgcaccagagccgataccgaggagcgccgagaccacgccggcaccgaacatcagcaccagaccgaggaggctgcgctccacccgatgggcaacgaggacgccgccatcaccgatcggcgctgcgccatggagttggagggcatcggcgatgcgatcgtcgcggggctgctcgatgcgatccccactgcgtcgacgcagcatggcgacggcagagtagacgaggatggctgcgaacagcaagaagaggaaccgcgtcggcaccgcgcgcgacaggagggcaccgacgatcgcgccgagcgtggtcgcgatcgcgagatacagcgcgagacgcacgttcaccatgccgcgacggacgagccgcgacgcgccggtcgccgaggtcgccaccacggtcacgaggctcgccccgaccgccaggcggatgtcgacatggaagaccagggtgagcaccggcacgacgacgattccgccaccgagtcccaccagggacccgagcaggccagccacagcggcgatcactatcagcgcgatgatgaagacgagcggtgtgatgaccatcattgtaccctcgtgggtatcagatcacgacgccggcgccgtacgaagcgcggctccgagtgccgcacccgcgtgccgggccacctcgatcacctcgcgaaccctcgcctcactgatcggcccttcggggtcctcgagccgtaggcgcaggccgagcgagcgccgaccctcgcgaacgaacgtgtcgaacgctgccacgtcgcgcaccaccgggccgatctcctcgcgcacccgagccgcgaggcttgcggccgcgaggtcccagggcacctcgaacgagaggtcgagctcactcgccgcgaaggcgccaagggtcgaggaagccgtgaggggtcggggctcggcgagccagtccgcgtccagctcgacaacgccgtagcgccaccgtcgagcacccagcgcagcggccacatccggcgcgagctcaccgaagacaccgacgaccagcccatcatcgatcaccgccgcctggcggctcggatgcagtcggggccacccaggaccaccagggccgagctgcaccgacccaggaccaagctcgaggccggcccgagccacgagcctcgcgagccaacggcccgcctccacgccgccgtcatgggcgtgggcgacgatgagcccgagtcgctgtcgctcgttgacgacgcgtccctcctgccagaagaccggaccccactcgaagaatcgcgcgggctcgagacggcgtctgaccgcgtgatcgagcgcaccgacgaggcccgcagcgaccgtggtgcgcaacacgctctcttcggggcgcaagggattggcgatcacgggtgcgacgcgctcgctcccgagctgctcctccaccgagggcgacaccatggtcacgctccaggcttcgaaggcgccctcgtccgcgaggagcgtcgagagggcacgttcgcgctgctggcgtagcgtcgggccatcgcgtcggggaccgatgaggggcgtcggggccaccgcgtcgtagccgacctgacggagcgcctcctcgacgacgtcggcgacgtcggtgacgtcggggcgccaggtggggaccccgacctgccagccgtccccgtctggctcgaggtcgaacccgaggcgcgagagcccggcatcgggttcgaacgactcgagcaccactggatcgcccgcgatcgccaccgcgctctcagcacgcaccgcgatccgtcgcggcgtcgtggcgtacgcaacgtcggcgaccagcatcggcgtcgcgacacccacgagagcggcaacacgggcgcacaccgcgtgcgcgacggcggggtccaccccacgctcgaaccgccacgacgcctccgtccgaagacccgtggcgcgcgccgcgcgcgcgatgcgctctcgtgggaacgccgccacctccaagaggacctgctcggtctcggcgttgacctcggtctcggcaccgcccatgatgccagcgagccccaccgcgcgatcgctgccgtcgacgatgacgagttcaccaccggcgagggttcgttctcgatcatcgagggtgacgagccgctctccaggacgagcactgcgcacccccaccacgccaccagccaaacggtcgcggtcgtaggcatgcgagggctgacccgtctcgagcatcacggcgttcgtggcgtcgacgatggggctgatctgccgcatgccgctcagcacgagccaccgcgccacgcgcggctcgagcaccgcgccacgcacctcgaggctcgcgagcacgagtcgatcgacggcgccctcttccaccgtcaccgcgcggggatcctggcgcgtgagcacccccgtgacgtcgacgaagggggcgcggaagcgcgcagcgaggtcgcgcgcgacaccgcgaactccggaggcgtccggtcgattgggttccacggcgatgtcgaggacgacctcgtcacggacccccagagcctcacgcaccggcacgccgagcgggagcgacggcgagaggatcgcgaggccgctcgcgtcggagccgagacctgcctccggagccgagcagagcatcccttccgacgtcaccccacgcagacgccgggccccgatctcggcgccgttcggcaggcgcacgcctggcagcgccagcgggacgacatcgccttcgacgaagttccatgcgccgcacaccaccggacggatgcgacccgatccgtcgtccacctcgacgagtcgaatgcggtccgctccctcgatccgatggatggcgagcaccttggccgtgaccacgccgtccgccgcgaccgggtgctcttccacgccttcgacgacgagcccgagggagtcgagcgtgcccaccagcgcgcgaacaccctcgctgtgcgcacgcagtgggtccgtgaggccgagcgcctcgagcggcgtgaagacctcgagccaaccgatgggcaacctcatacttcacccctcgtgcgcaccagcagccggaggtcgttctccggcaatacccgcatgtcggccagcccgtagcgcatctgcaccagacggtcgatgccgaaaccgaacgcgaaccccgacacacggccgggatcgagcccacctgcctcgagcacgcgtgcgtgcaccatgcctgcaccgccgagctcgatccagcccgtgcccgagcaggtgcggcaccccgccccgccacagatcgtgcacgtcacctcgaactcagccgacggctccgtgaacgggaagtacgcaggacgcagtcgcgagtggattcccggtccgaagtacgccgtcgtgaaggcctcgatcgtccccttcaggtgcgagaaggtgatcccctcgtcgaccacgagcgcctcgatctgatggaaggccggcgtgtgacgtgcgtccggggtgtcgcgccgatagacgcgccccggcaccaccgcgtagatcggcaacgtgcctcgctgcatgagacggatctgcgctggcgaggtgtgcgtccgcaggagcagcggaggcgaggcgtcgacgtcgaggtagaagctgtcctgggcggcccgtgcgggatggtgctccggcacgttcagcgcctcgaagttgaaccactcgtcctcgacctctggacccgaagcgacctcgaagccgaggcgccagaagacgtcctccagcgccatgcgcgctcgcgccacgaggtgcctcgccccgggaccctcgaggggttcgacgagcaggcccacggagggatcagagcgctcgcgctcagcgcgctcgaggagctctgctgcgtcgagacgtgcctcggccgcctcgatggccgacgtgagcgaggcgcgggcctcggccacgacccggccgagtaccggccgctcctcgggatcgaggttgcgaatcgaccgtgacagcactgccagtgggctctgcggcccgagcgcagcctcacggatcgcagcgagctcgtcccgatccgcgaccgtcgcaaggcgctcgagcgctccttgcacactcgccgtcacgagagcggtgtctgcggcgccctgaccgtcgccaccctggtctcgcacgctcgcccccatagaccctcgtccttcctcaccaccgcgacctgcggccaaggctagccccgggtcgacgcacccgccccgccaccgagcgacacccagagcgcgagtgcacccgccaccgcagcgttcagcgactcgagccggggcggcacgaccaacgccgcgcgctcgtcgagctcgccgtcgaccgccgcactcaggccagcgccctcggcaccgacgacgagcacgcgccgctgtgtctcgggcgcgagcggcgacggtgcgcgcgggtcgagcccaatgacgcgcgcgccccggactcgcagctcacggagcgcaggcgtgagctcgtccacctcggcgatgggcacgcgctcgagcgccccggccgccgctcgagccgccttgggattgaacggatcggccgatcccggaccgacgagcacgcccaccgcgtccgagagcgcggccgcggtgcgcaccaaggtgccgacgttgccgggatcttgcacgccgtcgagggcaaggacgacgagacggtcctcgagcgcctcgaccggaaccgtgacccgtcgcagcaccccgacgagaccctgcggagtcgtcgtggcgctgatggcggccagctcgcgctgcgtgacgacgacgaccgaacgcgcagaggccacgaggtcggcctcgcgacggatggcctcgtcgaccccgacgagctgctccacgtgcgctcccgccgccaccgcggcacgaaggaagcgtgcgccttcgagcacgtagcgaccgtgtctgcgccgcgcggctgccgacctcacgagctcgcgcagctcggcgcgggcgtcaggacgcagcgcgctcctggttggcttcggcaagccgcaccaacgcgccgaacgcgcccgggctccgcaccgccaggtccgcgagcacgcgacgatcgaggccgacacccgcgcggcgcagaccagccatgaagcgcgaatacgtggtgccctcggcacgcgccgccgcattgatgcgctggatccacagccgacgaaactcgcccttgcgcgcccgacggtcgcgataggcgtactgcagcgagtgcatcacctgctcgtgggcggctcgatagcttcggctcttgttgccgtagtagccgcgcgcgagctcgagcaccgcacgacggtgcttgcggctgtgcaacgaccgcttgactcgtgccacttgtgtcctcctccgaagccctagcgtccgccgagctgacgcaacgcgcgacgggtgtcaccccgcgacaacacaccctcgcgatgcaggcgccgcagccgcgacgacgacttcttgccgagcaggtgggaggtgaaggcgtgccgacgcatcagcttgcccgtgcccgtgcgcttgaaccgcgccttcgcacccgtatccgtcttcatcttcggcatcgcaactcccgtctcctgccggcgtcacccgctcgcgatcggtccacacccaacgagcggcgctggtaaccacgcatccatccccgaaaccccgtctgcgacggagcgctcgagcggtcatggctgcctcgacaagctcgcgccgggtgcggcgcggcctatcagcgtagtgtgtctgtcgaccgagttgggcctcaggcgcgcgccggtgcgggtcggcgatctggtgcgagcaccatcaccatgttccggccatccagcttcggcatcacctcgacgtgagcgacgcccttgaccgcctcgacgactctcgtgaggatctcctgaccgagttccgggtggaacacctcacgaccgcggaacatgatcgtgaccttcaccttgtggccctcggcgagaaacttggccacctgtcgcgtcttcgtgtcgaagtcgccctgcgagatcttggggcggtacttcatctccttgagctgcgacgccgaggccttgcgcttctgctcacggactcgctgggcttggtcgaacttgaacttcccgtagtccatgatcttcgcgaccggtggcttggccatgggtgccacctcgacgaggtccatgtccatcgctcgggcgatttgcagtgcctccggagtcggcttgatgccgagctggttgccgtccggtccgacgaggcgcacctcgcgaactcggatctgatcattcacacgggccccgtcctcgggtgcagtggcgataggagactccttccgtcggaaaaccaccagcgtggcggccagcagccgcgcctcacgattgtagcccaacgcgacgaggcaagcctcgattccccgaaggccacggcgctagactcatggcccgtggccaccgacgaacgtccgccatccgacctcgctggcgaggtgcatggtccttcgtccagcgacggctccacggcgagcaccgcggcgccctcggatgcgcgcgccgaggaggaggccgcacgcctcagggccgagctcctcgacgccgacgttggggatctcatcgccaaccacgcctacggtctgttcgagctgacgcggatctacctcgccgccgaaccaccccggctcgctgacgctaccctcgtcatcgacgccctcgcaggtctgcttgccggcgtcgccgatcgcctgggcgagcgcggccagctgctcgaagccgcactccgccaagtgcagctggcgttcgtgcgccttcgggacctcacccacgacgagaccgcctcctgagcgcgcgtcagtcgagcttgtgcacccaggtggcctcagaggcgcctcgaaaggacggcgcgacccgaaccagcacccgctggccgacacggacctggcgcgacccgtcgtcgaccacgatgcaatgaaacggcacctcgactgacccctcgaccgcgatcgccccgaggccgacgtgggcgtcgaacgccaccaccgtcccctcgcgcacctcgtagggatcgacgacggcgcgcgctggcgcctcttccagactgccgcggacgcggcgccgagaccgacgcaccgctacctacggcacgatcttcgacagcgggatctcgaggatgtccgtcgcgcccgcgtccttgagcgacgggatcagcaggttgatgcgctctctcggcaccaccgcctcaaccgcgaacccatcgccgccgtagagctcgctcacggtcggggccttcatcgaggggagctcggcgatgatctgcgccaacgccgccgctggggcgttgagcttgacgagcaccgacccgcgtgccgccagtgcgcccaccaacaacgtgcgcacctgctccatggcgtggcgccgctcggggtcggcggccgcgacgggattggcgatgagctcggtataggacacgaggagctcgtcgatgacgcgaagtccctgggccgcgagcgctcgaccggtctcggtgatctctacgaccgcatcggcgatctcggggaccttcgcctcggtggcgccgtaggaggcgagcacgtgggccttgatgccgagcctggcgaagtagcgctcggtcaaacggggatattccgtcgcgacgcgaacgccatcggggagctgtgcgggttcggtgacggcgctctcaccggcgaccgcgagcacgacgcggatggggcgcgacgacgccttcgagtagcgcagttcgcccagcgacacgacgttcgcgccggtctcctcgacccagtctcgcccggtgatgccgagatcgaacagaccctcggcgacgtaggtcgggatctcctgtggccggaggatgcgaacctccgcgatgcgcggatcgtcgatcgtcgcgcggtaggaaacctcgctctcccgctcgatcgtgagatcggcggcgcggaacaagtcgaaggtagcccgctccagcgagccctttggcaccacgaccctcagcacgaaccgtcatcctccttgagtgcatcgatgcgtcgatagacatcggccatgcgaacggccacgagggctgcctcgtagcccttgttgccgtgcttggccccggcccgatcgaaggcctgctccaaggagtccactgtgaggagtgcattggccaccggcaccgtggcctcggccgcgagacgagccagctgggcgctcgcctgcgtcgcgacgacctcgtagtgatcggtctcgccacgaatgaccgcgccgacggcgatgatgcccgcgatcggcgtgcctgccgtcacgagtcgacgcgccgcgccagcgatctcgagcgctccgggaacccacacgacgatgggctcagccgcacctgcctcctcgagcgcccgccgagccccatccaccagcgcctcgccgaccagctcgttgaagcgcgccgcgacgatgacgaagcggtcagtgggctcggcacgtggtcggccttcgagcttcatcgttctcccctcgcgacgtcgagcaggtgccccaacttgcgcgccttggtctcgagatagcgcgcgttctcgggtcgcacctcggtgacgatcggcacgcgctcgacgatctcgaggccgaatccagtgagtccacggtacttggccggattgttcgtgagcagacgcatgcgtcgcacaccgaggtcggcgaggatctgggcaccgatgccgtactcacgcgcatcgaccggcagcccgaggcgctcgttcgcctcgaccgtatcgagcccctcgaactcctgcaagtggtacgcgcgcagcttgtgaccgagcccgatgccgcggccctcgtgcccacgcaggtagaccaccacccctcgtccttcgtccgcgatccgtgcgagggcggcgtggagctgcggaccgcaatcacaccgatacgacccgaagatatccccggtcaagcactccgaatgcacccgcacgagcaccggttccgtgtcgtcgatctcgcccaggctgagcacgagatgctcgtccccgggctcgaggacgctccggtacaccaccgcatcgaacgctccccattgggtcggaatggtcgcctccgacccctcgacgcgtgcgacgagcgtctcgcgcgccgcccggtagcgaatcaggtcggcgatggagatgagcgggacgccccaggcagcggcgaacgccgccagttcggggagccgggccatggactgacgatcctcggtcgtgatctcggcaagcatcgcggcaggccgccgaccggcgaggcgggcaagatcgacccctgcctcggtgtgtccacctcgcttgaggaccccaccctcacgcgcgcgcagcgggaacacgtgaccaggtcgcacgaagtcgctagggcgcgcgtccgggctcgcgagcagcgccacagtgcgggctcggtcctcggccgagatgccggtcgtaccgccgcgcgcagcgtccacggtgatggtgaaggcggtcttgcggggatcggtcccgtgctccaccatgagcggcagctcgagggcgtcgaggagctgcgactcggccgacacgcagatcatgcccgaggtgacgcgcaggtagaaggcgacgtcgtccggacgcaccgcgtcggcaggcatgatgaggtcaccctcgttctcacgatcctcgtcgtcgacgacgatgaccatctcgcctcggcgaaacgcctcgatggcatcctcgaccgacgagaaaggcgtcgccgctgttgtctcactcatgcatcctccgcttcgcggccaagccggaccccctggagccgcgcgacgtacttcccgatgacgtcgaactcgatgttgagcaccgcaccgacctcgcaggtcccgaggttcgtgcgacgtcgcgtctctgggatgagagcgactctggccgaggccggcgcgagctcggcgaccgtcaacgcaaccccgttcagcacgatggtgcccttctcgacgacgagcggctcgaaccgctcggggtagtgcaccacgatgccttcgtcgtcgacgtccgtcacggtcgcgacggcgtcgacgtggccgagcacgaggccgccatcgagcagcgtctggagcgtcaccgaccgctcgacgttcaccagcaccccgggctcgagcgcaccgagattggttcgccgcagggtctcgggcacgacgtcgactccgaccacctcgtcactgatctcgacggcagtgaggcacgccccgttgaaggcgatggaactccctggggcgatggcgacatcccagtcgctgcggtcgaacagcaatcgcccgtcacggcgctcgaggagcgctacggtccgttccacgatccccgagaacacccgactacctccgggcgctccaccggatcgaccgcgccccgtcgaccagcctaccggcagccgatcgctccgaggacctgcgactccaagccccagtaggcatcctcgagcgccgtcgcggcggggagtcgcacccaggcgacgagatcctcaccgacccgtcgatgcgcacgccaggccccccgaatggcatcctccaggagccgcccctccccgaggtcgaccgcgtgccgagcatgctcgtcgcccaacaggatcggtgcgatggcgacgagcagctcgtcgaccagtccctcggcgagataggcaccgagcagggtcgggccgccctcgacgaggacctcgacccacccgcgagccgctccggcagcgagcagcgcaccggggctctcgctggcgaccacgaagccctcggggacgtccagcgggcgacgactcgcgaccaccctgaccggttgacgccgcgcgagtcgcccgcccggtcgcgcggtgagttgcggtcgatctcgctcgaacgtcccccgaccgacgatgatggcgtcgacctcggctcgaagtcggtgcccgagctctcgcgcagcttcctgggtgatccacttcgactgcccccaccgatccgcgacggcgccgtcgaggctgcaggcgatcttgccgacgacgaaggggcgcccgcgcagccggtgcgagaggtacggggccaggtcgtcggcgagcctcgcgcgcatcgcccggggcgcgagtcgcacctcgaccccagcggcttgcagggcctggatccctcgacctcgcacccgtggatctggatcgatgaggcccacctccacacgtgccacgcccgcctcgatgatcgcatcgacgcagggcggcgtgcggccatggtgggcgcagggctcgagcgtcacgctcatctgggcgccgcgagccagggcaccggccgcagcgagagcggcgacctcggcgtggggacccccgggatgggccgtccggccgacgccgaccaccacgccatcgcgctcgatcaccgcaccgacccacgggtttggcggtgcgaccgcacgggagcgacgtgcgagccgacgtgcacgctcgagcggagcgatcacggcgccgcgtgcgggtgcgcgtccccgccgtcgatcaacagcgccaacgcatgatccaggacgggcagcaccgcctcgagcgactccaccgcgccggtcgccgacccggggaggttcacgatcaggctacgcccacgggtgccggcgaggccacgcgacagcgcaccgagcggactcgccgcgcgcatcgcctcgcagaagccgggggcgtgacgctcgagcacctcggccgtgccctcgggagtctgatcgcgcggcgtgaaacccgtcccacccgtcgtcacgatgagccccgcgaatcccaacgatgcctcgcgcagtgcgcgtgccaccgatccggcgccatcggcgatggcgctccgggcctcgagctcgaaccccgcccgctcgagtgccgccgcgagcgcctcgccggatcgatcgacgcgcgtcccgcgcaccacaccgtcggagaccgtgatcaccttcgccttgcgcttcggctccatctagaactcctcgctcgggatcgctcgaacgtgcagctgcgctgcccgaagcccgcgaacgaagtccgcaccgctcatcggtcgcccgccttcggggatgacctctccgagctcgtaagcacctcgtgccgtgtgcacgatggcccgaccgtgatcgagttgcacggtcccgagcggatcggccgcctctcgctcgaggggacgacccgagcgtacgatcacgcgacgccgtccgacgaagcagaaggctcgctccagacgcacacgccgatcccacacgatcgcggcctcggcgggacgcagacggaggtcctcggacgtgatccgcggagcccaactcgccgctccggcctgggggacccccgcttcgagggatccgggctgttcgaggagaccgaggaggagcgacacgccggcgtcggtaagacgacggcgagcctcgctggcccggaggccatcgatcagcaccgagcgcatcgcgaggatcgggcccgcatcgagctcgggctcgagacggatgatgctcacaccgctgcgatcgacgccagcaaggatggcacgctcgaccggagcggcacctcgaaactcaggaagcagcgagtagtgcacgttcaccaccggaacaccggtgagccaggcggcaggcagcaaccggccgtaagcaacaacgacgcagacctcggccccgaggtggtcaggagggagcgcctcgtgcacctcgacgccgagctcctgcgcgcggcgcgccgccacggtcccggccaccgcgccgccacgcccacgtcgcttgggtggccgagtcacgaggccgatcacgtcgtgacccgcctcgacgaggccatcgagatgtcgcgccgtctcctcggtcgagccgagcaggagcacgcgcatggtcagttgccgagccagcgctcacgcgcgatgcgttgcttggcctcgcgccgctcctcctcgtcgagtcgctcgatgagcagcacaccatcgagatgatctgtctcgtgctggaacacgcgcccgaggaggtcgctcccctccaactcggcgacctcgccgtcacgggtgacgtagcgcaggagcaccgtgcgagggcgctcgatcggccagaagtagccaggaacggagaggcaaccctcctcgtagcgccacgtccccgtacgctcgacgatctcggggttgatcgcaacgtccggaccgtcaccgatgtcccagacgaacaggcgcagatcgacacccacctgcggggccgcaagcccgactccgggagcctcgtgcatggtcacgatcatgtcctcgatgagctgatcgaggcgagcgtcgatcgtctcgacctcgcgagctcgatgcgagagcaccggatcgcctatggttcggatcggcaggatcggcacgccaccacgctagacggccgaggcccgtcggggcgctaaccctggttcacggtgggggtcgttgctgatgcgatctctcgccacgagccctgatcgagctggaggaggccgacaccggtcagattcggattgcccgccacgacctcgaccgctccgcccgaggtcacgccgaccccttgggcccacgctggtgccgcgatcgccctcgtgatcaccccgccgcttgaggtgaccggttcgaactccaccaatgttgcgcgagccccatgaggcacgagcgcgaccgcacgggtcccggaggctgcgagcgacggaccgagcgaggcgtcactgccgagtgacaccgttgcgaccacgcggtcaccgacgaggtcgacgagctggagccgctcgcgatcgttcgtcgcaacgatgacggcgaccagcggacccgtcgccccatcgacgaccgcactcgtggcgaccacatggcccgcgagtgccacggtgcgagcggtgcgcgccgcgaggtcgaccacggcgagacgcgcactcgagccacagctcaccacgagcgtctcgccgtcgggtgcgagggagcgcgccacgggcgagacgcaccccacctgatgctcgagcgccgcgagggacgcagacgagaccagcgtcgtcgcgatcgtgccgttcggcgccagatcgacgatcgactggtcgccgagcccaaaggagcgtgtcccgacgatcgcctcgccgccaccggtggtcgcaacgaccgatccagggaacggcgccaccgccgtcgtgaactcctgtggcgtccaacctgcgctgtccgccgaccacaggaccgagtagggccaggtcccatgggcgacctcgccggcatacaccggcagacccgccgaccccccggacgcaagcacgatgccagctcgggtcgacacgccgagcggggtggcgagggagagcgagttcccttgttgcacgagcacctggccgtgttggtagctctggacctcgatcagctcgccaccgctcggacgggcgacgatggccgcaaaattctcaggcgccggaggggcttgcgtcgctgcactcgtggctgttgcgcaggccgcaagcaacgcgccgagcgacgccacgaccgcgactctggcacctcggccacgcgtccagcgcactcagacctcctcgaccaggtggacatacagcgacgagatgctggtcgccaccgatgcattcagcgacggatccatcggtatcaggtagcgctcggtgaggttcggccctaccacatagccgatgtcctcatgctgggtcatcacgccatccaccggctgggacacgccgaaaccgagcgcctgccacaccttcgacagctgcgtgagcgaggggctggtcaagaagtaccagttggacagtccggtcaggttctctcgttggtcgaagatcttgaccgcctgcaccgaatggatcacggggttgaccgcgacggcaacgaacaccgtgttggcgcgcaccgacggaggcagcgccaagtccgccgtgcggagttcttgggcaatcaacggacagtcgaaggtgcacaccggatccaggttggtgagcaccacccgcttgccggcgaactggtcgatcgagaccggaacgcctcgctgatcgagcaaggtgaacgagggtaccgggcggtcgatggcaaagggcgtgtccgaagccgccagcgcgagcgccggcgaggcggtctgattgatggcggcataggccagcggaccgatgcccatgagcgcgaccaccacggtccacgtgccgagcaaccgcccagcgatccccacgccactcggccacagaccgcgaacatcgaccgactctcgagcaggactcacgacgccgacgacagcagcgccagcgagcacgagaccgggcaccatggagttcgggtccgtgccgacgcccccgaggaacccgaagtcctggacgaaccaccacgccaggagcgacaggaccgcgagcacccagaacgcgggccataccaagcgcttggccagaaaggcaaccccgacggcaatgaggacggccgcgacggcagcgttcacgacgaccgtcgtcgtgccatggagtgcgttcgcgagatcgaccatcggccgcgccaggaacgatggttggggcgtcccggccatcgtccggatcatcgcggggatctgtccgtgatagaagccacgaccaggccaagcctcgaggaccccgaacacgaagagttcggcgcccacgaggccgagcagccagcgtggaaggcgatccggttgccacgcgctccacggcgcaagcagcgctgccgccgcgaccacgtacaggaggaccgccccaggggccccgaagagccacgaggcccccggcgcgaggatgccacccatcgcctcgccacccacccacacggtcaagccccagaggatggcggcgacgtagccgaccttggcgaacgcccctgacttgccgaggagcaaccacacgccgatcgcgagctggatccacaccgcacccgtcgctgcccagagcggatggcgctgccacgcgtcgatgccgagctgaacgaggtcgaccagccagcggggactgccctgcgcggctggctggatgacctggcccacgagcgacgtcggcatggcacgctgcatctggagcagcccatcgacgatccacagggcaccaaagccccaacgcaggatcgctctcgctcgcggctcggcgacctcgtacaccccctcgtccgccgaaccagcgacctggacgcgtgccgggttggtggcgcccgcaaagaggaaatagcgggccgcgacgagcaccaacccgatcaagacgagcgcaatcgcctcgagccccaaacggtggtagaacggccccgcaagacccgaactgctcagggctgcactgcccatacccgtcattgcctaagcctccttgggctcaccgaccggcacgtaccgagacccgcggttcccgacagagcctgtcctgacaaccggattctagcggccgaaggccgaggctacggggccgctctgtgcaccaaagctcagagttctcgcgggtcgagttcgacccgaaccgcgcgcgcatcgagcgttcgcggcacggatccaaggacaacgcgcagctcacggcgggtgggagcggtgaggagccagcgatcgggggcgagctcggcaacctcgaaccccggcacgctcacctcgctcagtgcatgcacaaaggccgccgcctccggtccggagacgacggcggtgccgtggtctgggtcgagaccgagagcggcacgctcgtcgcgtatggcgcgcagcgcgcgtcgcgcgtcgcgctccgcgagcacctccgggagccacgctggcgcgtgctcgaccacgagatccacctcgccgcggttcgatgcgacgagcgccactgcccggtggatccagtagaggcccagctcctccgcgaggcggccatgagagccgaagagacgctccggctcgacgagtacgaccagatctaccgagccagcactctcgagcgcctcgatcgtcccgacgaccacgcccgcccgtggatccgggcccttcgcgatcggctggcgtaccaccggctcgaggcgtgccgcaacgtgctcgaccgaccagcgagacacccgcacggcgggtgagccgcacacgccacagcgcagcggacgtagcgcctcgcacgtccgacaccagccccgttccgggacaccgcgcctcgcagggagcacgaccaagcgcccaccgcaggcggcacacgtgagcgttgcgccacacgcccgacagaccggagcgtgccccggacctcgagccgggacgacgacgagcgccctcgggtccgcgcgccggcgccgggctaccgcgagcccatcggcgacgaccccctcgattccgcggtcgagatcggcggccccgaacgtccgcacgacgggccagggtcgaggcgctcgagtggggacgcgaacccgggcgcgcgccaggatgtcggcgggcggcaccgcactcacgaccacgagtcggctccggctgacggacgcccgcaccccagcgagatccagtgcctcgaggtacggactcgactcgtcccgcgcgttcggatggatcgggtcgagcaccaccaccgcatccggcgtcgcgagcggcgcgagcgcgcctcggcgaccaccgatactcaccgtcgtacgaccgcacgcgagctggtcccagtcgtcggggaaccgtgccgcacggaccccgacccgggcgagcgcgtctgcagtgtgtgcggcgatcgctccggtgggcgccgcgatgaccactcgctcgccgaaggcgccagccgccatgaggcggccgacctcctcgggcgccgagacggcgagcggcacgaggaagacctcgggtgtgacctcgctcgggtcgacgaggcgctcggcgagctgaccccgggcaggctcgagcaccggtgctccccgcaccttcgggcgccgcgcagcgcgcaagagcgtgacgggactcgccaccgcccacatcgccgcggcgagcaccgcctcgatcacctcgggaggggggcccggtcggacacgacggagcaccgagcgcaacgaggtggccgacgggtgctcgcgcgctcgggccgggcgcgcaacgacccatccgctgacgcgtctcgcaccgaagggcaccacgacctcgtcaccgagaccgacctctgcctcggggtcgacggcgtaggtgaacggcccgggccggccgaccacgtcgacgatgacgtccgccgagtccgcgggaaggtcgccctccacctcagccagtgatgtcgagcgcgctccgcagcgcgtcgagccgatcgagtcgctcccacgggaacgtgccgtcggagcgcccgaagtgcccataggccgcggttcgccgatagatgggttgacggagccgcagcgcatcgatgatcgccgctggccgcaggtcgaacacctctcgaacggcatcttcgatgcgacgcggatcgacctgctccgtaccgaaggtctcgaccatgagcgacaccggatgggcgacgccgatcgcataggccacctggagctcgcaccgcgacgctgcgcccgaggcgacgatgtgcttggccacccagcgagccgcataggccccggatcggtcgaccttggacgggtccttgcccgagaacgcgccaccgccgtgacgcgccgatcccccataggtatcgacgatcaccttgcgaccggtcaggccggtgtcggcgtgtggtccgccgagctcgaaccgtcccgtcgggttcgccaggatcttgaggcccgagacgtcgaggtctttgggcaccatcggaccgatcacgacgctctcgagatcagggagcagcagggtggcgagatcgatgccgggctggtgctgcgtcgagaccagtaccgtgtcgagggcgacgggtcgaaacccctcgtagcgtacggtgacctgggtcttgccgtcgggtcgcaggtacgggagcaccccagcccgtcgcacctcggcaaggcgctgcgcgatgcgatgggcgagccagatcggcaagggcatgagatcgggcgtctcatcgcacgcgaagccgaacatcagtccttggtcaccagcgcccagggacgaatacggatccgcctcgccgctcctggcctcgagcgcgctcaggacaccagaggcgatatcgggcgactgctcatcgatcgtgaccacgacgccacaggtgttgccgtcgaaaccgtaggactcacggtcgtagccgatgtcgcagatggtccgacgaaccaccttgggaatgtcaacgtagctgtcggtggtgatctcgccggcgacgaccacgagacccgtggtcagcagcgtctcacacgccacacgggccaccggatcctgcgcgaggatctcgtcgaggatcgcatccgagatctggtcggccatcttgtcggggtgaccttcggtcaccgactccgacgtaaacgcgtagctgcgcacagcgctccttccttcgagggcgctcgaacaacctagtggagccgatgcgatcgcgcgtacgcgacggcgtgcgcgagaatgcccgcagcgatctgctccttcgacgccaacgccagctcgccccaacggccgtctcggtcgagcagcacgacctcattggtcgccaccgcgaagccggcgtccgcacgggacacgtcgttgccaaccatgatgtcgacgtcgcgggctgcccgcttgcgctccacctcggtgcgcggatcacccgtctcggcggcgaacccaacgatgatttggtgcggctcgcgatgagcgctgagctcacccaacacgtcgggtgtcggtccgagttcgatcgtcagagacgaacggccggcccgcttgatcttggaagacgccgtcgccaccggagcaaagtccgccaccgcagccgcctgcacgacgacgtccgccgacggctggcgctcgcgcatcgcagcgaggagctcctcggctcgctccacccgcaccacctcgacgagctcgccgaccggaccggcatcctcggtcgtcaccaacgtcaccgtcgctccagcgagcgccgccaccgcagcgatcgctcgcccctggcgaccagacgagcggttggccacgacacgaaccggatcgatcggctcccgtgtgccgcctgccgagacgagcaccttccagccggcgagatcgagctcaggtgccgcctcgagcagctcgagccagagcgacatccaccacggatcgacaaggcgtccgagccctcgatcgcctcccgcaagccgaccggtcgtcggtccgacgagcacggcgccgtcggtgcgcagtgtcgctaccgagcgttgggtcgctggcgacgaccacatctgggtgtgcatcgctggtgcgagcgctctcggcgcgctgctcgcgagcagcgtcaccagcgcaacgtcgtccgcgatcccggcggcgaccttggccatgaggtccgcggtcgccgggtacacgatgatgcgctcggcccacgacgccaagcgcgtgtggaccgatggctcacgaccgaagagatcgtcgttcaccatgcgtccggcgatcgccgacagcgacgcggcaccaacaaactcccgagcggcggccgtctggatgacctcgacgtcgtgccccgcatcgatcagcagccggatcagctcgagcgccttgaacgctccgactccaccgccaacgacgcacagcacgcgtcgcgtcacgccgttactccgcttcgtcctcgaccaactcggtcacgtcctcggccacgacatccggaacgatcatgccggcagcgatctcctcgaacgccagcgacaatggcttcgcgacgtccgactccacctgcggcggaatcatcgcgcccagcccttcaccgagatgggtgcggtagtcgttgatctggcgggcacgccgcgcggccaaggtaatcagaacgaacttcgagcccgtgtgctcgagcagctcctcgatgggcgggttcaggagcgaacgcccggcttcagccaccacaacctcctcgacggacctcggagcctacctgctcgagccgactactcgggccgaagggctgcgccgcggacgatcccggccacttcatcgatggcccgctcgaggcgatcgttgaccacgatatggtcggcgaggccgatcatcgcctccacctcgttcgccgcgatggcgagacgggactcgacgtgcgcgtcgtcgtcgcctcgagcgcgcatgcgacgctccagttcgtggaagctcggcggcaccacaccgatgatcgccgcctcgagctccagcatgcgcacactcctggcaccctggacatcgatctcgaggatggtcggatccccgcgctcgagctccgagcgcggggtgccgtacaagcgcccattgaacgacgcccactcgacgaacatgccctggtcgatagccgactcgaagtcctcgcgcgagacgaactcgtacgcctcgtccccctcaccgggacgacgaggcctcgtcgtccacgatctggcgaggtgggccgatggcagcgacccagcgagccgacgagcgatcgtacccttgccgaccccgccggggccgcagatgacgacgatcagtggcccttggtctcctcgagcaggcgctgacgctgcaccgatccaagaccctggacgcggcggctgtcggcgaccccgacctccgccatgatgcggcgagccttgaccttgccgatgcccggcaacgactcgaggaccgacaggaccttcatcttgccgacgatctcgtccgactccgctcgctccaggagctgcgcgagactgagcgagcccatcttcaggcgctccttgatctcggcgcgggctcgacgggcttctgcagccttctggagcgcagcttgacgctgctcagggctgagcgatggtggcaatggcatacagcgcaacctagcagagcttctggccgtctagggctcgatttcgcctgaatgttgcctacgaggcctctcccgtcgccgctgcgaacagcctggcggccacctcgaccgggtcactcgcctcggtcaccgcacgtccaaccaccagcacgtcggcacctgcctcgagcgccgctcgtggcgtgacgacctgccgctgatcgtgctgggcacccgatggctcccggatccctggcacgacgcgaacgagctccggccagcgctcggcgacggttcgcaggtgatcggcgccgacgaccacgccctgacagcccgagcgtacggcgacgtccatccggcgctccaactcggagaggtcgagcggagcctgcgacgtcagcgacagcacaccgagcgcgatcggtgtcggagcaccgacacgttcagccccctcgaggaggccctccacgccagcgcggagcatggcctcacctcctgcaacgtgcaaggtgacgagtgcgacgccaaaggaccccaacacccggctcgcgcgatgcacggttgtcgggatgtcgtggagcttgaggtccgcgaagatccggaatccttggtcggcaagggccgacagcaccgtcggaccggcggcggcgtagagctcgagccccaccttggcgatggagaaccactctcgcaacgacagtgccagccgttgggcctcgacggcatcgtcgcgatcgagcgccagagcgaagcgctcccgaagcgcctgagcctgcatcatccactccctccttgacgccgaagcgcccttgcgtagcggtcccagctgtcgacgccgctgcgcgcgagccgacgttcgatctcggcgagcacgaggacgggacgtcgtgggtcgacaaagagcgcggtgccgatctggacggcatcggctccagcacgaacgaagcgctcgacgtcgtcggcggtcgcgaccccgccgacgccgatgatcgggacggtcggcaacgccgcacgcagatctgcgaccgcccgaagcgcgatcggctgcacagcgcggcccgacaagccgccccctcgcgccgtgccgagggcctcacgaccgtcgtcgtaccactgcgcaaagagggtgttgatcgcgacgagtccgtcggcgccggcagccaccgcggcgtgcgccacgtcgacgatgcgatccgtattcgccgagagcttcacgaggatcggggtcgcaacctcgtcgcgcaccgcgcccaccacgcgagcggtggcgttgggatcgtgcgcgaacaacgcccggtcggcctcgagattcgggcacgacaggttgagttcgatgtagaccagcgatggcgcgatccgagcagcgcgccgaacggtctccccgtagtcgcgcggctgacgtccccagacgctgagggcgaccgggatcctggcgtcggccaaggagggccacgtctcagccagccatcggtcgatgcctggacccgccaacccgaccgagttcaccatgccacccggtaccggagcgaggcgaggcgctggattgccctcggtggcaacggtcgtcagcgacttgacgacgtgggcaccgagtcgctccagagccacagcagccgcgagctccgtgccgtaaccgccacacccggccgccgtgaggatggggttcgccaagacgagccgaccgcgtgcaaccgagaggtccgccactcaggtttcctcgtgataggcctgcagcggccgcacggtcagcggctgacgtgcgagcgcctcgaccgctgccacagccgcgcgagcggcctccagcgtcgtgatcaacgggatcttggcttcgagcgctgccgtgcggatgcggtaaccgtctcgccgcgggccactccctctcggcgtgttgatgatgagcgcaacctcgccggagcgcaccagccgtacggcatcgacgaaaccctccggcgcagcacgctcgccgagatcctcttcctcggtgaccttcgcgacgaggcgcgcaacagggacgccgtgagcctgaagccaggaggcggtcccctcggtcgcagcaaggtcgaacccgtgggccaccagtcgctcggcgatcgggacgagcgcctccttgtcgcgatcggcgacggtcacgaggaccgtgccctgctggggaagacgcgtaccggcggcgagttgtgccttggcgaacgccatcggcatcgtgcgatcgatccccatcacctcaccggtcgagcgcatctcgggcccgaggatgctgtcggccccgcggaacctgccgaacgggaggaccgcctccttcaccgcgacgtaactggtgacgcggcgaggcacgaagaggccctctcgttcgagatcacgcagggtcgatcccagcatgagacgcgtggcgatcttgacgagcgcgacacccgtcgccttggcgacgaacggaaccgtccgcgacgcacgcggattggcctcgatgacgaacaccgtgccgtccgccacggcgaactgtacgttgatgagcccgaccacatcgagtgcgtccgcgatcgcacgcgtctgggcctcgatctctgcgacgagggcgggagcaagtgagaccggcgggatcgtgcacgccgagtcacccgagtgaacgccagcctcctcgacgtgctccatgaccgcaccgatccagcacgcgccctcgcgatcgcgaaccgcgtcgacgtcgacctcgatcgcaccttcgaggaagcgatcgatcaggatcggtcggtcctgcgagatcgcgccctcggccgccagatcgacgagccgagagaacgcgctgcgcagctcgtcctccgagtagacgatctccatggctcgcccgccgagcacatagctcgggcgcaccaacacgggcaggccgatcgcagcgaccaccgcctccgcttcggcgagcgaggtcacggtgccgcccgggggctggcggatgccgaggcgctcgcacagggcagaccaacgccggcggtcctccgcgacgtcgatcgagtccggcgaagtgccgaggaccagcgacggatcgatgtctcgagccagcttgagtggtgtctggcctccgagcgacacgatgacaccctggagtgagccgagacgctgttcctcggcgatcacgtcgagcacgtgttcggtcaccaagggctccacgtacaggcgcgaggaggtgtcgtagtcggtcgagaccgtctccgggttcgagttgaccatgatcgcatcgacaccggcctcacgaagcgcgaatgctgcatggacgcagcagtagtcgaactcgatgccctggccgatgcgattcgggccagcgccgatgatgatcacacttggccgattcgatccgacggtctcgctctcctcctcgtaggtcccgtagtagtacggcgtgcgtgctgggaactcgccagcgcaggtgtcgaccgccttgtagacagcgcgcacccctacggtgtgccgatgctcgcgaaccgccgtctcgtccacaccgagcagccacgcgagttggagatccgagaagccccatcgcttcagatcgagcagttcgtcggcaccgagtgaggcgagatcgcggccacggatgtcggctgcacgcgcgacgatgcccgccatttccccgatgaaccacgggtcgatccggctcagctcggcaacgcgctcgatgctccaaccgcgccggagtgcctcgccaacggcgaagactcgctgctcggtcggcacagcgacgagcgtggccagggcgtcatcggagtacgcctgccaggtgacctcggccggatcggcgccgaaccctccccgcgaccgctcgataccgcggagcgccttctgcagcgcctcggcgaaactacggccgatcgccatggtctccccgaccgactgcatccgcgtcccgagaataccctcggcaccttcgaacttctcgaagacccagcgcggcaccttgaccaccacgtaatcgagtgccggctcgaaactggctggcgtgacacccgtgatgtcgttcatgatctcgtcgagcgtgtagccgatcgccaagcgtgtcgcgatcttggcgatcgggaacccggtggccttcgatgccagcgcgctcgagcgcgacacacgggggttcatctcgaccacgaccatgcggccgctggtcggctccacagcgaactgcacgttcgagccgcccgtctcgacacccacgcgtcggaggatctcgaacgagagcgaccgcatgcgctggtactcgagatccgtcagcgtctgtgcaggagcaacggtgatcgagtcaccagtgtgaacccccatcgggtcgacgttctcgatcgaacacacgacgacgcagttgtcattcgcgtcgcgcatgacctcgagctcgaactccttccaaccggcgatcgactcctcgaccaacacctcgccgaccggcgaggcgatgagaccggcccgcagcatcgcctcgaaggagctggggtcggtcgcgatcccggttccggctccgccgaggatgtacgagggtcgcagcatgagcgggtaaccgagctcgtcggcgacgtcccttccctcctcgagggaccgcacgagccgcccgcgcaccgccagctgctcgtcgatgctcatgagcagctggcggaatgcatcgcggttctccgcgagctcgatcgaggccggtcgcgccccgagcatccgcaccccacttcgctcgagcacaccagacgcatccagctccatcgcgagattcagcgccgtctggccgccgagcgtcgggagcaccgcatcaggccgttcggcctcgatgatgcgctcgagcacctcgagcgtcaggggctcgatgtaggtcgcgtcggcgaactcgggatcggtcatgatcgtcgctggattcgagttcgccaaaatgacgcggagcccttcctctcgaaggacccggcacgcctgtacgccggagtagtcgaactcgctggcctggccgatgacgatgggaccagacccgatgacgagcaccgactccaccttcggatccctaggcatgcgaacctccaccgagcagtgacagcagctcgtcatggatctccgacgactgctcgagcggaccgggggcggcctccggatggtactggacgctcacggcgccaagtgccggcaaccgcagtccctcgacgaccccgtcgaacaggttgcgccgggtcacctcggccggcgtgtcgagccggccgagcgacgcctcgtcgaccgcgtacgagtgattctgggcggtgatcgcgacgcggccggtctcctccaggcgaacgggatgattcgatccgtggtggccgaacggcagcttgatcgtctcggctccggccgcgagggcgaggagctggtgcccgaggcagatcccggcgatcggcaccacaccgagcaaggaccgaacgagctcgatgggacccgtcagtgcggcagggtctccaggcccgttcgacaggaacaccgcgagcgggtcgagcttctcgagctcttcgagtcgtatggtcgccgggacgacgacgagccgccatgggccacgcagggtctcgagcatccgctccttcaccccgaaatcgatggccacgatcggtcgactggagcgcgcgtgacccaagggctcgagctcgcgaggttcgcgacgggtgaccgcgcgcacgagatctcgcccttcggtaccgacggcgacccgaactcgctcggcggccgcgtccggatcaccggtcgtgatgatgcctggttcggcgccagcggcccgcaccaggcgaacgagtcgcctcgagtcgaagtcgacgaagagtgggacgcgtgcctcccagagccacgccgcgagggtggtgtcggccgcatggttcgacgccaccaccgagtacctcggcgccaagaccgcactcacccacggccggacgctttgcacgtcggccctgcggacgccgtaggttccgaggtgggccgtggtgaagcacaccatctggccgtagtaggacggatcggtgatggcctcgacgtagccgctcatcgcggtgttgaagaccacttcggcctcgacgtcatcgaggagcggctcgacaccggcggggatgaccacagcgccacggaacctcgcacccgagcgcagcaccaaccacgccggtattcgctgtaccgactcctcacgcacccacatagcggccttcctcgacaaccacctgacctcggcgcacgacccagcggatcgacccgaccaactccctcgtcgcccatggcgaattcgtcgaccggtacgccccgtcgccgccgccgatggttctcccacagggatcgatcacgacgacatccgccagctcgcctcgtcgcagctcgcgcgaacgaccgagcacgcgggccgggccgatcgccaacgcctcgaggacacgcacgagggcgcgccgcgcctcgtcgccaaggtgctcagagctctctggccgcgcatcctcgatcgagccacggagcacgagctggtcgagcacggcggtccaggtcgcagggaacgcctcgacgagaccgagcatgccgggtgctgccagctggaccggcaccgtcttcgctcgctccggatgcggggcgtgatccgtggcgatcgcgtcgaacgcgcctccgaggagcgcttcgagcagtgccatacgcgtcgcacgcgtacgcagcggtgggttcacgcgaaagcgcgcgtcgtggctcaggagttctgactcctcgaggccgaggtgatgcggcgtgatttcggacgtcaccgccaagccctctcgctgcgccgcacgcacaacattgacgctctcgcgggcgctcacatgctggaggtggtagcgcgcaccggtcgcacgaacgagagcgacgtcgcgcgcgaccagtgcaacttccgcaacctccggaacaccgtcgtagccgagacggtccgccagcgctccggcgttcatgacgccgcggctcagttccgggatggtcgcatgctgcgccacgacgacccccgtgctcgcggcggcctcgaggaccgcgaccgcgacgtcggcacgccagagggggtcaccgtcatcggagatgatgcgaacaccggccttcgccaggctctcgacgtcgacggcatgatctcctgcacgctccatcgtcgccgacgccgcctgcacgacctcgaccgggagcgccgcaaagcgatcagttgctgcgcgccatcgctcgacacggtcgatcgcggggaccgtgttcgccatggcaaccaccgtcgtaaagcccccacgcagcgcctggatggcgatgtcctccggcgtgtcggccacctcaccacccggccaccggaggtgggcgtgcaggtcggtgaaggcgggggccacgacggccccgggagcctcgatcacccggtcgccgcgctcgggaccctcgaatccggcaatccgtgcctcatcgatccgtatcggcacccgttggaggctcccgtcgacgaggacctctgcgcctgtgactacaatccccaccctgcctcctcggcgagcgcttcgagaacggcgacccgagtgggcacaccgtaggcgtactgcaggccatcgagcatccgaggggacgagagcacgatatcgtccaattcgaccccccgattgacgggcccgggatggagcaccacggcatcgggccgcgcacgctccaggcgatgcccgctcagctgaaacctcgcccgatagcccgacagatccacgcgctcgttcgctcccacgcgctcgtgctggatacggagcatgtagaagacgtcgacctcgtcgaggacgtcatcgattccatccgtgacgcccacggcaccaagggccttcggatccaacgaccactcacggggagcgacgccgaccacctccgcccccaccgaagcgagaagccgccctaccgaacgcgcgacgcgcgagtggcgcagatcacccacgatcgccacccgacacccctcaagcgcgccaaacgcatccgcacgcccgccccgagtccgagcaaggacgcagacgtcttggagcgcctgcgtcggatgctgaccgacaccgtcgccagcgttgacgacgatgccatcgaagaatctggctaccacgtcggccgtaccaacccacggagcccgcacgaccacgccactcgtcccctgcgcagccagcacgcgcaacgtgtcgcgaagactctcatccttgacgagcgagctgctctccggatcgatgcggacggtccgcccgccgagccgatcgattgcagcctcgaacgacagcgccgtacgcgtcgacggctccaggaacagcaacgcaacccgtcgcccctccagacaccgcgacgccgccgcgccatgaacgagctcgtcgacacgcgcgcccagcacgccaaggcgccccgcatcgagctgctcgacccccaggaacgttgcgctcatcgcccttccgcctcgatccacacaccggccgcatcgacaaccacgtactcgttacgcgctgtcggcaggttccgacccacgatgtcgggccgaatcggcagctctcgatgtccccgatcgacgagcaccgcgagcagcacacgctgcgctcggcccgcacgcaagacggcctcaagggccgctctcgccgtacgcccagtgaagaccacatcgtcgacgaggacaacggtccgtccctcgaccttgatcggcggcaaccatctcggatcacctgccggctccgcatcgtcgcggaactgcgtcggatccacgacgaccaacggtaccgctacggagcgaatcgactccaacgtgtcgacgaggccacgagcaaccgggacaccgccgtcggcgatcgccacgaccacgagatccgctccaccgcgcgtcgcctcgacgacctcatgcgccatccgacgcagtgaacgaacgatgtcgtcagcgtccaacacacgccgccgacgcatcgcaacctccgtttcggcctcacaggaccgtccttaacggctaccacgacgagcctagcgtgtcggctctcgccgcggcacggacggacgaacctcacacgcgcgcccgagaacgatcgatggcggggagcttcacgccccccgccatcgtcagcgaaccagcgagatcagccggaccctaccggcggctaccgagccgccgccgagcgaaaaatccgaacaccaacgacgctgcgaagatcccgatcggaatcgcgaacgtcatgtcagccgctgctgagtatccggtgacacttgcgaacattgacactccctcttgttgtcgtcagccccaacacgaaagacccatgacgctcctactgtatcgcgacgagaccagctcgggcgaccactaccaggagcactacaggaacaactctaccgacccacggcagcgaaccaccggccgatctacgggcgccgtcgcaccgaacgaccgatccgcacaccaccagtgagacgccccttgagcccgtcccgttcctcggcgtccaaccacagcttcatcttctgcgccccgagcacgaaccacacggccccaccgccgatcaccaagatcgccgccgcgatctgctggtcggtcatcgcgccaagaatcccatcctgatggaccaggtagccgtaccaggtgcccggtgcgaggcccatcgcgatacccacgcccatgatcaccatggccgaggtccacgcgacgatgacttgacggatgtgggtgatctggggcctgccgtctcccatcagcaccgccattgacagtgctcctgcagtcccttgggcaagcaacgtcgccgtaccgacgaccggcacggcgtggatccatgactgccagaaaccctcgaactgacccacgaccaacaggtcatcggcgacggcaaccagccagacccatcgcaccgcccacgcgacgagcggcccacgcccagcgagcggctcgtccgactgcgtcaactcgtgccaaaagagcgcgagcggcaccgccaggaccacaatgctcaccagtgcatgcaccgcgaccacagccgcggacgccaccatgaggagcggattcgccaccagaccgagcgccacgacgacccaacccactcgacgccacatcgaaacgcgaccgcgtcgaatcagagcagccccaacggcgacgacccccacgctgaggagcgccgcaacaacgttaccgatcacgccagcacccccttgcgacaactcctcgcccgacgacgaccctctgcatccaggccatccgtcgccgggaatcgtgctggcggggcacccggaaacccgcgtgccccggccaacactcaactcactcgagttcccaccctcctagtggaggatgaagtacacgtaccacgaaaagatctggaccaacacgaagaagatggagaaggccccgaagccatcgaggtttgctcggaagttctccgccaggcgatggctcgaaacgccgacgccaccgtcgacccggaagaactggtagctccgaatcgcccgcatcaccaacacgaagatccagtaggccgccaggaacaaagccaacgcattcatcacagcgaacgcgatgtacaccccggcatagccggaatacccaggcgggaacggcaatctcgtcaggctccagatctggaaccccatggcgagcagcagcaacagcacattagcgaggcctgccacgatgaagtccatcgtgaacccacgccgcaggcgccgattcgcaaacagctgcaccagcagaccagccagcgggagcagcatgacgaggaagccaaggatcttcgaggccgtcaatccgtgtggatcccacaggccgttggagttcaacgactgaaggtagaagaacgagaagtagatcccgccgtagaacgcagccgcaaccgggatcagcgttcgagacgccgtccacagcgcacccagctgcgcatcatggtagtactgctcctcatcgatcgcaggcggctgggcctgcacacccgtagccactactcctcacctccagcgacgacagcggcctgctcagccgacggatggagctcggcaaccggaccccgatccttcacgccgtactggtacgggctgcgaagcacgaccggaatctcctcgaagttgtcggccggtaccggatagccaacctgccactcaagaccctccgagcgccacgggttcggaccagccggcgtccgccagacggcgagcgaccagatcagattgaacacgtagagcaggattccgaagccgagcacgtacgaggagatcgacgcgaactggttcaggtgctggagccgaagggcgtactcgaacacgcggcgcggctgacccagcagaccgaccatgaagagcggcaagaaggtcccattgaagccgagcaggatgagccagaaggaccacttcccgagcttgtcgttcaaccgcacaccgaacagcaacggtgtgtagtagtagatcgcgccgagcacgatgaacacgagctgacccatgatcgtgaagtggaagtgcgccagcacgaagaagcttccgtgcaccaacgtgtccaccggcacgtccgagttgaacactcccgtcacgccgccccagaggaagttccagaacacggcgagaacgaagagcatcgggacctcgaagcggatctttgcgcgccagagcgtgcccatgctgaccaggtacaagaagccggtcgggatcgagatcagctccgtggtcagcatgaacagcggacgcatgtccgggttcatgcccgacatgaacaggtgatgctgccacacgaagaagctcagcgcagcgataccgatcatgcccgccgccgaggtcttgtaggcaaagaccggcttgcgtgcgaagaccggcaagagctccatggtcatcgcgaagccaggcatcgccatgaggtagacctcgggatgaccgaagaaccagaacagattctcccagaggaagctcgagccgccgtggcccgcatagagcatcgacgtgcgcacggcacgatcgagacccatgatgaagaggccatctgcgaacaccggaaccgagagcaacatcgtgaaggccgtcgtcagcaaaccccacaccaggatcggcatccgagaccacttcatccccggcgcgcggtagttgatgatcgtcgccaccatgttgagcgaaccgatgatcataccgatgccgaccagagcgaaaccgacgtcgtaatcggactgtccgggtccaccctggatcgagagcggtgcgtagccagtccaaccggcctggaatccaccctgccacagcgccgagatgatgaccatgtacgccgcgacgaggagccacagcgacaccgcctcgaggcgggggaaggccatcttcttcgacccgatcatgagcggcaccaggtagttaccgaacggaccgagcacgagcgacgtcgccatcgccatcatgatcgttccgtgctcaccgaccacctcgatgtaggtatcggccgcccagatgtggtacgtcggcgacaagagctccgtgcggatcgcaagcgccagcaaaccaccggtcaggaagaacagcagcgtgacgaacaggtactgcacgcccacgaccttgtggtcggtcgagtacgtgaagtgctcccagaacgtccgcttctccgacttcggcgggtccttcggttcccatccgagaagcttctggatcgggtagttgaagaccccgagtccagcgagaaagcctacggcaccgaagatgagtgccaagtacacggcgatctcgttctggccggagttcactaccaccgtatagcccgaggcaatgaagttgccgagccaatggccgaacgcgtagaagatcgcgcctccaacgaggccagtgaagaagttgcccgtgaaccacgcacgtgcgaacttcaaccctcgagcctcgaggtcacgctgatcgacgatcgccgcgctcggcgacatctcaacagccatcgtttcgttcccttcctcagcgttcctagtacgcaaccgagtgaccgttggggtcgtagctcgggtagtagccaccaccggcccccgagtacgacggcgtgtacgtcaacgcgaacggcggcaggagcttggtcacaccagcgttcgcagcctgcatgttcgtcgcccacgtctcgaacgacgatgctggcaacacctcgccgtagttgtacatcgcaccatgccagatcccgcaaagctcgtcgcaacggacggtgatcttgcccgtctggctcgtcgtctcggtggtcgcgacgttgttgacgcccggattcgcatccgccttgactccgagctgatacgcccagaagtcgtggatcacgtccagagacgtcacatcgaagaccacgcgcgcgttggtcggcagatacagctcagtggtctccatccccccgaactgcgggtaccgataggtgaaccgccactgttgcgcgatgacctgcacgacgagcggcgtcgagcctcccggcgtccacgccccctgcggcgttgcctttgcccatgagtagttccagatcggcgacgggccagacccactccccatgtcatggttcgcgatcagctcgtaggtaccgaataccgccaggccgagcacgagcacggtcgaggccacgtaccagattccctggatcttccgattgccgaagaggacaatgccatcctggtcctcttcacccttacgggctcggaagttcacgagtgcaaaaccaccgtacacccagaccatgaacaggactgggaccacgagcaccatcagaatcttgaagtcgaactgctgggccgcagccgacgtcgtcatggtgccgggcggcatgtggggcccccacacgaaccacgtcagatagtcgacgatcgccgtcaggacgaaccagaccgcaaagatctgccaccccttggatcgcgcgaaagccttgcgctcctcacgctcctgttgtgtcagcgccatcacgccaccaccttgaagaagccagccatgtagccagtctcggccataggaccaccgttaccttcgaggtagccaacgccgcacgggatgaagcactgccagcggtaggtgtgcgtcgtgttgccggagtagaacgtgaaggtgatcacgttgtgcgcctccgacggattgcacggaccctgctggcagaagttcttcgcattgccgttgacgccccacaccgggatgttcaggccgagcgacggggcatcgatggtgtgtgcgacaccattccccgaggcagcatcgagaacgctgaccggcttcccgttcagatactcgacaccgccctgcgtccccaggaccttgccccagtaggggttccgcaacggcccgcccgagtcgtactcgtagaccgtcacgtgcacgtacgtcttctcaggaacctgatagatcgtcgtgcgtacccacttgccagcggcatccttcgcgtaccagcccacccattgcgggtgaggaccggtgccgacggcaccctcgacctgcaacgtcaggtcgacggtgttcggctgtgtcggcgacggagttgccgccaccgtcggcgggtacgttcgcaagtatccgaagatgccaaacaggatcaacccgatggcgatcgccgcggatacaagaacgatgcccgcccttgctcccttagacaacctcaaccccctatcacctagggccttccccactgcgcctccggcgaggctgcgagcgcagctgctcgaacgagctcactgcacccggacgaacctggtgctaaccgtggtgggccagcgcgtccaacttccgaagccagttctccaaggtggacgacgaaatttgaccctgcaccgcaccgatgacgcgaccgtcgggtgcaacgaagaaggtgtcagggatgcccacgagcaggtaggacgactggagcgatccggcgtcgcgcacgactggatacgagacccccgtgcgcgccagaaaggcgagtgcagccgatcgctggtcattttcgtccacaccgaggaatgcgacgctcccggcggaagccgccgccgccttggcgagcatcggcgtctcggcgttgcacggtccgcaccacgacgcaaagaagttgatcaccaacggacgcccacggaaggatcccggtccgagcttcgacgcgctcgaatcgttcgcgaggaccggcagcgaaaagccaggcaccgtacgacccacgagggccgaaccagacgacgaggccgtgagcgaggccgaggccccgttcgttgcggatcgcgcaacacccacggcgtacacgacgtacccaaccgcgaccaagagcgcaagcaccatcgcgaacatgaagacgcgggggcgccggcgaaggtcggactgctcgtaggtgctctcactcgtcgtccgcgtcacctcgacctcacgatgacatcgacagccatcccgacgaacagcaaggacaggtacgtgatggagtaggaaaacacgcgcatcgccgccttcggagagagggagcgcaggagacgtaccgcataccacacgaaccccgcaccgagcaggaccgcagcggcgtcgtacacgaggccgagcccggcgaccgggcccaggacgagggccaggagcaccagcacgaccgagtaggccacgatctgccacgccgacgcgcgacgcgaggcgaccgaaggcagcatcggaacccctgcagccgagtagtcgtcggcatagcgaaacgccagcccccagaagtgcggcggcgtccacacgaagatgatgaggaacatgagccacgcggcgagcgagagctcgtcacgcaccgcagcccatccgacgaggaccggcgccgcaccggccgctccaccgatcacgatgttctgcgacgtcgatcgcttcaaccacatcgtgtacacgccgaagtagaacagcgccgccgcgagcgcgatcgaagccgcgagcacattggcgcccacggacaggatcgcaaacgcggcgacctcaagcgtgacagagaagatcagggcgccccggggcgacacatcaccggtgacgagcggacggcccttcgttcgccgcatgaccgcgtcgatatcacggtcgaaccacatgttggccgcgttcgcaccgcctgccgcaagggtgccaccgaccacggtgatcgcgatgagcgagagggatggcaggccacgcttcgccacgatcatcgccggaaccgtcgtgatcaacaggagctcgatgatccgcggcttcgtcagcatcacgtagccgcgggctgtccgcacccagctccgagagtcttcgaccagcaccggcgacacccctcctcatcacagccacctgtccagtcattcgggcaggacggcgtgctcagcactcgttatcctaccaaccaggtcgtcatctcgtcaaccggaagcaggctttcgtgcatacgcaagacacatcgcctcggcgttcgctcagcttgaacccagccgcgctcgaccgcgcgccgggtccctccatggttgggcaggtcaggggcctgctgtccggacaagctgcgacgacgctggtcgttgtcgacccagcatggatccgctacttgacgggattcgacggttcccacggcaccctactgatcgatctgcgcgatgaggatcggcaccttctgtgtacggatggccgctacgtcgaggctgcgggtcgggcacttggggcgcgagggctcgacgggctcgttgaggtgctcggagacgaccccctcaccacgtcgcatcaccgagacctgctgcgcgcaccactcgctctgctcggctcgtgttggtcgctctcgaccctacgactgctgatggagatcgatccgactcccatcgacgcacagcctctcctctggccgcttcgggccgtcaagcaaacctgggagctcgagcgcatccgcgcggcagcccgactcgcggacgacgccatggatgctgcccttgcgtcgctcgccgacgggccaatctcagaacgccttctcgcggcgacgtacgagttcgagctgcgtgcacgaggagccgatgaacccgccttcgcgaccatcgtggcggcgggatctcatgcctccgaaccgcatgcgaggccgagcgagcggctgatcaggccaggcgacatcctgctggtcgacttcggcgcaacggtggacggctatcgctcggacgccacccgcacgatgctgccgagcgaaggagcagaccctcgagtccaggcgtactgggacatcgttgcggcggcccagagggccggaatcgcagccgcgaccgtcggcgcgtccgcgcacgacatcgagacggcagcccgcgccgtccttcgcgaggccggcgtcgaagagctcctcctccatggagtcggccacgcgctcggcctcgagatccacgagcggcccttcaccgcgcacgatcgagatcccctcgccgaagggacggtcatcaccgtcgagccgggtctctatgtacccggagagcttgggatccggctcgaagacacgatcctcgtgggcgcagaaggcccagagtgcttgacccggcccgcgaccgagtctcgaacgagaccaggttccgcagctcgcgtgcgcagctaagctggtagctcgcatcgcgcggacgtgcgtccgttgcgcccattcactgttccgcctcggaaggagcccctatggcagtcgctacctcgacgaatgacctcaagaatgggatgaccctggacctcggaagcgacggcctctttacggtggtggagttccagcacgtcaagccgggcaagggcggagcgttcgtgcgcaccaagctgaagaacctccgaaccggcgcggtcatcgaccgtacctaccgagccgacgagcgcatcgaccaagccatcatcgacaagcgggagatgcaagcgctctatcgcgatcaggacggctgggtgctcatggacacgcagagctacgaccagatcacggtggatgcggcgaccctcggatccgcgatgcagtacctgcgcgaagggagcacggtgctcgtcctcagctacgaaggctcgatcgtcgccgtcgaactgcctgctgctgtcgagctgaccgtcaccgagaccgagcctggtctccaaggcgaccgagtctccggcgcccgcaagccagccacgctggagaccggactggtcgtccaggtccccctcttcgtgaacgtgggtgacaccgtcaaggtggatacgcgcaccggcgactatctcacgcgtgcctgaccgacgcgacgactcgcacgacgtgcgcgccgtttggcgcgagcgcgtgctggagctgctctacgaagccgatacgaagggcgaagcgcccgcggacctccttcggggggacgagccagcgttcatccgcgaacggatccgaggtctgacggagcgacgcagcgagatcgacgcacagttgacggcccacgtcatcggatggcagctcgagcggctcgcacccatcgaccgtgccattctccgactggcgaccgcagagctcctggaagcatcgacgccgccctctgtcgccattgcagaagcggtgaaactcgccgaccgctattcaaccgaacgttcggccgcgttcgtcaatggggtcctcgcctcgatcgccgtcgacatcgctggcgagggccaccgcggcgagcccgaccgcgaacccagctagctcgcgacgcgaccgagttcggcacgcaagaagctgggcatgccgctcgtcgagctcagctccacccgttgaggcgagatgccgagctggcgagaaacgctcgcaagctgtgcgttcgctgttgccaggacggtgtccatggtgtgcaggcgccctgcgatcaacgtgacggtgctcatgtcggtcggatgcaccagcagcgtcttcatgtacgcgagcaccgacgctgcgttcgggaacgcccacgcgtagacctccttgaccaccggcgtcaggttgaagtggttcaaggagttcggcggtgcataggtcgccaagttgtagaggtccgagttgaccgcgatggtgcagtactcctcgtcttgttcgatgatcgttcgcgcctcggcgagctggttggacgccttcgagacgatcgcaccgagcgcccgatagccgtcgttgagggcgaccgcacagccccctgcgtcctgctgcatcgtctgcacggcgccgcggaaatcgacgcgctcttgggcaacggtcacgcgctgcgggtacacgatcgcggcctcgatggcgacggacgcgacgaccactgcgccgacgatccagagcaccttgcgacggcgagcaggcgtccggggctcaagcgttggatcagctcggttgacgggtcggggcactgtgctcctccagatcgagtggttcagatcgcgtggcgacggggccgctgctacgccctctcggcgagggccggttcgctctccagtctacggacccacacgcactcgctctcgcaccatctccacgagggcgagcacggcgagttcataggagcggggcccgaacccagcgatggatcctgccacgacgcgcgcgatcgtcgaccgatgacggaatggttcgcgagctgccggattcgacaggtgcacctccaccacggggatcgtgatcgccgcgatcgcatcggcaatcgcgtacgacgtatgggtcagcgcgcccgcattgagcaccacaccatcgaccgatcgaggcgcacgctgcaggagttcgatcacccgagcctcgctgttggtctgctcgaaggtcacggctgctccgaccgaggccgcacgttctccgacgcggcggcgcacgtcctcgagcgtctcggtcccatacacggtcggctcccggaccccgagcaggttgaggttcggaccatcgatgacgagcaggcgcaccgccgtcatgcgcgtgcctcgtcgattgccgcgacgatcaccgcctctggcacgccgtggaccagctcgagaccgctcggtccatcgaggaccatcgcgagtgaccctcggtgcttcttgtccgctgcgagaaagaccatcacctctgcggccccgatccacggcggcacgcgatgtgcgaggccgagacgcgccaccacctcgacgtgctggatcacgcgatctcgcgtgatcctgccgagacgctcggcaacgatcgcctcgaccacgaggccgatcgccaccgcctcgccatggctcaagggccggcgacgcgccaaggcggctgcctcgatggcatggcccaccgtatgcccgtagttcagcagtgcgcgctcaccgtgctcgcgctcatcgcgctccacgacgcgcgcctttgcctgggccgcctcggcaaccgcctcgtcgagcgggagctcgaccagacgatcgaggccaaggaaggcgtacttcgccagctcgccaagaccacttcgccactggcgacgaggcagtgtcgccagcacatcgaggtcggcgacgactcgtcgcggctgccagaaggcgccgacgagatttttaccggcacgcaggttgaccgcggtcttgccgccgatggccgcgtcgaccataccaaggagtgaggtcggcaccgcgacgaagtcgatgccacggtggtaggtggcggcaacgaaacccgccaggtcggtgaccacccctccaccgatggcgatgaggccatctccccgagtggccccggcgctggcgagctcctcagccacccgctccaccaccgcgagccgcttggcgcgctcgccattgggaacctcaatgacaggccagggccatgacgcagggaggggaatcgcggcttgggtcaccacgaaggcctggcgccagtcctccgggacgatctcgcgagagtcctggaggatgccgctcccgaccgtgatggccacctcgtgctgtggcgttcgcatcgagaaccggcgggtcgcacggcctcgcgctgcccacgctgatcggagtgcgctcggaggaccttgcaccatcagcgctccagcgcaccgtcgcgccacggtagcgccgcctcgtgtgcgagatagctctcggcgttgcggcgaaactcggcgatggagtccccgccaaactttctcagggcttcgtccgcgagcaccaaggccaccatcgcctcggcaaccacgcccatcgcgggcaccgcggtcacgtcggtgcgctcgcgaaaggcgatcgaccgctcccccgtggcgagatcgaccgtctcgatcacaggccgattcagcgtcgcaaggggcttcatccacgcggttgccacgatcgggctcccattgctcacaccgccttcgatgcctccagcgcggtccgtcggacgctcgagctgcgaacccacgatggcatcgtgcgcgagcgaccctcgcacgcccgcgacctcgagcccggcaccaatgctgacggccttgacggccgggatcgacagcaacgcctgaccgaggaggccatcgagtcgacgatcccagtgcacgtaactccccaacccgaccggcacgccgtgcgcgacgacctgggcggccccgcccagcgagtcgccaaccttcgcggccgctcgcacctctgcaatcatcgccgcctcgacagccggatcgagacagcgcacctcggaggcgtcgatacgctcgcgatcaccaagcgtcggcacggtctcgacgctcacccgggcggcacccagctgcacgacgtggctcacgatcccgacaccgagaacgccgagcagggccttcgcaacggcacctgctgcgacccgagcagcggtctcgcgtgccgacgctcgctcgagcacgttgcgagcgtcatcgaagccatacttctgcagaccggcgagatcagcgtgaccaggacgtggcgccgtcaacttccgggcggtctggcccggatccggcgacatctcctcggtccacttgcgctcccactccgagttggcgatctcgagcacgatcggcgatcccaaggtgcgtccatgacgcacgccgccgatgatcgtgagcgcatcctgctcgaagcgcatcctcgggccccgcccgtagcccaagcgccgccgcgcaagctcagcgctgatggcgtcgccgacgagctcgagtcccgcggggacaccctcgatgatgaccgcgagcgcacgtccgtgcgattcgccaccagtcaaccagcgcagcatgcgctcaggctagcgagacgccgagcgcactcacgtgagtgccgtgagccacgatcaaagccacgagcgcacccaccgcgatcgctggcccgagaggcaggcggtcacgatggctcccgccgcgcaggagatgccagagcgcaccgagcgcgccgaggctcaaggccacgagcgccgcgaggaccgggacccaccagccgagcggcgcctccacggctccgagcatgccgaggagggcaatatcaccacgaccgagccccccgcgcgacaaccagcgtacgagcatccacgcgcccaccacggcgagcgcaccgccgatcgctgcagccacagcgcgcagcgcgtggggaccgagtccgaagatcacgacctccgtgaccagcgcaccatcgacgagcgagcgcggaatgcgtcgggtctgccagtccacggtcgcaccgaccaccgcgacactccaggcaagcgcctcggcgacgagcgcggcgcccgtcacgcccgaccagctgagccaccacacaccaagacccgccgccacgccagcgccaccatgcaggaacgtcgcccgtcggctcttcaccgcgccccgccgacgggcgagcggtcccacggcacaggcgaccagagcggcggcaaccacagcggctgtcgcccggacaacagcgacggacacgtacgatccgtcgaccgagtgcctccaaaggtttaccgttcggcaagatccgaccactacggtcgagccatggcaccgatgagccagagcgccgacgaccaggactggcgagcattcgacgggctctggaatttccgacccgtcgaggcaatccttgccaacggtcaccgactccgtcccggcaggcttctgcgctcggagcaaccgtaccgactcgacgccacccaacgacgccaactcctcgagcgctacgcgattggcaagatcctcgacctccgaaccgccgaggagtgcgccccgacggagtccatcgacgcgccacgaacgcacctaccgctcccggacgtctcgcgtgacccacgcatcgcagatggttcgcgcaacctggccggtgcctaccgcgcgatgctcgacgaccacgctccgacgttggttcgagccatcgacgccatcggggtgccaacgccggtgctcgtccactgcacggccggcaaggaccgaaccgggatcgtcgtggccctcaccctcgaactcgtgggcgctcggcgggacgacatcgtgcgcgactacgtcgagagcggacgacgtctcgcggcgttgaccgaacgtgccttggctcgcggctacgagccgacgtggcgcgagctcgcgcccgaagtgctcggtgcgcctccggctgcgatcatcacggttctcgagacggtcaaggaacggtggggctccgtggatcggttcctcatgacgttcgggatgacgccaatgcgcatcgaggcgatccgaagctcgctcatcgcatgacgccacgattgcacgcgcgccaaccccaacggctccgcccgaggccggcgtgtgcggcgccgcatcacgagcgctcgcgctcagtcgctcgcgtcgaccccttcaagggccttggcgagcaggttgccaagctggcgcaattcctccggagtcagtcgactgccaagcgcgccgtcaagcgtcgcgaccacaacgggctcggctcggcgcgccaccgtgcgtcccgcctccgtgatcaccgcatacgtcccgcgccgatcggtcgggcagccacgccgcacgacccactcggcttcgaccagccggtcgactcgccgcgacagcgcgctgcgcgacaccaaggcagcatcggcgagctcggacaggcgaacccgtccctcgggagcgctgtcgaggtggtggagcaccaagaactccccgagaccgatgccgcacgcgctctcgagctcacgatcgagcaggtcgacgagccggccctggagaacgagcagcgtgccgaacacctcccgggtcagggggtgctgggctgttcggacaggcgtcgacggcgatactgcttgcatgtgcaactacaactcctatacttcagcatagtcaggaacccatgacacaaggaggaaagcgatgacgctgagcgcacaggatctcggcatcgacacggggcggtggaacatcgacccgacccactcgacggtcgagttcgtcgtcaggcacatgatggtttcgaaggtccgcgggagcttcgagaagttcgagggctacgccgacatcgccgacgacgtcacgcagagcacggtcactgcgaccatcgacgcatccacgatctccacgcgcgacgagaaccgcgacaaccacctccgcagcccggacttcctcaacgtgaccgagttccccaccatcaccttcacgtccacccgcatcgagcccgcaggtgagaactggaagctcgtcggcgaactcaccatccgcggcgtcacccgtcccgtcacgctggacctcgagttcaacggcacctcacccgacccgtacggtgggaagcgtgccgggttctccgcgaccggcgagatctcccgcaaggacttcggtatcgagtggaacgctgccctcgagaccggtggggtcgtggtgagcgacaaggtcaccatcaacatcgagatcgagctcgtcaaggcgtaaggatcgagcgaccatactaccgagaaggggccgggtccgaagacccggccccttctcgcgtaccacgagcgcacggcgggcctcacccggatcccgatcgcggtcacgacgagccggtcacgacgagcgaggtgcgcaaaccagggccgtcgcctacttcttctcaggttggtagtacgggttgttgccggcggcgtgattcgtcacgtcgacgacgtcacgaatctcgggtacggcatctcgaatggcgaccgcgatgccctgcgtcagggtcgcagaagccagtccacacccctggcatccaccacccatcaacacgtaggccacctcgtcgacgacgccgacgagttccgcatacccaccgtgagctgcgatggccgggttgacctgctcctgcaggatgctgtcgacacgtcgggcgagatcgctcgtgagcgcctcgggaccgaactctggtagatcgctctggcgcgtcggggcgttcggattttcaatgacgaggtcgccatcgtcgccgacgtcgagcgtcgcgtcgcgcagcgcctcgatcgacgccgcaggaatgacgacaacgagatcgcccacctcgacgatggcgtctgcaccggacgccatcgccagctcctgcaggtacacgtcgtaggtccactggtcgcccgtcgaaccagtcacctcgatccagagcgcgatcggcgcctccgcttgctcttcggcgatcgccgcagcgacgacctccgctgcacgctgcgacacagccatcagtcccaccgcgcgcctccttccgctcaccactacgatcctatcgacgtggcacgccttgccctcgtggtccccgcgcatagttaccgagggaacgatttcctcgcagctgcaacgccacaccagctcacgatcgtcaccgatgccgaggagccactcggaggtgaccacatcgtgcgatcttcgctctccctggatgcgtccgagacagatcgcctcgcccaggtcctcgtcgagcgcagcgtcgaagcggtcatcggcgtcgacgagtactccgtccagctcgcagccgatgtctccgatcgcatgggactcagccacggccgtggggaggcaatccggcgggcgacacacaaggaccaactgcgcagcaccctcgatcgcgcggaactgccacagccatcgtggcacgtggccgacagcgtggccgccatcgacgtcgactggctcgagcgcgcgctcgggcctggcccgtgggtgctcaagcccctcgaccgaaccgcctccgagggagtcgtgcgcgtcgatgcgtccacactcgcctggggacgcgaccaactcgcagccgtcgtcggatcgcacgcgccggtcctcgccgagaccttcgtaccgggagccgagatcgccgtcgaggcgatcctgaccgacggcgcactcgagatcgtcacggtcttcgacaagccagacatcggcgatggaccgacgttctgggaagcgacgtacctcgctccgagctccatccctctctcagtgatcgaagaggttcgtgtgctcatcgaacgagctgcacgcgccctcgacctccacacgacgccgatccacgccgagttacggctccctgaaggtcggccggtgatcatcgagctcgcgccacgcaccatcggcggacgctgtgctcgagccattcgtctcgacgacggtcgtcatctcgaggatctcgtcatcgagcgggcactcaaccagccacgcacgatccctgcggcccgccgtggtggccccatcggtatctggatgctccccacgccccacgacggcaccttcgagggtctcgacggcgtggaagtggcggcagcgatcccaggcgtcgagcgcatcgagatgaccacgaccgccggcaccacggtgtacgctcccccacgaacccgcagctatctcggcttcgtcttcgtgagcggacgaagccgccgacgcgtgctctccacgctcgatcaggtccgttccgtgcttcgtccccgtgtcgctcccgcttcctagactctgagcggtgaccgctccgcgtaccgacgcagcacgagtactcctcatcaccacctacgacctcggacaccgtccccaactcgcggcgttgctccaggccgagctcgccgaccgactcacggtggtcgacggcaaggccgatgccgcagtgctcgcgagcgagattcgatccgccgactggatcatcctcaccacaccgatgctcaccggcgcgctgatcgccgagcaggtcctcgctgctcacactgacctgctcgccgctcggcacgtcctcctggtcggcgcctacgcaacgacgacgctccacgcgctcggcgagacacaccacgggatcatcgcactcgaccgtgacgatcctgagctggtccttggcgccatcgaacccgagcgaccgctccgccgaggcgggcgtcgtcactaccgcgtgacgacgagcgaaccgctggaccgctatcgacacgccgagcgcaacgggagctggcagctcgccgggtacgccgagaccacgctcggctgccgccatggctgcctgcactgcccggtcgccggcgcgtggcacggtcggatcgtgacgctggacgcgactgacgtgctcgccgacatcgatcgccaggtggaagcgggtgcctcccacctgtcactgggcgacgccgacttcctctcggcgccccgtcatgcgctcgccatcttgcgctcggtccacgaacgtcacccgcagctcagcgtcgacgtcaccatcaagattgccgagctcgcagcggatccaaccctccccgcgcgtctcgccgaactgggcgtcgccttcgtgatctccgcggtcgagtcgcttcgcgacgacatcctcgaccgcctgggcaagggtcaccacgcgcacgacgtcctggcagctcgtgacgcgctcttcgcagcaggcgtcggcctccacccgaccttcatcccgttcacgccatggagccgcctcgaagaccttcacgacattctccgcttcgtgtgggattcgcatctcgaagacgtcgtcgaaccggtgcagtacggcatcgagttgctcgtgccgacgtcgagcctcctcgagatcggccccgagttcggcgacttcgacccagcgacgctgagtcggcggtggaatccgagcgaccctcgtctcgatgggctcgctccgcgcatccgcgccatcgcagcgcgcagcgctcgctacgacgagggcttccgagccgtctgggaactggcagggctcggtgctctgccgtctcgcgggccgcgccgagcacccgcgcccaccttgatgagcgaggcatggttctgctgcgcagcgcctccacgatgaccgacctcgacgacctgctcgatggtctctccgacgcccagcgcgaggcggtcctcgccccggcgcccgttcgggtcatcgcacccgcaggctccggcaagaccctggtcctgacgcgacgtatcgctgctcagatacgactcggcgccgtacgaccccgcacgtccgcagcgctcacgtttacgagagccgccgccttgtctctgcgtcaacgcctggctcgcaccctggatacgaccttgccgatcaccacgacgatccatggtgctgcgctcgtctggctgagcgaactcgctcggctggaggggaaggccctcccaccagtcgtggagtccgaaaccctcgtgcgcgccgcgcttccgaacctctcgccggcggagcacgcggcggtgagagctgccctccgcggccagcgaccgacgtcacccgcgcacgaagcgcacgtccgcgcggtccatgagctccgacgacggcgacgcgtcatcgatctcgactccatcgtcggagagctcgcacgacaactcgaacgccagcccgaacggcgcggactcatcgggatcgaggcgctgttcgtcgacgagttccaagactcgacgcccgaccaacttcggctgttccgcgcgctcctcggtccggatctggccggactcaccgtggtcggcgacccgaaccagtccatctacggctggaacggcgccgacccgaacgtactcaccgacctcgaaccgcccggcttgcgcaccgtgacgctcacgacgaactaccggagccgcgacgagctcgtccgtcacgcgaccaggatcctcgatccgcagccacacgttcgaggagcacgtccaggcggtcgaccacccacgctgcgcggctacgccacgccagagcgagaggctcgagcgctcgtgcgcgaactcggcgggctccacgcgctcggtgtcgcctggcgtgcgatggcggtactctcccgcaccacgcgcgcactcgagcccgtgacggcagcgctcgaggccgccgagattccagccgtcgtgctcggacggacgcgcacggtctcggccatgctcgcacgactgcgctcgctgcgagatcgacgcgcgaccgtcgggcacctgatcgacgagctgagttcgatgcaggtcgacgacccttcgcaccagcacgagctcgaccaagttcgcgacatcgccatcgaactccaccgtgtcgatccactcgcagacctcgcgaccttccaggagatcctcgagcagcggctggcacggcgtctcgacgcggtcaccatcgcgaccttccacaaggccaaaggcctcgagtggtaccacgtccacgtcctcggcgtcggagagcgcgcactgccgcatccgcgagcacggacgagcgcgcagcgcgaggaggagcgaaggctgctctatgtcgcgatgacccgagcgaccgattcgctcagcgtgagctggcatggcggggggccgagtccgttcctcgcaccgatcgtcggtgatcgagcacccctccgccccacgccgagcgcagcggccagaggagccgtcgcgcgccaacgcgcgctgcgccatgccctcgtcgcccaacgagctcgcctggcgcgcagcttcgcgatcgcgccgtcgatgctgctgagcgacgagagcatcgagaccttcgtacgaaccccaccacgatgcgcggacgacgtggtcgcgcacctcacacgcgttccgccagccaggcgccgcgcggtcgctcgcgccatctgggcgtgcgtcagcgcgcctgccgacagctaagcgagatccacgacgagcggtgcgtgatcggaagggcgaggagcccgccgggcctcgatgtccacatcgaccgcaaccacgttgcgcgcgatgtcctcgctggcgaggaccaggtcgatgcgcatccccatcccacgacggaaggcgccctgccggtagtcccaccaggtaaagcccggatcgtcagggtgaagcgcgcgatagacgtcggtgaggccgagcccgaggagcgcatcgagcgcgcgtcgctcgggcaacgacacgtgggtcgcgccttcgagcgcggacggatcccagacgtcgtggtcgctcggtgcgacgttgaagtcaccgccgaccaccacaccgtcggcaaccaggtctgcgagatgtgcccgcagctcggccagccacgtcagcttgtagacgtagtgcggatcatcgagcgcacgaccgttcggcacgtagacactcatgaaccagcccgcctcgagcctgaccgcgagcgcacggggttcctcggtcgccagaggcgctcgcgcgaacccggtcccatagcgcacctcgcgaggagcctcgcgggtcaggaccgcgacgccgttccaggcccccgtgccccagtgggtcacgtgatagccgagcgagacgagggaatcggccgggaactgatcggtggccaccttggtctcctgcagcaggagcacgtcgggggcgacacgctcggcccacgccaccaccaactcgatcctggcgcggatcgagttgacgttccaggtcgcaagccgcatggtcacgcggtcggcgcgatcacgaacatcagctcgacctcggcgacgatcgcgtcaccgaccctggcatgtccccgaccgcgtccggccctcgtcgacagcgaggagagctcgacctccaatcgcagctcgtcgcccggcaacacctggcgccgaaaccgtgcccgatcgaccccaccaaacagcggtagccgaccagcgaagcgctcatcggcgagcacggccgccgcgcccagttgcgcgatggactccacctggtagacgcccggcaggaccggccgccctgggaaatgaccggccaggatcggcaggtcgaccgggacgcgccacctgcccgcggctcggagacccggctcgagatcgtcgatcgcgtcgaggagcaagaaggggggtcgatgtgggatcaacgtggtcggatcgatcgctgccacccgtcctcctcggtcctccccgatcgcgcccctcgccgcgccgtcaccggcgacctcgagcggacctaccctagcgggctaggcgacgtcacgaacctgcgacttcacggccgcgagcagggcaggcgtcactcgcttgagcccgtgcgcactcacgacgtgctcctggatgtgggcgagcagttcctcatccgtcgccgccgctgcatgccagtcgcacagggggatcacatccccgcaccggaactccttcatggttggccctccttcttgacgaacactggatctgtgacccggaccacgccgtcgagcccaacgcactgccgcagcgccatcgccgcgaggaacccaccgaggtctgcgcccggaaggcccacgttgcgctggccacgacttccctgtggcggcacgcttcctaccagcgtcatggtagctcaccgcgacgacgccggaccgaggttggcccaccttgcacccataccatcatcggcgaccgtccaagacgcaccgaacgacccgcgacggcttcacgacgccacacgccgcgccgtcggcgtcgacgaccacgatcggctcgagcgcaccgtcgtcgcgcacgagcgcccgttggagcagcacgtcgagggggtcttcttcgtggacgacgaggggtcgttcccaacgctggcgtcgctcgccgttcgaccaacagcagccgacggccaggggtttgcgccctgtcggctgcagcacccaccaacccgtcggcggtgcgtcggccagtgcgccgatacgttcggcaggctcaaggtactcgccagcgcagctgtcgttcgaacgtggcctgtggacgtgcatgagtcgttcacgcagcacctggtcgagatcgatcggctcgggtgatggacggccaaacaggtaaccctgcgcaagagggatgccgatccgcacgatctcttcgagttctccgtaggtctcgaccccctcggcaaggagccacgcatcgagttcaccgaggaatgcgccgaaggcggatgcgagacgactgcgcgccgcgtcacggtcgatcccgttcacgagccctcgatcgagcttgacgatctccggtcgcacgacgaggagcgccgcaaggcccgcgtacccggcgcccgcgtcgtccatggcgatgatggcgccgcgttcccgaaggaggtcgagtctcgcggggagatccggcaggtcatggagcggaacgtgttcggtgagttcgatgaccaacccctggagcgagggcagtcccacgacggcctcgaaggcgcgcgactcgagcgtcactggactcacgttgatcgcgagaaagtgctcgccgagcagatccgctcgtcgctcgagcgcagcgagcgcacacaaggtctcgagctccgcccccacgccaaggtcccaggcggcagcgatcacgcgatcaggtccgatcctgcccatggggtcgagccgcgcgagcgcctcgtagcccgcgatccgcggaccgtgcaggttgacgatcggctgcaggtgcgtgcgaggagcgatccgacccgtgacgagatcgtccacgaggtccgccaagcttcgcgggcggacaccgtcggagcgatcagcgcatcccactccctggagatccacgcccgcctcctgctcggctcctgtcgcttccagcagtggtgatctcggctgccggagcgcccacctgaagcgacggccgccgcggcgggctcacttggcgcgatgggggcgcgagcctagactgaagctgatggcgagcgcacccgacaacagcactgtgcagcattcggcctccgaacagttcggacccaacgactggttcgtcgaggagatggcggagcgctaccgagccaatcccctcctcgtgcctgagagctggcgtgcgtacttcgagggtgagcgcgtccccgatggcgtggcgacgaagaccatcgccaccgctacggcgaaagagctcgttggcttcgaggctccaggcgtcgcgacacctccgacgacggcgacaccggcgccgacttcgcctccgcacaacggagccacaccccagaccgcgccgttcacccctgcatcgtccccagaagccgtcgacccgctgacgccgccgaggagcagcgctcccgagacggcaccgcacgcgtccgaacccgcagtctccacgacgccgaccgtcccgtcagcacagcccctccgtggagcccagggcgccttggcacgcaacatggaggcctcgcttgcggtcccgaccgccaccagcgtgcgtgccgtgcccacccgcgcactcgaggtcaaccgggcaaccatcaacgatcagctccagcggctcggtcgatcgaaggtctcgttcggtcacttggtcgcgtgggccatcgtccgtgcgctcgtcgagcatcctcggatgcacgcctcctacgtcgccgacgccgacggacgcgggcaccccggcatcgtcatcccagagagcgtgaacctgggcatcgccgtcgacgttcagcgccccgacggcacccgctcgctcctcgtgccggtgattcgcaacgccgacaccctcggtcctcttgggttcttcgccgcctacgacgatgcggtccgcgcggtgcgctcacagcaggcatcgcccgacctcttcgtcggggccaccgcctcgatcacgaaccctgggacgatcggcaccgagcactcaatcccgcgtctcatgcccggtcaaggggtgatcgttggcgtcggggccatcgcctaccccgccgcattccaggctgcagacccacgactcctcggcgaactcggtgtctcgcggacgatcaccctcacctcgacgtacgaccatcgcatcattcaaggcgccgagtctgggcagttcctcgcgacgatcgccgctctcctcgaaggagaacaggacttctacgacgagatcttctcggcactccaggttccctacccgcccatgcggtggcaggccgaccacaccagcatgcagcccgacgcgaccgagcggctcgccaagcaggtccacgtccagagcctgatccaccactatcgggttcgtgggcatctgctcgcgacgctcgatccgctggacctgacccgtcccaccatgagccccgaactcgatccggcaacctacggactcacgctgtgggatctctcccgacccttcctcgctgaagggctcgtcccagggggtcaggcgtccctcgaaaccatcctccaggtgctgcgcgatacctactgccagaccatcggctacgagttcatgcacatccagagcccggacgagaagctctggatccaacaacggatcgagggctcgcaccaaaccctcacgaaggatgaccagctccgcatcctcgcaaccttgaacgacgccgaggcgttcgagaagttcctgtcgacgcgctacatcggccagaagcgcttcggtctggaaggtggcgagtctgccatcgtgttcctccgggaggtcctcgatcacgccgccgagacggggacacacgcagccgtcatcggcatggcgcatcgcgggcgcttgaacgtgctggcgaacatcgtcggcaagtcctatcgcacgatcttcgccgagttcgaaggcaacctcgacccctcgagcgtgcagggctcgggcgacgtcaagtatcacaagggtttcgagggacactatcgcactgcgagcggcagcgagctgcccgtcacgctcgcatccaacccctcgcacctcgaagcggtcgatcccgtcgtcgaaggcatggtgcgcgcgctccaggatcagcgtggcacgctctacgagttcggtgtcctcgggatcctcgtccacggcgacgcttcgttcgccggccagggcgtcgtcgccgagacgctcaacctctcgcagctgcctggctaccggactggcggcaccgtccacctcgtcatcaacaaccaggtcggcttcaccacgaacccatcggaggcgcgctcttccttctacgcctccgacatcgccaagaccatccaagcacccatcttccacgtcaacggcgacgatccggaggcggtggcgcgctgtgcgcggctcgccgtcgagtatcgagcgaccttccacaaggacgtcgtcgtcgacctgatctgctatcgccgtcacggacacaacgaaggcgacgaaccgagctacacgcagcccgtcatgtaccacgtgatcgagcagcacccgtccgtgcgccgactctacgcagatcagttggtacgttcgggtgcgatctcggaggacgaagccgaccaagcgctcgaagcgtacctccagcggctcgcgacggcgcttgccgagactcgcgaggcagcaccccccaagccgaccgagctgccgccagagccagcacgcgacgtcccactcccgatcgtcacgaccgcggtcgacaaggctgcgctcgactacgtgatcgagacgatccatcgggtgccagaggattttcacctgcatccaaagctcgctcgccagttcgagacgcgccgggccctctacgagcagggacagctcgactgggcgctcggggagctcgctgcctacggcacgctgctgctcgaggggcacgacgtccgcctcagcggccaagacacgcgccgcggcaccttctcgcatcgtcacgccgccctctacgactacgagacgggcgcgatggtccaacccctcgctcgcttgcgcgacgacgaggtgccggtgccgcacgcgtccccgatcgggcgcttcatggtgtacgactcctcgttgtccgagtatgcggcgatggggttcgagtacggctactcgctcgtccagcgatccgctctcgtcatctgggaggcacagttcggcgacttcgcgaacggcgctcagatcgtgatcgaccagttcatcgccggagcgctcgacaaatgggaccagcactcgggtctcgtgctctacttgccgcacggctacgaaggacaggggccagaacactcgtccgctcggctcgagcgcttcctcgcgctcgctgccggacccaaccttgcggtcgtccaaccgtcgacggccgcgcagctgttccacctcgtgcgcgcccaggttgcgcgcaccccacagcggccgctcgtcgtcctcacccccaagtctctgctccgtgcgcgtgagacgcgctctgcgatcgccgcgttcactgacggaggtttccagccggttctggccgacccgttggtcgacgacggcgagctcgagccgacctcagtgcgacgactgatcctcgcaagcggcaaggttgcctacgaggcaatggccaagcgagccaagggtgagctcgccgcgccgaccgccatcgtgcgcgtcgaccagctctacccctggccccgtgaagcactcgccgcagcactggcgaccttccccaacctcgccgaactggtgtggctccaagaggagcccgagaacatgggcgcctggccgtccgtccacgagctgctccatcgcatggacctcaatggggcgcggctgcgccacgtctctcgcgtgcgcgctggctctccggcaacgggctccgctgcgatgcacgcgctcgaacaagccgacctacttcgtcgcgcgctcgaggcacccctgccctaggccctcgcatgccgtgctcggctcgcgtgctcagtcgaggcgacgaatgaagtcgcggaccgcctcggcccaggccgctggcgccgacaggtgcaccccgtggggagcgcccctcacacagtaggcctcggcatcgatgctcgccatgagtgttgcaagtcctcggcgatggcgagtccctgccagctcgccgatgcccgcttgcaccgggaccgagatccggtcgaggtcgatggcaacctcaccagcagcgagctcggcgagttctcgcgtgaaggctggggcctctgctcggcgctccgcaaggaagttcggcccgagctgtgcgagcgcagggcccatcgctcgacgcaggaagtcgctcaccagctcctcgaggtctggttcgggaacctcacccgccagcaccgaccgagggtccactgcccacggtccccaccacgccgacgtcggcaggggcgcctcgaagacactcacgccacgcagcgtgggcggaggatcgctcgccaaggcgagtgcgagcgtccctccgagcgaatgaccaacgaccaccgtcgcatgctcgcgccccaccacagcccgcaggtctgcgaggtgcgccgtgaaggtggcgggccccatgtcccgagagcgcgcgtaaccacggcggtcgtagagcacgacctcgagcggtgcgagcgctcgcgcgaagcgtcgaaaggtcgcagcacgatcgagcacgccgtgcaccacgacgacgcgcggctccgagcccgcgaagcgatcgaccgccaagtctcgacccacgctggcagcctacgaggccgacacgcagacccgctccctcgtagactcgctgcgtgcgcgccgtagccccccgaaccctcggcctcgccgaggccgcgctcggcggcggcttggcgctcggccaatggctccgcaggcatccacacgccgcgcgagccctcgtcgtcggcaccgcctacgacctttgcgcgcgggggccagcgggtctcggtctcggtcttgcgattggtgcggcacgtccagccctgcggggcccgatcgtcgcggggttggcgctctcggctcgcagacgactgggttggttcgcaggccacgccctggccgccaccgctgcgctcagcgccgtgcgcgcggtgcttccaggtccgcgaaccgatcggcgagccgtcgtcgtcgtcaatgcgcacgccggctccacgcgcctcacccgacgcgccctgacccatctccatcggctggactcgaacgtcggcgtcatcgtcgctccgcgagatgccttcggcgcaagcctctctgccgctgcccgccagagccccgaggtcctcatcgtcgccggcggcgatggctccatcagcggtggggccgaggtcgcggccgatcacgaggtcgtgctcggcatccttccgaccggcaccggcaacgacaccgctcgaggcctgcgcatcccactcggcccggaggacgccgcgagcgtcgcgatcggcggcgtcgagaccgccatcgatctcgggctcgccggcactcgtttgttcgtccacgctgtgtcggtgggtgtgatcgcgcgcttcgcggaggcggtccagcaccttcgcggccgagcccggccgctgctctacccgctcgccgcatggcgggtctggcgccactacgacggagtccgcctcgaggtgagcgtggatggacaacctgtccactttccagggacgctcgtcgaactcgcggtcgtcaacaccccacggctcggagggcgtcttggcatctcgctcccgccgtcgcttgcggccgacggccgactcaccgccatcgccgtcacccgctcgccgctctcgctgctggtacgatccttggcctccatgatgcagcagaggcctcaccacccgcacgggaccctgctgacgcgcgacgctcgagtcatcacgctcacgagtgccacgccgaccctggtggcgatcgacggggagccaatcgccgagaccccgatcgatcttcgaaccctccccgcccgcctccgcgttcacgtaccggcgcaacctcggcgatggcgtggcgcggcgtcggaccaccgcacgccaggagacgacgaggcagctagacgccagcagcggtgagcgaaccatcccgcaccgcccacgagagggcggcgtgcacggttgggtgctcgaaggcgaagccgcttgcaccgaggacgctcggttcgacacgctgcgacacaaggaggagctcgcgagccatctcggaaccgaggaccacctcgagcaccggagccgggaccgggagcacggccgggcggctgacgacacggccgaggactgcgacgaagtctcggttccgcaccgggtccgggccaacgaggttgactggtccgtcgagctcggtgtcgatggcgtggacgatggctcgcacctcatcgaccaagctgatcggactcatgaactgccgaccatgcccgaagggccccgcgagaccgagccgcgccatgggcaggagacgagtgagcacgccgccatctggagcgagcacgacacccgtacgcgcaaggaccacgcgaccgacgacctcgcgggcccggagcgcctccgcctcccaatcgaccacgacccgagcgaggaatccctccccggcggtggactgctcggtgagcacctcgtcgccacgatcgccgtagaacccgatcgccgatgcgcagaccagcacgcgaggtggactcgtcagctgtcgcaagccacgtaccacagaccgggtgccgacgacgcgagaggcgtagatcgaggaccgaaccgccgcattccagcggcgctcgccgatcggcgcacccgcaaggtgcaccactgcatcgacgccgtcgatcgcgtcgaaccacgcccgctcgtcgttggtcgagaagatcggcgttcccgccgggtccggggcatcgccccgtcgaagcgcgagcacctcgtcgccacgagcccgcagcaccgatacgagcgcccgcccgatcaacccgctcgcaccactcaccgctacgcgcatgtcaccctccatcgtgtcgacactcgcaccaacgcctcggtctaccgagatcatcctggacgctcaggcatatcgttccgcgcgggcgtcgacacgaacgcgaaagcacgtccaggctggccgcggatacccgcggccagcctggaccaacgcacgatggtcgcaacgatcgaaccgtcgcgacctgacgctcacgcttcgtgcgacgtgagcgcatgcgccgaggcgccacgctcgatctggatacggcgcggacgagcggtctcagcgagcggaaccgtcacccgcagcaccccgtcctggtaggtcgcgctcactcgggacggatcgagctccgaaccgaggtagatcgaccgctggaacgtgccggcgaagcgctcggcgacgacgacgtccttggcgtccgcccgcctcaccgcgcgcgcagccttcaccgtgaggacgttgcgctcaacggtcagatcgatcgactccggatcgacgccgggcaggtcgaactcgacgacgtagtgatcatcctcgcgataggcatcgaccggcgtgaacaccgagtaaccctcagtggtcacaccctgcaccatgctcatgagctcacggaacggatccgtacggaacagcaccatggcacacacctccttgccagtcctcgactgtcacgatcgtcgtgacacttacgacaacaccactctagcaaatctattcccaaactgaccattttcttgagtcacttgccatcatgtttcttgaccctcactccccagtaccgaactcccgatggccactagactgtcgatcacgagcagacaacgcctgtggcaggtgggtcgagcggccacgaccatcgcggcccgcgacacccttcgtcgtatcggtatcgcgctcacgccaggtcccagcaaggacgcggcccagcgagcacggacactgcgcacgacgaccgacgtagcggccgccgtcgcgggcatgcgcggcctcaccgtcaagcttgcgcagatggcgtcctacgtcgatcccgccgcccccgacgacgtccgcaacggtctcgcgcgcttccaagacgccgcaccgccgatgagcgccgacctcgcgctcggcgtcctgcgcgacgaactcggcgaacggctctcgcggttcgccgagatcgaagaggagccccgggccgcggcctcgatcggtcaggtccatcgcgccacgctccgcgatggcaccaccgtggcgctgaagatccagtacccggacgcgcgcgaactcatcaccgccgacctcgagcaagcgccagccatcgtcggccttctgcgcttcgcctttccctcgatgcgcgtcgacgacatcgtcgccgaactcgccacgcgggtccgcgacgaactcgattaccggcgcgaggctgccgtccaggctcgcttcgcacgggcctacgccggccacccgcgcatcgtcatcccccgcccgatcggagcgctcacgacgagcagggtcctcgtcaccgaatggatcgatggcgcaccctttgcgagtgctgccaccctcgagcccgaggagcggtccgagatcggcgagatcctgttccgcttcgtcttcgcgagtctctatcgcctccgtctctacaacggcgacccgcatcccggcaactacctcatcctcgacggaccacgcccgcgcgttgccttcctcgacttcggattctcgcgctcgttcaccgccgacgagatggcaaccttcgaggcgctgatcagggcgcgtgtcgtgacgcccgaccgccacgccttcgccgagacgcttcgagcagccggcctcgtcatcggcgacgaccacgacgacgacgtgctgtgggagttcttcgctccctactacgaactcgtcgagacacctggaccgcgcacggtgacgccggcgtgggcctcgggcatccttcgtcacaccttcgaccgatcgcacccgctggccagcgccgtcaacgtgccaccggcgttcgtcgtggtccaacggatcaacctcggcctctatgcactcctcgccgagctcggtgcgacggccgactggcgtgccatcgccgaggacatctggccattcgtcgctcgcgccccgatcacaccgatcggccaggaggaggccgcctggcgtctggagagggctcgatgagacgcaggctctggtggttggtgcccatcggcatcgccgccgcgatggtcggcgcgcgccaactcctcgaccaacccgcgatcgtggtcccggaggctgccgccgtgagcgccggcatgctggtgtgggagttgcccttgttcacccaccggccattggcgaccgtggcgctgatcgatctcgcggcgttcggcggcgtccaggccgctcgctacgtctcgctgcctgagcccgccctcatcgctctggtgacggtcgccatcctgggggccttcgtcctcttcgacctccccgccctgccagcgctctcggcggggctgctaccgatctacctgcacatcgtggtagccgcgtacgtggtggcggtagcgctcaccatggtgcccgtcgcactcgtcgccgaacggcgccaccgagcaagtcgccgccacttcggcacccacgagcttgcccagatcgcgccagcgagcgccgttgcggtgctgctcgccagcctgaacccgttcctcatgcttccgccgctctacgtcgccacgaccgaagcagccctcggcgctcgcccaccagcgggtcaggaggccatccgtcgttccgtggcgctcgcgacgggcttcgccggcgcgctcgtcctccatctcgtggccccgcccctcgtcgtcgcccccgtcgcggtcgcgctcgccgcgttcgtgagcagccagctcggcgtgtcccttccacctgcgatcgcgttcagcctggttcccctcctgtttccagtgaccgccagcacccttctcgccctcggcggactcgtcggcatcgtcgcaaccgccctcgctccgtggctgcccaacgccttcggccgtgcgcggatcctcctcgcctcgttctcgtcgggtaggctcacggcatcggtggatgacgaggcgctgcctgtgggcgatggcgagtaggcgatggacgaacgccacgaggagcatggcgagggagcacggtgaaggcaaccacagcgatcgagcgatcgcacgcgagcggcgagcgctccacgggacggatcgtacgtggcctgatcgtcgcgatgcgacccaagcagtgggccaagaacgctctcgtcgtagcggcaccgctcgcagcgggcagcatccttcggacccacgtcctcgtgccgacagccctcgccttcgtcgccttcgtcgcgatctcggccgcgacgtatctgctcaatgacactgcggatcgagagcgcgacgccgcccacccgaccaaacgccgacgcccgatcgcggccggcatcgtcccggtatggctcgcccttctcacggcaaccatcctcggcctcggggccctcctcctcgccgccctcgccatcaacctggcgacgctcgccgtcctcgcgacctacgccgcctcgacgcttgcctactcgctcaagctcaagcacgaaccgatcctcgacatcgcgatcgtggccggcggcttcgtgctgcgcgccgtcgcgggaggcatcgcagcgcacgtcttcatctcgcactactttttgctcgtcgccggcttcggcgcgctcttcgtcgtggcctcgaagcgctatgccgagctcaccgcgaccgacggcgagagccgcacccgcagcgtgctcgcttcgtactcaccaggcttcttgaacctgactcgggcactcgctgccaccacgacagtcgtgacctactgcttctgggcgttcgagcgcagcgccgggctatcggatggtcgcctcgtgcttggcttgtcgatcgtgccgttcacgatcggagtccttcgctacgccctgctcgtcgagcacggccacggggaggcccccgaggacctcctcaccgccgatcgcacgctgctcgggatcggcatgctctgggtcgcgctcgtcggaggagcgatcttccttgtctaggcatatgagccaacccatcgacgcggcgaccgatcaggccccacccttcgaggagcgttggacgctcctcgaagggtggggccgaacgccccgctcggcggcgtggcttcgcgaagcgacagacgacgccgtcgtcgatgccctctgtagccagggcccccgcccggtgctcgcccgcggcctcggacgcagctacggcgacgcggcgctcgcggcaggcgggatcgtgctggacatgaccagccgccagccggtcgtcaccctcgaccagcatcgcggcgtcgccgtcgtcgacgcgggtacctcgcttgcccacctcgctgcgagtgtgctcccccacggttggttcctccccgtcacccccggcaccaagcacgtcaccgtcggcggtgcgatcgccgccgacgtccatggcaagaaccatcaccgagacggatcgttcggcggctacgtcgagcgactctggctggccacgccggagggcatcgtcgagctcgcgccacccgatgagcgtttctgggcgaccgtgggcggcatgggactgaccggggtcatcctccgagccgccgttcggctcatcccggtcgagagccgcttcgtcctcgaccgagaagtcgcgacgtcgtccctcgacgagaccatcgaggtcctcgccgacgacagttcggttcgctactccgtcgcatggctggacgcgacggctaccggagctcgcctcggccgcggcctcgtctcgttcgccgaccacgcacccgccgacgcactcccggcctcgctcgctcacgacccactccgactgccgcgcgagcgaacgctgcccgcacctccagatcgcatcccctcagggctgctgtcggtgcccacgattcgggcgttcaacgagctgtggtaccagcgtggacggcgtcggccggagacggccctcgtcgacctgcgctcgtacttctatccgctcgacgccgtgaacggttggaaccgtctctacggcccacgaggtttcgtgcagtaccaagtggtcgtcccgaacgacgccgtatcggtgatcaggcgcatcctcaccgacctcgtcgagcatgggcatccgtcgttcctcagcgtgctgaagcgcttcgggccagcggggaacggttggctctcgttccccaccgcaggctggactctcgcgctcgatctcccggcgcgccggagcgacctcgagaccctcctcgtgcgcctcgacgccctcgtgctcgaggccggaggtcgcgtctacctcgccaaggacggacggcttcgacctgagtccgctcgggcgatgtacaccaggatcgacgacttccaagcgctgcgtgcacgcctcggtgtacgaggcgtcatcagctccgacctcgcccgccgcctgcacctcgactagcctcgtggcgtgctcaacgccaacggtcttccccaacagctcctcgtcgtggggggtgggtccgatctcgcggtcgcgatcatcgagcgcctcgcaaccgacggccccctcgaacgcgtcgcgctcgccggaccgcggccggccacactcgaacgcgctcgcgaccggatccgtgagcacctcgacgaggtcgccacgttccacctggacctcgccgatccacgagcggtaccgagcgacctcgaaccagccctcgagtggctcggcagtgtggatgccgtcctcgtcgcggcaggtgtcctccccgaccaacacgctgccgaggccgaccccgccatcgtcgcgaatgcctttgcggtcaacgccaccggacctgcggtggcactcagcgtgctcgccgatcgcctcgagcgggccggcaccggtcagctgatcgtcctctcgtcggtcgccgccacggtggtgcgccggcgaagctacgtctacgacgcgtcgaaggcggcgctcgatcgctttgccctcgggctcgccgatcgcctcgaaccggcggtcggtgtccacatcgtgcgcccgatgttcgtcacgacccgcatgaccgagggtctcgagcgaccaccgctcgcgctctcgcccgaacaggtcgctcgcgcaaccatcgcagggatccaggctcgccaacgagtgatctgggtgccccgggccgccgcgctcggggtcatggtgctcagcgtcctgccgcgcaccgtcctccgacgtctcccgatctgacaggcaacgtccctcttaccccgcgaccgcggtgcccccgaccagatcgacgccgccaggcgcaggggcgctcggggcgccgccaagccccacgatggcgccggaggacaacaccagttcgagaccggcacctgcgcgcgcagcactcaccacggtggcagagccgacatcggcgctcgcgaggtccgatgcatcgccgaaggcaaagacatcgccgttcgcaagcacgagccagtagccctggccgtcggccgtcggcacgagcgtgaccactggggcagggagcgggtgcgagccgccgaggcctgagtagccggcactgtaggtattgccgtagaagtgggcgtcaccgaagccaaagacgccgccgtcggcggccaccaaccagtagccctggccgtcgggggtggggctgagcccgacgaccggtgcggcgagcgggtgggagccgccgaggccggtgagacccaaggtataggtgttcccgaagaagggtgcgtcaccgaagccaaagacgccaccgtcggcggccaccaaccagtagccctggccatcgggggtggggctgagcccgacgaccggtgcggcgagcgggtgcgagccgccgaggccggtgagacccaaggtataggtgttcccgaagaagggtgcgtcaccgaagccaaagacgccgccgtcggcggccaccaaccagtagccctggccatcgggggtggggctgagcccgacgaccggtgcggcgagcggatgggagccaccgaggccggtgatgccaagggtggcggtgtcaccgagactggtggcaccgtcggcggccaccacggtcccatccgccgtgacgccgcgaagcccgacgttccccgtcggcgacgacgatggtggagcaggcgtcgttggcgaggtcgtcgtcggggtggtcgccgactgcgcgttcgtcgccggggtgccgaccgccgcgatcgcgcccaccgcaccgccagcgggtgcggtggcgccgatgctcacccctccatcgaagccgacgagggcgcccgacgacaggacgatggagtagccctggccaccgggaccgggcacgagtccgatcgcgctcgccgttcccggcgtgagcgatccgtagctcggcgcatcgccgaagccgtagaccgtaccgtcggcggcgagcagccagtagccctggccatcgggggtcgcgagcatggcgacgatcgggctggcgggtgccgccggaagcccgccgaggttcgtggcgtcgccgaaggcgagcacggtgccgttcgcaagggcgagccagtagcccttgccgtcaggggtaggcacaagcgccacgacacgcgctggcagcggatgagcaccgccgaggccggtgaagccgcgcgtgtaggtattgccgtagaaacccgcgtcaccgaagctgaagacgccgccgtcggcggccactaaccagtagccctggccatcgggggtggggctgagcccgacgaccggtgcggcgagcgggtgggagccgccgaggccggtgatgccgagggtataggtgttcccgaagaagggtgcgtcaccgaagccaaagacgccgccgtcggccgccaccaaccagtagccctggccgctcgggtcgcgggtgatcccgaccacgggtgcagccagggggtgggagccgccgaggccggtgatgccgagggtagcggtgtcgccgagactggtggcaccgtcggcggccaccacggttccggctggggtggtctcgagcaccccgttgccgaggctcggcgactcgggcggcgtcgggggcggtgcgggggctgaggcgctcgcgtcgttcgagatcgcgatcggtccgctcgcgacgaaccaggccgaggggagtccgagagcaccagcgaacgttgcgcccgagacggtcaccgacccgttcgtgccgctcacggtgatcgaggtcactcgtccgccgtcgttaccgagcccgttgcgcgcatcgaccgcgagtccggtgggtgtgccgatcgaggggaatgcggcctcgaccgacgcgagcgagacgctctgcgtccaggggttccaggggttacagatgttgccgtagcagcccgcatcgtagggatcgggaacggcgggaaacgtaccgggtgccgtgtaaccgccatcggaggccgagtactgcgtgaacgcaggcgctccggaggcggtcacgagcacctcgtgcgccgtgtccgccaccgcctgctcgaccagcggccgatacggcgcgctcaacccgttgttcacaccgccgtagacctggcacgccgaggtgtcgcagatggtcgcgaacccgtagccgttgccgaccgcgagcgcataggttcgggcctcgacggcctgagcctcgagcgcctggaaaccccatggttccccttgcggaccggaagcgccgaggaggccccatgaggccggcatctcgttcgccaccacaccgagcacgtaggactcgagcccgagctcattgacgagcaccatctggcccgagccatcctggagcacctcgagttggccgcgatagctccgctcgctgccgccgggcccacaccacacgagtgccgacgaggccggctcgtcgacctgctgaccgaccggcggcagcgacggcggcgacacccacagcgaaccaggtgcgctcgtgaggttactccaccctcctggggagccgcagcccgtggcggcttgccccaccgccgcaaccatggtgccaccctgatccgtgagctccaccgggacgttcgcaccgacgctgacgccaccgacgctcaaaccggatggatcgaagacgacaacggggcccccgttggcctcggtgatccagacgcgcactgcctggtcggcagccgtcgtgagcgtggtcccaccgtagaagtgcgcgaggatggcctgataggagtcctggcccacactggcgtagccgatctcgccgaactgcgaagcgccggagcctccaccgacaccgaacccggtgaaggtgagctcgccgctggtcgacgttggcgtcatcgccggtgcatgcgccggcgccgcgacaagggctccgagcgcgatcgctgcgcccgcgagcggaatacggcgccctccgacgcgcacgctggtcctcggcaacctctgccccctcctgcgtgagccctccttggccgagccgagcgcgccttctcgacgctcggcccacactacaccatcggcacgcgccggagcggtcttgacggacgtagactccaaggcgccatggcctctcgcgacctcaccgccaaggacctcactgcaagggaactgcgcacccatctcgacgagacccgagcagcacttcgggctcgccttgcgccgtcgctggagcggacgttgcgtgaagcgctggtcgatctcgagccgctcctcgggccccgcgcgcttgccgaacggttgcggcgactcgcggcggcgtcctatgtcgaggccgacgtaccgacccaatcgcgaatcccggggctcgccgtcgtcaagcgcggcgtgcacgctctcgtggcgtggtacgtccgtgcgatcgtgcagcaggtcaacacctttgccttcgagacggccggtgtcctcgaagcggtcagcatcaagctcgacgagttcgagcggcgcctcggtgccgtcgaggctccgagcgtcgcaccggccacggccatcacagtgccgtggcctcccggcgcgaacgctgcgatcgtggcggcgctgaccgaactcgagccgggggctcgcgtgctcgtctcggacgcgacgaacgacgacctcgcgaccgccctggccgccgcaggcctcgacgtcctcggcacctcgctcgatcaggaggcggccgatgcactcgccgccgacggtatcgacgtgcgcatcctcacgatgaacgaactgctcgacgcaacggcgcccggatccatcgatgcggtcgtgctccgaggcaccgaggtcgagttcagcgacgtcaccgccaagcgtcgcctcatcgcatcggcccggcgcgccgccaagggtcccgtcgtcctcgtctggaacgagcccgagcgcctcgccgccgaaccgagccttgcgggcgtgctcgcgctgcaccctgggccgttgcccaaggcggcgtgggaactcctcctcgcagagcgcggcgagcggcccgtcctcgcgccggtcgccgacgggctcaccatggcggtgctccccggctgatgagggttctccacctcgtcccgtcgctcgcgccccacgacgccatcggcacgcacactcggctcctgcacgaagcgctgctcgctgccggcatcgactctgagatcgtcgcagacgaggcactcgacggcgcccaggccacgccgttcgccgcgcttcgtcgacggcggctcgatgccgccaccgtggtgtggtaccaggcatccacgacctcgccgatggccgcatgggttaggactcaggtccgtgcacggcgcctcctgacctaccacaacgtcaccccgtggcagtaccaggagcagaccaacgtcgaggttgcccgtgccctctggagggcacggggcgaactcacgcacctcgcgccagccgtccaccttgcgagcaccgtctcgcgcttcaatgcccgcgatctgaggcgactcggggtcgacgaggtgcggatcctgcccccactcatcgagctcggtgagcccgcagagcctgcgccggcccggccatctggctcgcgatggatcttcgtcggtcgactcgtaccgcacaagcgccaggatcgcctcatcgcagcgctcgcgatctaccgtcgcacgatcgacccctcggcgacgctcgcgctcgtgggcaaggcgaccgaaccgagctggcgcgcgcgactcgtcgacctcgccgcggcgatcggcgtcgaggcggccgtcgagttcatcggcgacgtcgacgagtcggggctgcgtgccgagtggcgcgaggcgtccgtgtacgtctcggcctccgatcacgagggttttggcttccccctcatcgaggcgatgagcgctggcgtgccggtggttgcgctcgcgcgtggcgcggtcgctgagaccatcggacgagcgggcctcctcgtcaccgacgaggcgccccgagcgctcgccgaggcggtcgccctcgtcgagcacgacaccgaggtgcgttcggcgctcagcgccgaggctgctcgacgacgcgctgcactcgatcccgcgcgggtcggccccctgtatcgagcgctggcctgggaggcggccgggtgagggtgctccagttcgtgcctgccctcctcccgcacgacgccgtcggcaacatcgtgcgcggtctcgacgagcgactccgcggcatcggcgtctcgaccggcatcgtggtggcgggcgaccgaccgcctccgggcgcaaccagcgttcgccacacccagctccggcctgacgacatcgtgctctaccaccttgcgagccgctcgcccgagggtgcgcgtctggtcgctcgccacccgaacgtggtcgtgcactaccacaacatcacccctccggagctactgctgccgtggctcccgacggacgcactcgagctccagctggccaggcgtgaggccgcgcgcatcctgcgagctgctcggctcaccatggcggtgagcgcctacaacgcagacgacgcccgttccctgggggcacgtgacgtcgccgtcaccggcaccctgtcgcgccacgatcagctcgtcgcagcaccatcaaccgaggtcctcggatggctgcgcgcagaccgcgatcgccgagggtccccgcacgactggctgttcgtcggacgcctcacaccgcacaagcgcgccgaggatctcgtcgccgcgctgttcgcctaccgacacgccaccggcaccgacgctgcgctcaccatcgtgggacggccggcctcgcgacgctaccttgcccatctccgtcggcgcgtcagcgtgctcggactcaccgcccgcgtccgcatcctgacccatcccctcgcaccacgcgccctggcggatcactttcgagcggcgagcgtctacgtcacggcctcgcgccacgaggggttcgggctgccactcctcgaggcgatgtccttcgggctgcccatcgctggcctcgcggctgcagcggtcaccgagacggtccagacggcgggagtgctcgtcgaccgcgccgacccagtggagctcgccgccgcggccgcgacggccgccgagctcgggccacgtcttcgtcccgccatggacgaacggctccgcgcgtatgacagcgacgccgccttcgcccgcatcgtcgagggactccggagcgtcggcctcgaggtccgagcgtgagggtcctgttcgtcacgcctcgttggggtcccgacatcgcgggcggtgccgaacgagccgcgcgcgcctggggggtggccctcgcccggcgcggccacacggtccgggcgctcacgaccacggcgaccacgctcgactggtccccggtcctcgatgccggtgagaccaccgacgatggcgtcatcgtcgagcggcaccacgcgaccgctcgcgacggcgacatcgatcgcgcgcttcgagccgtcggaccgctcgccgcccacctcgagcgcaccgctgcgcgccgactcatcgagcgtcaagggcccgtcatcgacgggatcgaggatgcagcgcaaaacgccgacgtcgtcatcgcctatccgtacctctactggaccagcctccgcgcgaccgaggtcgccggtcgccggacggtggtccacccggctgcgcacccggagccgctcgtcgcgctcagcgcactcgaacccgtcttcaccgcgcccggcgggctcgtctaccagacggcgagcgagcgccgcacggtggaagcccactggccaacggcgcaggtgcgctcgctcgaactcgcacctccgctggtcgcgtccgcgcgcgagcgcgtgccgtgggacgcacgaacgatcgtgctcgcggtcggacgcttcgagcacgacaagggttccgaggccctcatcgcactcgccgaggcacttcccgacccgttgcgagtcgtcgtggccgggcccgttgtcgaaccgccgcgacgaccgagcccgctccagaccctcggcgttgtcagcgacacgagactcggccagctccgcgccgaggccatcgccacggtgatcctctcacgctacgagtcctactccctcgctgcggcggagtcactcgccgccggggtcccgatcgtcgtcaacggctcgaacgacgtgctcgtcgagctcgctaccacctccggtgccgggatcgtcgccgcggacggcatcgacgtggccgcagcgatcgtagccctcgcgaccgatcgcgagctggcgtcgcgcctcgagacagccgcactcgcctgggcacagcaacgcccgggtgccgacgaggccgtcgaacgctacgaggccttcctcaccgaggtcgctgcgcacgcgcctactcggcgaagaagctgacctcggtcgccacgaggccgcccacaccgaggtgttggtcgacgatcttcagggcggtatcccattggcgccgctcgaggagctcgccgctacgcgcctcgacgacgctgagcgagagctggtagatgccgggagcgagcgggacgtcggcgacctgaaccaagaacttgcccgcgccgtggacgacgaagggatcgagtcccatctcgcgcgtgtgtgcggtgagcacgggggcgccctgaggactcaccaccgcgagctcgaggtgcaccggggtcggacgcccgtcgcgctcctcaagggcgaaacggagctcgagcgggctacgcgcctcgagcgtcaccggctggtccacgacaacaccgttcgcccggaggtcctcgaccacgacgtggcggggcgcctcgtcgagctctgcgacgaccggtgcctgggttccgagcccggagcctgccaactggagctgcgtcagcagcgagatcgcctcctgtgtcggtccaccgcccaccaggcggccgtggtcgagcacgaacgccgagtcacacaccgcgcgaacgagctcgggcgagtgcgacacgaagatgatcgtgcgaccctcggcctggaactcgcggatcttcgcgatgcacttggcctggaaacgggcgtcgccgaccgcgagcacctcgtcgacgaggagcacgtcgggatccatgttcacggccaccgcgaagcccagcctcgcgtacatgcccgaggagtagaacttcacctggttctcgatgaaggggccgagctcggagaactcgatgatgtcatcgatgcgctgatcgacctcacgccgcgacatgccgaacaaggtcgcgttcaggtagatgttgtcgcgccccgacaggtcggggtggaagccggctccgacctcgagcatggccgcgacacgtcctcgcacggcgacctcgccgcgactgggcgtcaggatgccggcgatgcacttgagcagtgtcgacttcccggatccgttgtggccgagcagtcccaacgtgtgaccctgctcgacgtcgaaggtgatgtcgtcgagggcggcgaacgactcgtgaggcacacggccccagtggacgaatcgctccttgagcgacgtgtacttctcctggtagagacggaagaccttggtgaccccgcgtacctcgaccgcggtctgacccaccgctagagctcctccgcgaagttgccttcgagtcgtccgaacgcccacagggcaaccacgaagagcacgacaccagcgacgaggacgccgagcacgccccagaagtaccacatcgggcccgccgtcggcaagatctggacgacggtgtgcgacgcgaccgagtagggatccgtcttggcgtagaacgtcctctggaacgcgagcacgaccggcgtcaccggattgaggagatacacccagaccgggatgtgatggtctgcgaacttgttcgcgacgagttcgaacgcgtacacgacgggggttgcccagaaccaggcctggagcaggatctccatcagatggcgcacgtcacgcaggtagaccgtgatcccagagacgaggatgccaaggccggaagcgaacacgagcagcgcaacgagcccgatgagcgccacccacaggtagctgaccgacggcacgacttggaatacgacgaggaacaccgcgagcaccacggcctggaacacgaagaagaccgacgcggagccgaccgaggccaaggccaggatctcgcgaggaaacgcgaccttcttgacgagtcccgcgttgtccacgactgcgccggtcgcgcccatgatcccggtctggaagaggttccagcagaggagcccggtggcgaggaagatcgcgaacaacgggatgccagaacccagcaccttctggaagacgatgtagtagatcaagatgaacatcgccgggttcaccagcgaccacaagaacccgaggaaggagtccttgtacttgacgcggatctccttgacgatgagtccgcgcagcagatcgcggtagcgccagatgttcgcgagccgctccgtcaccgacacgcgcggccgcaccagccgtatggcgagcgcgcggttcgggtcgtagcgcttcgtgtcgccaggctgggacgctgggagatgggtgtccacccgcgccctcacgcctcggtcgacgaagcgctgcgctgtccgtaggacttcgtgcgaatcacttgatcgatgaagccatactcgagcgcctcgtcggcggtgaaccagcgatcgcgctcggaatcggcctggatccgctcgaggggttggccggtgtggaacgcaatgcgctcggcgagctggcgcttgaggtacgtgatctgctcggcctggatcgcgatatcggccgcctgtccctgcatctgtgcgagcggctggtgcatgaggatgcgcgcgtgcggcaaggcgtagcgcttgccatgcgtgccggcacacaggaggaactgggccatcgaagccgccatgccgatggcgatggtcgagacatcgcagctgacatattgcatggtgtcgtagaccgcgagcccgtcgtagatcgagccacccggcgagttgatgatgaacgagatatcgcgttcgggatcctcagcagcgagcagcagcagctgcgcgcagatctggttcgccgaggcctgggacacctcggtcccgaggaagacgatccgctcacggaggaggcgctgaaagacgtcgccaccagcttcgataccagcggcgtcggcaagatctcggacagaaccctcgacaagggcaggtagggccatgcccgctaggctagcgtgcgttccccgacgggaggctgacggggtcgcgactcgacgtcgaacgcgggcgtggcgaaattggcagccgcgcgaggtttaggtcctcgtgtcgtaagacgtgggagttcgagtctccccgcccgcaccggtcatcggcggccggcgcacagccgatcttcagcgtcaccggtcgcgatcagcgaaagctctcgcccagtcggcgaagccgacgagcgcccgccttcgatgcgacagcgcgtccttccactcaccgagttcggcaaacgttcggccgtcgccaccgagcgggatgaagatggggtcgtacccgaatccctgctcgccacggggctcgagtgcgatggccccctcgacgacaccctcgaagcatcgcggcgggtcctcgtcgaccacggcgcacaccaccgccacgaagcgggcacggcgactacgcgtcgatccgagctcctggagcacacgcgcgatacgctccgcatccgtcggcccatagcgagcggagtagatgcctggggcaccgtcgaggccgtccacgacgagtcccgagtcctccccgatcacgatcggcgctcgcccgcgtcccgcctcggccttgatgatcgcgttctcctcgaaggtcgacccggtctcggcgacctcaccgacgtcgatccccacgacctcgaagtcggtgaggatgcgtcgcgcttccgccaacttgtgcgaattcgaggtgacgagcccgaccctcacgcgagctggggtcctcgctcgaggagctcgccgatgccgcgctccgccagcttgaggagctcgacgagggtcgccttcgcaaagggcgccccctccgctgcaccttggacctcgacgtagcgaccgccgtcggtcatcaccacgttcatgtcgacgtcggcgcgcgagtcctcgtcgtagtcgagatcgaggagcggctccccgtcgacgacgccgacggacacggccgcaagacgaccggtgagcgcagctggctgcacgagaccgccctcggcgaggcgctcgagcgcgcgctcgagcgccaagaagcccccggtgatcgcggccgtcctcgtgcctccgtcggcctggaggacgtcgcagtcgacgacgagctgatgctccccgaggcgctcgaggtcgaccacgctgcgcaacgctcggccgatgagccgctggatctccacggtgcgcccctgctggcgcccgcgcacggcctcacgggccgtccgtgtcggcgtcgaccccggtaggagcgcatactcggcactcacccatccccggccctgcccccgaagccaggccggcacgcgctcctcgagcgagacggtacagagcaccgcggtacgacccatacgcatgaggaccgatccaggcgccatctcggtgaagtcaggtgtgatcgccaccggccgcagctcggctgccccgcgccccactggccgtcgttccacgtcgcctcctcgctgcgtccggcgacccacgctaggcgctacgcgtgcgccggcactccagcgcctcgacgggcacctgctcgatcgcgccgagctccccagggaacaggcgaccgccgatctcgcgaaagacgacagggtccccgctgcaggcgacgcgcaaagagccgacggctcccgagcgtgccagtccatccgcaccgagtcgctgtgcgacctcgaacgccgcctcctctgccggcgacacgagcgtcacctgctcgccgaccaccgcttgaatctcgcgtgcaagatagggatagtgcgtgcaccccagcagcaacacctcgacccccgcgtcgacgacgggcgccagacgatccgcgatgaccgctcgtacggccggaccggtcgtctggcctgcctccacgaactcgacgagtccaggacaggcgacggcgacgcccgcatcgtcggcgagcgcccgctggtaggcgcccgaggcgatcgtgcgctccgtcccgatcacgccgacacgaccggacccgacgcaccggcgcgccgcgcgcgcccccgccccgaccacgccgatcaccggaaccgcaagctcggcccgaagcgcatcgagtgccacggcggacgcggtattgcaacccacgacgacgagtttcgaaccggcctcgtccacgagccagcgaccgatctcgagcgagaaccggaccacctcgtcggcaggccgcgatccgtacggcgaacgagccgagtcgccgaagtagacgagatcctcactcggcaatagatcgcgcagcgccgcgaggatgttgagcccgccaaaaccagagtcgaagacaccgatggggccgtgcgcgcgctcagccgccaccgctcgacgctccctggaccacctgttcttctcgaacgagcccgcggctgatgcgataggcgcggatgtcgactcgaggacgcgcaagcgacgcgatcacgtagacccaccgatcgtcgaccgcttggcgtacgtccgtcggcgacgggaacgcctcggagtgggtgtgcgagtggaacaccccaacgatctcgagcccggcacgctcggctcgctgctccgcgcgcagcacatcctccggggccatggtgaacacccgtgccgagtgcgcctcgttgcgtccggggaacgcctcgacgatggcacggtcgtcgccgagcagcaggccacacgcctcgagcggataggtacgaaggcagtgcgcagcgatcgcatcgagcaccccatcagccacgcggaccacgacaccacgctaccgcgcaggcaccggccccccgggcaccaggagccggagctatgctgagcagcgctcggcatcggcgaacgaggaggcagacgcacgtggcacggcaaggcgcgcgtcctgcgaaggcgcagcagctcggcggcgtccgcgtgctcgcccagaatcgtcgcgcgcgtcacgactacgacgtcctcgagaccttcgaggccggcatcgtgctggtgggcagcgaagtcaaggccgtgcgcgagggtcacgtccagctccgcgacgcctacgcccgcatccgagatggcgagctcttcttgttccaggcagtgatcagcccctatcgacacgccaccggctttgggactcacgtcaccgaccgccctcgcaagctgctcctccaccgcgacgaaatcgatcgactccgcggccgcttggagcaggagcgtctcacactcatcccactctcgctctacctgcgcgacgggttggtcaaggtcgagctggcgctcgcgaagggccgcacgctctacgacaagcgccacgtcctcgccacccgcgacgcccagcgcgaggtcgagcggctgcgctcacgctatcgacccaatcgcagcgcacgctagactgatcacgccacagcgagtcatgagggggctgcgcatcgcagctatcggtcgcgttgttggcatcgacaagggggtgtaccggattcgactctggtcgacgagatggtggaagcgagccgtgctcaccggatgcacgtcaaacagccggtgcaacaataaacgccgagcctgagctcgcactcgccgcgtaacaccggcgacggcggacggcttgcccgtgcccgcgggctgatcccgtcgtcatcacagggcacttaccgtttcgcagctgttggcgctgcctagcgggacacctcgccaacacaacctcaggggacgtgccaggtcgtccccgaggatctcaacctggctgcgctcggagaagcaccatcaaggagccagaggacgcgggttcgactcccgccacctccactgatgttacgaaaggccaaccggtgtccccccaggaggaggacaccggttgcgcgttcgggccccgttcgcccctcgtcggtacgcgatcgcggctcgcgggcctcaggcggagggaaaggcgccggtcgggagtgattgccacccggtcgatcaggtcgcgcaggagctgctcgacggtgtcagggttggcgacctcgacgatccaggagatctgggcgaagagggcctcgagccgcttgcggtctgggaaccgaggagccgctccgctcagctggctgggcaaccgttctcggtggacgatcagttcatcacgctgttcgatcagctcggtgacccggggcaagcagaccgccgccggcatgtcgccggtctcgaaggctcgcaggtcgtggtggctggccccctgcaacgaggccgcggccgcgagttcggcgagcaccgcgcggcgaagcagatcctcgggaggctggtcgagggggacagatgctgaacaagggtgccaccgtcgccgaggtcgcccgcaccttcgcacatcgccgagaccacctggtaccgctggaaacagacctacggcggcatgcagggcgcggacctgaagaggtcgaaggagctctgcgccgaaggccggcgcctgagacgctggtcattgatctcgccctcgcgaacgacaggctctgacgagctggccgaggggatcgtctgaccccggaccgcaggcgaggcgccgtgcgccggctccaccagcggctctcaggcgtccgagccaggggcgtgccgagtgacggtccagccacgagccacccggcgccgaaggtcgacgaggcgctccagcggcctcgacgaggccatcggcgagatcctgcctgccttcgcgctgccgacgaacgcaagggacaccccctcaccgagcgcacgatcggtcacgcagatgccagatctgcctccacgacgctgcacgtcggcgcaccacgcctgctgccggacatggtggcaccatcggctccgtcgggaacgtcaacgacgacgcactcgccgagaccgcgagcggcctcgcggcgaccgaatgggtgggcccgggctcacccgccacgtgtggccctctggccggcctcacgaaccttgaggaggtgacctcggcctggatgcgccgctccgccacgacgaggtctatgcaccggctggggcaccgtccgccggtcggggtcgagtatgagtacgatgatcgccgagcgcgagaccgttcacacgtcacggcgtgtgcacggaacctgggggcttcaccgtgcatcgcgtgggccctgtgccgatcccgcgctgtgcgtgagtccccgacgatgctgcgacaccaaggaggaagcgtgcgtccgaacgccgtcatcatcggccttggccagctcggccgttcccttgccgaaggactggtcctcgcaggctggaccgtgacgggggtccggcgcgatcagacggcgagcgagcttgctcggcccgacctcgtggtcgtcgccaccggtgaggacgatctcggcccagcgctcgagacactgccgcccgactggcgctcgcaccgggtcgtcctcctccagaacgaactcctccccgaccagtggcgtcgccatggcatcatcgatcccacgatcctcgtcgtgtggttctcccgcaagcccggcgagctggtacgggagctgcggccctcggtcgtcgcggggccgcacgccagcgcgatccgcagcgcgctcagcgccctcgatctccacgccgtcgaggtcaccccatccgaggtgatcagtgccctcgtcgagaagaacgtctacatctggtcgatgaacctcgcggcactcctcgtccccgacccgaccacgagccgcgtgctcggcgagtttcgagacgtctacgacgcgctctgtcgagagacggttcacatccacgaggccgcccttggtcatccgatcggcgacgtcgcggcgctgtgcgacggcgtggccgccatcctcgccaacgagggagagcggcgcctcggaggccgcagcgcgaagcgccgagcggagcggctcgccgcgctcgctcgtacactcggcgtcgacgcccccaccgtggctcgcgctgccgagagcgcctgagtcacgcgacagcttcggacccgtcagggcgacccaggctcggcgaggaagaccgcgacgaagtcgcgccagaacggcaccagatagtgcgtcggcgcctgcgccatggacggcaacaggttcgtcgccacgagtccgttcggcccctcggcgaaggtcgcaaagctcacccagtaggggttgatgtcgagctgcatcccacgaacggcaccagcccacaccagcatcgagcccagcgtcgctggcgacagtcctgggccaccgacccacacgagattgccgtgcgaggtgatgccgaggccgctccgccaggtcgcgagcagattgccgagcgagtagccccacgtcacgaggggattctccgacgccgtcgggagcactgctccgtgatcgaccagcaaggtcaagttctggcgaaccgcgctcacggccggactcggaccgacctcggagccccacgcaccaatctcgactcgcccgttcgtcagctcgacgagtgacgcggcaccctcgacgagcggggctcccacgacgccatcctgctcgaagccaccgttcgaaaccgcgaactggaagccgccctcgaacgccgcgacgagattggtgaccaacgaggggggcaccatgccctggtaccgaaagctcccaccgggttgggtcgtgcccgcgaagagctgcacgacagcgtgtgcctgatcgatccaggccaccccgaccggagcggcccccggcgacggcgccacctccgaggtgaataccaccgcgccgcccgagccgaccgcccccgctggcgtccacgtcaccggcgcacccgtcgggccgacctcgatccggggcatcggccacagttgctcgggggcgccgccccccgcgatgggcccggggtgtgcaaggcgggtcacgccgctcgccgcgtcggaggccgccgggaccgggggcggcacgcgcgctggcgacgagcccttagcacgtgcgctccgtgcgctagtgccacaggcagcgagcaccccgcacgcaacgaccaggcaagcgccgccgtagcgccgacgtcgcgccatggcctcagccgtccgtcgccatcgggcgagtgcgaggtcaggcgttcatgaatcggcgcacagcgatggccgatcccgccgtaccgaccacgatccccaccacgaggacgatgccgagcgtcccgatcacgtcgccagtggtgaggacgaagccggacaggaggtggatctggaagtggctcacggcaaagctgatcaggtcacggagtccgaccacgaccccacccgcgatggcagcgcccaggaggccctggacgagcccttcgagcatgaacgggatctggatgaacgagttcgtcgcgccgacgagccgcatgacggcgacctctcggcgccgagagaagatcgcgacccggatgacgttcaaaatgagcaccgcggccgacacgaggagcacgacggcgatcacgaggatcaccgactgagcaatcgtcgagatctcgaggatcgtgtggatcgccgagaagttgtcgttcaccgcgtagaccccgggctcaccacgcacgaccgcggcgatcgccggtgcctctgccgggttgaccagcgagacacgatagaacgtcgggacctgcgattcaggcaccgcgttcacgagatcgggctggttggcgaggaggcgacggaagtcttggtaggcctgagcccgtggcacgtaggagtacgagcgcaccgtcggcagctgatggagctccgcctcgagcgcacggaactccgatcgcgtcgcgttcggctgcatgaagacgaggagctgcacgttgccctgccactcgctggtcgcggtctggacaccctgcttgatgaggagcgcggcccctaccagcgacagcgacaccgtcaccgtcaagatggccgccagtgacatcaagcgattacgccacaggttggtcgcggtctcgcgaaggaagtagcgcagtgcggtcatcgaccctccactccgatgccgtagacgcctcgaacctgatcccgctggacggtgccggtaccgatctcgatcacgcggcgccgcatggcgtcgacgatgctcgagtcgtgggtcgccatcacgaccgccgtcccggtgcggttgatccgctccagcaagttcatcactccccagctcgtctccgggtcgaggttgccggtcggctcgtccgcgagcaggatcagtgggcggttcacgaacgcccgagcgatcgcgactcgctgctgctcgccaccggagatctgcccggggagtcgatccgccttgtcctcgaggccgacgagccgaagaacctggggcacctgctggttgatcacggaacgcggcttgccgatcacctcgagggcgaacgccacgttctggaagaccgtcttgttcggcaggagtcggaagtcctggaagacgaccccgatgttgcgccggaagtaggggaccctccagttcggcatggtcacgaggttcttgccagccatccagatcgtgcccgagtcggggcgctcctcacgcgtcatgagcttgatcagcgtcgtcttgcccgatcccgacgacccgatgaggaagacgaactctccacggccgatctcgaagctgacgtcacgaatcgcagacgacgatcccgcgtactgcttcgtgacatgctcgaagcgaatcatgcagctccttcccccgggcgcctgcccggtgaggtcacgcagccgctcatcctaccattcgagatcacccatcagggtgcttctcgcgcctccaggcgaggaacgcctcgatgaaggggtcgaggcgcccatcgaggactgcttgaacattgcgatcttcgtacccggaacgatggtccttgaccaactggtagggcgcgaggacataggagcgcacctgattcgcccaaccgacgtccacccgcggcccgctcaaggcatcgagctgtgctcgctgctcttcgcgccgtcgctgctccagcttcgacaccaggatctgcatcgccttcgccctattctgcaactgcgaacgctcgttctggcacgacaccacgattccggtcggtaggtgggtgatgcgtaccgccgagtcggtgacgttgacgtgctgcccgcccgctccggacgaccgatacgtgtcgatccgcagatccttctcgtcgatgacgacctcgccagcgtcctcggcgagtggggtcacgtccagtgacgcaaagctcgtctgacgccggtgctgggcgtcgaacggcgagatgcgcaccaaccggtgcaccccacgctccgcgacgagcaagccataggcgtagcgtccgcgcacgatcgccgtcgccgacaagatcccggcctcttgtccctcggtgacctcgtccacctcgaactcgaacccgcgaccttgggcccaacgctcgtacatgcgcagcatcatctgggcccaatcctgggcatcggtgccaccggcacccgagtggatctcgagcacggcatcgctctcgtcgaactccccggcgaggagcgagcgaatctcgatcgcatcgaggtgcgcagccagcgacgtgaggacgtcctcggcctcggcggcgagatctgggtcgtcgtcggccatctcgatggcgacgttgctgtcggcgagcatggcgtcgagtcgggcgatgagctcgacgtcgtccttgagcgtgccgtagcggcgcgagagctcgcgacccttcgcggggtccgaccagaccccaggatcggcgagtgcggcctcgagctcggcaagctctgttcggcgatcgtcgatgtgcaagaacgctcgggcccgctcgagacgctcggccagtgcccgagctcgctcggcgagttccgctctcgtcacgccgaaccgccctcggactcaggaccctcggtgacgtcgcgagcctcgcggatgaggtccaagatgctcatcgcctgcggatcggtggcgccgaagtagcgcgcgcccgacaggtcgagcttcggcacgttctgcgaggattcggttcggaacaggtaccgcacgaagtcgtcctcgatgcggcgcattagctcctggaacatctcgaagccctcttgctgccacgcgacgagcgggtcctgctgacccatggcacgcaagttgatgccctcgcgcagatagtccatgtcgatgagatggtcgcgccagtgctgatcgatgacgcccaagagcacgtcgcgctcgagcgctcggagcctgggggtgccatcggcatcggcaccgagcgcgcgttcgcgctcgtcgtagagctccaaggcctcgacgaccagcgagctcacaagttgatcgcggctctgcgcgtcggcgagctcctcggcggtgaaggcgctcccccaggttcgccgcgcctcgtcgaccaggcccgcaaggtcccagtcctcgccgtaggccccaggagcgtagacgtccgcgacacgccgaaccgtgcgctcgatgctctggcgagcgaactccgacagatcctccccttcgaggatctctcggcgcctggcgtagatgaccttgcgctgctcgtcgagcacctggtcgtacttgagcacgtccttgcggatgtcggcgttgcgcgcttcgaccgtcgcctgggcacgctcgatcgctcgcgacacggccttggcctcgatcggttgatcctccgggaacgcacgattcatcacccacgacacgacgctgccacccgcaaagatacgcatgagttcgtcctcgagcgagaggaagaaccgcgtctcgccggggtcaccttggcgacccgatcgacctcgcagctggttgtcgatccgacgagactcatggcgctccgagccgatgacgtagagacctccgagcgagcgcacctgctcaccttcgtcggcgcacacctgttggaacttgccgagagcttcctcgtaggcagcacgtccctcatcggtcgtggggtcgagtccggcttcgcgcaccgcgatcgccgcgagcccctcggggttgccgccgagcaagatgtcgacaccgcgcccagccatgttcgtggcgacggtgacggcgccgaggcgtccggcctgggcgatgatctccgcctcggcagcgtggtacttcgcgttcagcaccgcatgcgagatcccgcgttctgcgagcagactcgagagcaactcggacttggcaaccgagaccgtgccgacgagcaccggctggcccttcgccgatcgctcggcgatctcctcgacaacggcgccgaacttcccgagctccgacttgaacacgaggtctgcgcgatcgacacgttgcacgggtcgattcgtcgggatcggcacgacctggaggccgtacgtcgaggcgaactccgcggcttccgtctgggccgtaccggtcatccccgcaagcttgtcgtagaggcggaagtagttctggagggtcacggtggcccaggtgtggttctcctcctggatccgcacccgctccttggcctccacggcctggtgcaacccgtccgaccaacgccggccctccaggatgcgccccgtgaactcgtcgacgatcttgacctcgccccggtcgacgatgtagtcgcgatcgcgcaggtacaggtgctttgcccgcagcgcctgggtgagctggtgcaagtagcccatgtgcgcgatgtcgtagaggttctcgaccccgagcgcgcgctccacccgttcgatgccggcctccgtcgggaggacgaccttcttctcctcgtcgatctcatagtcgacgtccggacggagggtgcgcacgatcgaggcgaagcggtagtagagatcggggctcatctccgacggccccgagatgatgagcggcgtgcgtgcctcgtcgatcaagatggagtcgacctcgtcgacgatggcgtagtggtgcggacgctgcaccacctcctccaacgacgtcgccatgttgtcgcgcaggtagtcgaacccgaactcggtgttggtgccgtaggtgatgtcggcgaggtacgccgcgcgcttggcggcgggatcgctctcgtcggccccgacccgaccgaccgtcatcccgagggcggcgtagatgcgtcccatccaggcggcgtcgcgtgcggccaggtagtcgttgaccgtcacgatgtgcacgcccttgccctcgagcgcgttcaggtaggccgggagggtcgacaccaaggtcttgccttctccggtctgcatctcggcgatccacccgaagtggagcgccatcccgccgagcagctgcacgtcgtagtgccgctgaccgatcgctcgccgagcggcctcgcgcaccaccgcgaaggcctcgaccaacaggtcctcgagagtctcgccctcctcgagccgctgacggaactcggcggtcttcgcacgcagtgccgcgtcgtcgagttgggcgatctcgggttctagctggttgatgagcgggacgactgcctgcagacgcttgaggcgcttgccctcgcccgctcgtaggatgcgatcgaagatccccatgggctcgctcgcggacgacgctcagtcggcgacgcccgcaccctcctcctcggcttgatcgatgagcccgacggtgccatcctcccgccgatacacgacagcgggccgcccggtctcctcattgatgaacaggtagaaactatggtcgagcaggtccattcggaacgcggccgactgcgggtcgagcggctggagcgcgaaacgcttgcgccgcctgatgtcgagtcgagcctcgggtgcttcggcgccaccgcggtgatggggatggctgcgggccaccagtcgacccttcagacgctcgaggcgccgcttgagccgctcctcggcacggtcgaaggactcgagctccgtctcgcccacaccgcgtgcgcgcacgaccgccttcgagaccacgtaggtcacctcggtcacgacgcggtccggattggctgggttgccggctcgctcgacatgcacctcgacccgctcaggggcaccgaggtacttctcgagtcgcgcgatacggtcctcgacgtgcgcgcgctgctgctcggtcagcgtgcagcctcgacaccgaaggtcaactgccatgggccacctcctatcgggtaccgacggtccatgaggccaagtatgcctcttgctcaggagtgagcacgtcgatccggatccccatcgctgcaagcttgagggcggcaacctcggcgtcgatcgactcgggcacgccgagcaccgacggctcgaggcgctgcccctcgcgcacgagccactccacgctcaacgcctggttcgcaaagctcatgtccatcacgctggccgggtgaccctctgcggccgagagattgacgagacggccctcggcgaccaccatgacgcgagccgtggtgcccgactcgctgtcgaccaggtactcctccaccatgggtcgcacgggtcggcgacgctcccctggggccaaccgcgccaatccctccaggtcgatctcgacatcgaagtgcccagcgttggccaacaaggcaccgtccttcatacgccgaacgtgctccggccggatcacgtcacggttcccggtgacggtgatgaagatgtcgccctcggccgcagcctcctccatgggctcgacacggaacccatccatcaccgcctcgagggcggccaccggatcgatctcggtcacgacgacctgcgcgcccatcccgcgagcgcgtgaggcgacacccttgccacagaaaccgtaacccgccaccaccaccgtggtccccgcgagcagcacgttggtcgcccgaatgatgccatcgagcgccgattgacccgtaccgtagcggttgtcgaacatgtgcttggtcttggcgtcgttcaccgcaacgacgggatagccaaggctgcccgaggcctccatggcccgaagtctgatgacgccggtcgtggtctcctcggtgcctccgaggatgcgcttcacctggtcgggacgctccgcgtgcagtcgggagacgaggtcacacccgtcgtccatcgtgatggtcgggtccgtgtcgaggacctggtcgatgtggcgatagtaggtctcggtgtcctcggcccgaaccgcgaacaccgggatgccttcgtgcttgaccagcgacgccgcgacgtcgtcttgggtcgagagcggattggacgcgcacgccacgacctcggcgccgccagccttcaacgtacggaggaggttcgccgtctccgtcgtgatgtgcaggcacgccgcgatgcgcacgcccgcgagcggtcgctccgcctggaagcgctcccggatgccacggagcaccggcatggttcgatccgcccacgcgatgcgctggcggccctcgtcagcaagcccgaggtcacgtacgtcgtagtccacgttgatcctttcgaagaggtctgatcgggtcggccgcggactaggccgcagggccgctgaggtactgcttgagtgcgttcagcatcggaatgggtccaggatccgttccgagtgcctcggcgaggcggagcgacatgacgtcgccgacgaaggcgaggtcgaagaacgtcgcgagttcgcccaccccctggccgtggaccgagaccgctcgatgcactcggggtgcgatctcgcgctccatgaaggcgacccgccgtgagatctgcgggtgctctccatcgtggcgcaagaacaccagcgacacggtggacgcgagcagctcggggtaggcctcgaaagcggtcagctcgttgtggcccgcctcgggcaacaccgacgcaaccgcgagtgccttggcgttctcgttgatctggttcttccatcgcagcgccgccacctgaccgacggcacccgatccgagcacgatcgggatcgtaccgacgagcgccgaagcgagatcggaggcgagcgtccccttctcgagttcgtcgcgtcgctggcgaagacgctcgatggcatggccgatccaggccgaggcaccggggaagaagccgacccgctccaacacgccgagcagcgacaccgtgagcgcaccgagcgccgctcgcggctgcgggatcgagccatcgatggcgacgtgacacacaccgcgctcggcggcaacacgagcgagctccccgccggccgagatggcgacggcgcgagcaccatgatcgagcgctcccgccaggacttcgagcgtctcctcggtgttccccgagaacgacaacgccacggccagcgagcgtggaccgacgaacgaagggagctcgtagcccttcacgaccaccacggggatgggcatgtacggagccgccgtcgccaccgcgacgtcacccgcgatgccgctcccgcccatcccgagcaccacaacatgctcgacctggtcgggagcgggaagatcgcacagtcggccaacggtaccgagggcggcttccatctgctcggggagtccgagcgtcgcatcccacatgcctagttcgtccacggcggtcctccctcgggatcggtgttggatacctccccctccggcgagaggccagcggcgactaggagcgcccgatggcgctcgtcatcgaccacctctgcatcctcgaccagcagatccgcgataccgtctgtgaccgcataggcacggtggaggcggggattgtagagcactgactccgactcgatccagagcaggggcccgtggtcgagcggacaggcgacgatggcgagcaggtccggcgagagcgcactcatgcgtcgcgagactccgccttcgcgacgacggcgagcacctgctgcgtccgccgagcgacctcgtcggaggtgcgtgcttccaggttgaggcgcaagagcggctcggtgttcgaggcccgaaggttgaaccaccaatcggggaagtcgatggtgagcccgtcgaggtgatcgacgcgcccttcaccggcaaaggccgtctcgacgaaggcgagcacctcgttggcgtcgcgaaccttggagttgatctcgcccgacgccgcgtagcgctcgtactccttacgcagcgtcgagagctccacccctgcgcgagcgagctcttcgagcacgttcaccgcgccgatcacacccgagtcggcccggtagttctcgcggaagtagtagtgccccgagtgttctccagcgaagatggcaccggtgcgagccatctcggccttgatgaacgagtgaccgacgcgcgtacgaatcggcaccccgccctgttcacgaatgatctccgggacagcccgggagcagatcaggttgtagaggatggttgcacccggctcgcgctcgagcatgcggcgcgcgatgatcgcggtggtggtcgatcccgacaccggcgcggcccggtcgtcgaccaggaagacccgatccgcgtcgccgtcgaacgcgagcccgatgtcggcaccctggctgagaacccgtgccttgagatcgatcaggttctcgggctggatggggtcggcaggatggttgggaaagctgccatcgagctccggatagagcacatcgagctcgacgtcgagtgccccgaagacggctgggaccacgaggccgcccatgccgttggccgtatcggccacgatgcgaagacccgcgagcgacgacgcatcgacgaagctgagcacgtggtgcacgtaggcatcgagcaggttgtcggtggtgcgagccccgcgagcgccgctcgcgctcaccggagctagtccctgctccacgagcgcttcgatctcggcgagaccggtctcgacgccgatgggagcagccccgggaccgcagaacttgatgccgttgtaggaccctggattgtgcgacgcggtcaccatggcgccgtgcgcatcgagtcggccgctcgcgaagtagagcatgtcggtcgagcagagcccgagatcgacgacgtcgaccccctcgaccacgagaccgtccgcaaaggcactggccagctcttcggacgagaggcgcatgtcgcggcccaccaccacgcggcgcggaccgagcgcgcgcgcaaaggcacgaccgatcgcgaaggcgatctcgccattcagttcgtccgggacgacgcctcgaacgtcataggccttgaagattccactcatcgtcgcagggcactccttcgaccgccgcccaaggtccgtccgagcgacgcggccttcgggcaccacggcagcttaccgcaccggcccgggacgtaggatcgacggcttcaggcgcgctggcgacgacgggatcgtcccgaccgagcatcctcttcgacgagcgacacgacgtcgtcgacggtgaccgcatcaccatctcggcgccaccacttggccccgcaggcagcacaggagatcagcgtcagcgcgtggcgagccacgtcgaggtcgatgatcaccaggtcccgctcgcggcacgccggacacactgtgtccatgagacctccctctctcgtgggcctttggacccgatccaggcttcggcacctggggccaggatctttaccaaatgttgagctcgcgagctggtgcttcggcgaccgccccgctcacggaccccgagagggctacactcacaccatgcacgtggcccctgagcagctcgacgacgtcgagcgcatcgcccgagccgccctcgcccgactcggcaccgagggcatcgacgacgaccaagagctcgcgtggcgcctcgcgcacgtcgtgagcgctctcggcgccgtgcgagcactcgtggacgatccggcggtaccccaagcgctcgcgagctacggtgcagccctgttcctgcgggaagcggcgagcgagctcgtcgcgctcggcgtcatcgacgacctcggtgcgcttccgctcccaccgcgaccgtccgaggcggccgctgccgaggtcgccgaggcgcccacgacgtggtcgctgggggccgacctcgatctcgcacgcgacaccttcgggcgcttcgcgcgcgacgagatcgcaccggtcgccgacgaggtccatcggcgcaacctcgacgtacccgagcgcatcatcgagggcctggctgggctcggcgctttcggcctcagcatccccgaacgctacggaggctccgccaccggaagcgtcgacgacacgctggccatgctggttgcgaccgaagcactctcgcaggcctcgctcgggatcggcggctcgctgatcacgcgccccgagatcatcgcccgggcgatccttgccggtggcaccgaggagcaacgggtccgctacctgccagcgctcgcgtcgggcgagctcatgggcgctgtcgccgtaacggagcccgactacggctccgatgtcgcctcgatcacgacgcaggcgatcctcgggcccgacacggccaccgtgcgcggcacgaagacctggtgcacgttcgctggacgcgccaacctgctcgcggtcctcgcccgcaccgagcccgacccgagcctgcgtcatcgagggctgtcactcctcctcgtccccaaggatcccgtcccgggccacagcttcgacctcgagatcggcgggggccggctcacgggccgcgcgatcgacacgctcggctatcgcgggatgcactcctacgaggtcgccttcgacgacgtcagcgttgcgcgcgagcagatcgtcggcggcgaggagggacgtggccgagggttctacctccagatggctggcttcgagaacgggcgactccagacggtggcgcgagcagtcggactgatggacgccgcacttgcgcaggcgcgcgcctacgtcgccaaccggcgcgtgttcggacgcagtctcgccgactacaccctgacccggcgcaagctcgctcgcatggtcgcgacggtggcggcggcacgggccgccgcctaccgcaccgcacgtcacctcgagacccccgaagggtcgctcgcagcctcgatggccaaggcatggtcgtgtcgccaggcagagttggtcacgcgcgaagcacagcagcttcatggtggcatgggctatgccgaggagtacccggtgagccgttacttcgtcgatgcccgggtgctctcgatcttcgaaggcgccgacgagacgctgtcgctgcgcgtcatcgcgcgagcagtcgcatcgtccagcgagacgacacgatgagcgccctccgccgcctcctcggcgatctgctgtactgggccggcctcatcgccggcacgggggccatcgtgatccacctgttcacacttaccgtgctgacgcccgggcgcctcacccaacaagcacatcagctgctctcagccagcgtcgtccagcgcgcgatcgccgactcgctcgccaacgcgctccaacccatcgcttcggctcagggcgtccagctcacgtcgagcgaaaccctcgctgcggtccacagtgcgctcagctcgccgctcgtccagagtgacttcctcggcgccatgacgaccgcgcaagatcgcctcctcgggaagaccagcgcacccgtcgtgatcggcggacccgccttcacgcaggccatcgccgccagccttgcatccgtcgacccgtccgtcgcccatgtggtcgcaggcgaggacctcgccgtcaccgttcccggagccgacgtgcccaaccttggcttcatcgccaccaacgccccgcgcaccgagcacacgctgacggacatcgcgctgctcgccctcgtcctcgccctcgtgctccacaacgaccggcgcaagctcctcgcccgcatcggcacctggctcgtcggctgctcgatcgccgaggtcgccttgttctggttcctcccgaaggtcatcctgccgcacgtcggcttctcgtgggcccagttcgccgcggtggtcctcacgatgaccggggcggccacggtcacgttcttcctcgagctcttcgctgcaggcgccgcagccatcgcgctcgcgcgcggcgcgaaggcgctggtgtgatggctcagccgacgagcgaagcctcgacgatcacattgtcggcataggacccgccgacgccagggacctcagtgaacggtcccccacaggtcaccagcgcgagtgtgggtggcccttgggtcgtgaagagctgtggatgcacgacggtgttcggcgagagcaccggcttcgtgtcgactcgccactcggtctcgcgcccaccccagttgagatagacaagatcaccggggacgagctggccgatctcgccgagggcgccctcgccctgcccgacccagttcacgtgcccagcgagcagcgtcactccgggcgctccgggcgatggcgtctgctcgtcccaccccaccgtgtgcacgtcggacgggatggtcagctcaccgttcaccggcccctcggcgaccaccggcgcgctcacggcaagcgcagggatggagatctcggcgacctcgcccgacacggtcggcgtaaacggcacgagacgactcccgccttggcggggagcgatcgctctctggctcgcgagtgaccgggctcgcacgtgatcgaggtgggtcagacgcgcgatgcgagcagccggcgacgtcgcgataccgtcgtagacgagccagccccccgcaacgatcgcgagggcggacccgcccaccgcgagccggcgccaacgagcgctccgggcgcgctcagcgacgctcatcgtgcctcgcgcggagggaacgacgacgtacggcgaccgccagcgtcccacatcccacgccaccgagcacgatgccgatgggcaccgcagcggtcgtggtcgacggagcgacccttggcccggtcgcgagcagcacgggcgtgaccgacgtcgagctcgtgcgaggtgtcgggagcgaggtcgacgaaccggaggtcgtgggggtgggtcccgagcctgtcggaagcgaggtcgacgatccggaggtcgtgggggtgggtgatgggcccgtcgagccagacgaaccggagccagaggacccctggccttcccccctccaggttgacacctgctataggaggaagggatgagccagacaccgaacccaccaccgggcgacggccccgctggacgacgacgcggccgctacccgagccagttccgcaaggacgcggcagcgttggttctcgaccagcgccgcaccatcgctgacgtcgcccgtgagcttggcatcaacgagcagacccttggtaactgggtccgtcaggaacgcatcgaccgaggtgagcgagagggcctgacgagcgccgagcgcgaggagctgacacggctgcgccgccaggtcaagcagctcaccgtggaacgcgagctgctcaagcgagcgatggccttctgggtgaaggaggggggacagtgagccgctaccactggatctcccgccaggaggccaagggcttctctgtagcggcagcagcacgagtcatcggggtctctcgccaggcctactacgcctggcgacaccgtcgggaccgaggcgaggatcccgagcacctggtgctcgcgagcgagcttcgcgccatctggcacgagagcgacggcacctacggcagcccccgcatcacccacgagctgcgacggcgcgggttctgcgtgaaccacaagcgggtggaacgcctgatgcgcgagctcgagatggcagcgggcccacgccggcgcttcgtagtcacgacgaggcggggagaggacgcagcgctcccggacctcgtccgtcaggacttcgctcctggtgagccgaagcgcaggtatgtgagcgacatcacctacgtccgcaccgatgaggggttctgctatctcgccacggtggcagatcttggctcgaggcgcatcgtgggctggtcacttgggcgtcacatgcccgatgacctggtggtcgaggcgatccgcgaagcactcgggactcggggcagcctggctggggcgatctttcacagcgatcgcggcagccagtacctctcccggaaggtacggagcctgctcgcgacccttggcattcgccagtcggtggggagggtcgcgacctgctacgacaacgccgtggccgagtccttcttcgggagcttgaagcgcgagctggtggctcgctaccgcttcgcgaacctctcaggggctcgctctgccatcgctagctggattcaccgttacaacacggtccgcctgcactcaagcctcgggtacctaccgcccgtcgagtacgagctctcctgggcctgccgggaggtggccgtggcctaaattcagactgtcaagcaaatggggggaagcccacccgaacccgacgaaccgccagagctggtcggcgacgcggggacggtcaccgtcacctggttggacggagtcgtcgaaccgtcgtagctcacggtggcgacgttggtcgcgctctgggtcgccggcgccgatgccgacaccgtgaccgggatcgttacggaaccgaggacggtgccgctcgccacgtcgatgggctgaccgttcaccggcacgagcgtgcaggtcatggtcccagctgagatggcacacggtttcccgcccggagcgctgtcgctcaaccccgccgacggcgtgaagctcggcgagccgtagctgagccaggtcacgctcggcaagttgtcactgaccgtgagcgggtcggcgatgatgcccgagcccatgatggtgatcgtgtactcgccggtcgtccctgggctcgcgaccgaggtcgggctcccgccgctctcgtaccccttcacgaccgtgaacgtcggtggggcaggctgtgggagcgtgcccacgaacccgtggggcgcggtgtggacctcggggaccacgacacaggggacccccgccgtctggacgcagctcgcagtgttcgacaaggttccctcgatgacgtccccgtcgatctgggtgccgccggtgatggtgccgaagggcgcgaggagcgacccctcccactgcacgccacccgagcctcgctggccatcgagcgtgatggactgcgtcgcactcgacgacggcggcgcggcgacgaagatcgccctgctggcgcccgtcgcgctcaccgacgtgatgaaggagagatccgcctgggtcgggagctggacgatcaaggtggccgacgagggcaccgaataggcgagcgtccactccggggacgccgggtacgcggcctggccggcctcgatggcagccaacgcatgaccaaggttcacgacgacgtcccccgtctgcgtcgacgggacgctgatcgtgatcgtcggacccgaggaacccgtcgtggggtaggtgacgctcgccccgctcgtcaccggcaggcccgagagctcctcgtcgagggcctcgagataggtgttctctgcggcaaagtcgagcggactcgttggggacgccgtcgtcaccggcccgctgccgttgttgtagagcgtccatgatccctgcgtccccgtgggcgtcggggagactgccgccccgtagttcccgaggacgaacgtgcttccgctctggacatcgggtgcaacgagcgcgtcacacgtcacgcccggggggcaggagaacccggggaccttctttccgtcgacggtgaagctcgtcccatgcgcggtaccgatgctgccaccgaaggccgcccatccggtcgtgtcgaccgaaccctcgagcgtcgcgtcaccgccaccgacgtagaagccgtacggaaacggattcgccccgccgagcgtccaagtcgtcgagtcagaactcgcccgggcgccggtgccgacgagtccgaacgcgcccgccatccctgccgacgcgactgcgagcgcaaccgcgccaacgaggcgtcctcgccacgcgaggtgtcgacgctgcctcgtgtgacgacccctcctggtgcgccgccgcagtcccctggtctccgcctcgtccatgtgcgctcccaaccctggctaccggagccggccacccaaccatggccacgctgtgtggttcgatggtactacgtcatgtggcgtcttcgccacattgccctcaaggtttgcaccatcgttgccgataaggccacctggccgctgttcaggaccgcgccttggcgacgtcgggaccacgacggtcctcttgaggcgctcgacgctcagcgtgagggcaggctccctacgaggccaacgaccgatgcgtcagcccacgcactcctgtggcgctgcaccagcgcaccaggccactcgcactcggtcgccgcagcgacggcgctacgacgccgacggcgtcatgccggcgcgacggccacggagggcgaacttctccgccatcttgcgactcgcctcgtcgatcatctcgtccccgaacatgaccgctccacgacggtccgacgtcgtggcctgctcgtaggcgtccaagatggcgacggcgcgatcgaagagttcctgtgacggacgatacgtgtcgttgaggacgtccacctgcgtcggatgcaacgcccacttgccgtcgtagcccagcatggccgatcgaagcgcggaggccttgaggccctcgaggtcgtggatgcgcaagaacgggccgtcgatcacctgcagacccgccgtgcgcgccgccatcaggatcttcgagaggacgtagtgaaagtggtcacccggatactccggaatcgcagccccaccggtgagcaccggcagctgcatcgacgccgagaagtccgccggtccgaagacgagcgtctcgagccgtgacgacgcggttgcgatggcctcgacgttgatcagtccccgggtcgtctcgatctgggcctcgatgccgatgtggccgcgctcgagtccgagttcggcctcgagctgcgtgagaacgagatcgagcgccaccacctcgtcggggcgctgcaccttcggcaacatgatctcgtcgagacgcgggccagcccctgtcaccacctcgatcacgtcgcgcaacgtgagcggcgtatcccaggcattcacccggacgcacaccacccgctcgccccagtcgaacgagcggatcgcacgggccacccgcccgcgggcctcgagcttctcgctgggtgcgaccgagtcctcgagatcgaggaacaccatgtcagccgggatggtcagcgctcgctcgatgaagcgatcggacgatccaggtaccgcgaggcacgaacgacggaggagatcacgagatcgggcacccatgggccccagcgtaccaatgcgggtgggtccgcgtcagctcacgcttccgagagctcgaaccacaagaacccgtacggcgcgagcgtcagtgggtagcctccgtcggctgggacctcaggaaatggggtcatgccgagcagctccaccggcacaaagccctcgaacccacgaagatcgaggcggcagggctgagccttcgaggacagattgctcacgcaggccacgacccgctcgtgctcctcgtcgaagcggaggtaggccaagatcgccggattgtcgacgtcgcgcagctcgaaggtaccgtcaccaaagactccctcctggcgacgcgcgagcaggagctcgcgcagccatctgaggaacgacgacgggttgcgcatctgcgattcgacattgacgacctggtagccatagaccgggtcggtgatcggggcgaggtagaggcgctggggatcggcgcgcgagaacccgccgttacgatcgggcgaccactgcatgggggtacgcaccgagtcgcgatcgccgaggtagacgttgtcccccatcaggatctcgtcgccgtagtagagcaccggtgagcccggcagcgacagcaggagcgcgtggaggagttcggccacgcgacgatcgttctcgatgaggggcgcgaggcgccgaccgatgccaacgttgcgtcgcgcgatgggatcggacgcgaaggccgcccagagaaagacgcggtcctcttcggagatcatctcgagggtgagttcgtcgtggttacgcaggaagatgccccactggcaccgcggcgggatcggtggggtctcggcgatggcgtcgcgaatcggctgcgcactctcctgcttcaccgccatgaacagcctcggcatgagcgggaagtggaagcacatgtggcactcgtcgccctggccgaagtactcaacgacctgggccggaggctggttcgcctcggcgagcagcaccgcgtcgggaaactcggcatcgacgagcgccctgatccggcgaaggaacgcgtgggtaccgggaaggttctcacagcgcgtcccctcggcctcgaagagatacgggaccgcatcgaggcgaaaaccgtcgacgccaaacgccagccagtagcgcacgatctccagcatcgcctcttgcaccgccgggttctcgtagttcagatcgggctgatgagagaagaaccgatgccagtagtactgttcgcgttctggcgcccacgaccagttcgacgactcggtatcgacgaagatgatcggggcgtcgcgatacccgtcgtccgtgtccgaccacacgtaccagtccgccttcggattgtcgcgcgacgagcgcgactccacgaaccatgggtgctggtcgctcgtgtggttcagcacgagatcggcgatcacgcgcatcccgcgcaggtgcgcctcccgaagcagctcggcaaggtcgtcgagggtgccaaggtcgggatggaccttggtgaagtcagcgacgtcgtagccaccgtcgcgcagcggcgactcgtagaacgggagcagccacaagcagtccaccccgagccactcgaggtagtcgagcttctcgatgaggcctcggaggtcaccgacgccgtcgtcgttcgagtcgtagaacccgcggatcagcacctcgtagaagaccgcttgctggtaccacgcgggctcgccctcggcgccccgcagcgaggcgaaccggtgttgggccatcaccgtcccacgaagttcgctcgtcccggcccatcggtcaggaacgaccgcacaccgatgcgcgcgtcctcggtggtgaacacctgcgcgaagagtgcctgttcgagcgcgagcccctcctcgagcgagccctgcgtcccctcggcgagcgcgaccttcgcgaacgcgagtgctgcgagcggacccgacgcgaagcgctgcgcccacgctcgcgccgcctcggtcgcctgccctggctcgacgacgcggtcgacgagccccacgccgagtgcctcggcagccgtgagcggctccccggtcaggacgagacgcttcgcgaccgccaacccgacgagccgaggcaaccgttgtgtgccgccgccacccgggatcaagcccagcgagatctccgggaggccgagcttggccgacgaactcgccacccgtaggtcgcacgcgagggcgagctcgaggccgcccccgagggcgtacccctcgatcgctgcgatcaccacgcgtgggagcgccgcgatggcccccaacgcgcggtggaacgcccgggcggtctcccaccccacggggcgctcgtcgaactccgcgatgtccgcgccggccgcgaagatgcgatcgccacccgtcacgaccacggcgcggggcaagtctcgctccaggtccgaggccgcggctgcgagttcggcgagcaccgcgcccgagagcgcgtttgccttcggccgatcgagccgtacggtggcgacgcctgcatcgtccctctcgacgtggacaaactcactcatcggatgaccctcctcgtgctccgtgccctggagcgatctcgagcgcgtcgaggagtgcgtcggccgcggccccagggtccacggtgcccgcctccacctgcgcccacactgcctggtctgcgtcggccgccgcccggaggacgcgatcgacgatgacacgctccaccgcgcgcctccgccgcgcggccacgcgcgacttcaagatgcctcgatcgtcgagttcggccgcgagcgccacgacggcctcggccaccgcatcggtgccctcaccgctcgtcgcgaccgtctcgagaatcggggggcgcggctctcgatggccgagatcgagcatcgcgacgagatcacgacgcgtctcggcgagccccgcacgatcggccttgttgatgacgaagaggtcggcgatctccatgatgcccgccttgttggcctggatggcatcgccccagcccggcgtgatgacgaccaccgtcacgtccgcctcgccgacgacctcgacctccacctgtccgacaccgacggtctcgatcacgacgaggtcgtagccgaccaacccgaggagtcgaacgatctcggggacgctgcgcgcgaggccacccagcgcaccgcgggtcgccaccgagcgaatgaacacgtcggggtcgtgcgtgtgcccctgcatacgcacgcggtcgcccaggatcgcgccgccggagaacggcgaactcgggtcgaccgcgacgacacccacgcggtgaccccgggtccgccacgccccgaccaagcgatcgaccagcgtcgacttcccagcgccgggcgaaccggtcaccccgaccacgacacgagggcgcgctgaccacagatcggcgatgccgatcggctcgccggcccctgcccggcgctcgacgaccgagatcagccgtgcggtcgcacccctgtcaccagcacgagcccgtccaacgagctcttcgaggtcgctcactcgcctccctcgatccagacctgacccccgagtcgctgcaaggttcccgcaagatcgtcgtagccccgctcgatgtgctcgacgccgagcaaccgactctggccctccgcagcgagcgccgccaccaccaacgccgcacccgcacggatgtcgtgcgcgaccgccgtcgcaccgtggagatgatccacgccgcgcacgacgacgtgatggccctcggagatgatgtccgcgccgaagctccgcagctcgtcgaggtagcgaaaccgaccgctgtagagattctcgctgaccaccgagactccctgggcacgcgtcagcatcgccacgagcatgggcttgtagtcggtcgcgacccccggatagggcagcgtctggatgtccccggccctgaggcgctcagtgacctcggcgacgagccgttgacccgcgtcgtcggcctcgatgtggaagccgaggccgctgagcttgcgcagcaggatctcgaggaccctcgggttgacgccgacgagctcgagacgcccggtcgtcgcaccgagcgcggccaggtaggtggccgcgacgacgcggtcgccgatgacgcggtgacgcaacgggcgcaggcgctggacgccctggacgcggatccgagacgtccccgcaccgtcgatccgcgcgcccatcgacacgagcgcggtcgccaagtcgacgacctctggctcacgagcggcgttgtcgatgatcgtctcgccgctcgcggtgacggcggcaaggagcgcggtgtcggtccccgtgtgggacgggaactcgagcgtcaccggcgcacccgcaaggggggagcccttcacgaggaccgatcccgcgtccatcgtcgccacggcaccgagactggccaacgcatcgagatggatgtcgatcgggcgcgccccgaaatcatccccacccggcggcgcgagccgcaccgcgccggtgcgcgccagcaacggtgcgaggagcacgacggacgcgcgaatctgcccgacgagttcggcaggaggttcgctcgacagcgacgccgcctcgggcacctcgacctcgacgacgtgcggctcgggccaggacacccgagcccccacggcctcgagcaggtgggccatgacggtgacgtcactgatggccgggacgttctcgatacggtgacgaccctcggcgagcagcgtcgcggccatgatcttcaggaccgagttcttcgcgccctgcaggcgcacctcaccctcgagccgcgacgtgtgttggaccatccacgaacgcatcgcgcctccctcacgctctccacgccaaccggccacaacctactcggcgccggcgcccggggccaatggcggcgcgtcctcagggttgaggtcctcgagcgtacgagcacgcgtctctggaaaggcgatcagcaccagggcagcgagcgcgatcggcccgatggcgagcgcggcgatcggggtgccgtagcccaatccagccgacgcggccgccccgaccgcgacgagtcccaccacggtgcccaccctgctcgcgatcgcgatcacaccattggccccagagcgaagcctcgtcgggaacagctccggtccgaacaccgccagcgccggcaccgccatggtcccgaccgcttcgccgacggcgtagagcaccaccagcgccacgccgtgggcgaggaatgcgagcgcgaggagcaccccgccgaccgcgagcccaacggcggcgagcacgcgccgaccgaccgtctcggcgaggcgcgcaccgaaggccaggccgatcccagatggcaggttggcgccgatcgtgaacgccgagatctgccaggccgcaaagtggcgatcgacgcgcaagaactggttccgaaactgggaagccggcaggtagaacaggttgaacagcgcggcagcgatggccacgaggatgagacgaccgcgatgctcccgagaggtgagttcgcgaaagcgcacgggggtcgagtgccgaaagcgggccggatcgcggcggtgacggaggcgtgggacgagcacgaggccgacgatcgcgatcgcgaacaaggcgcgccacgcctcgggtgcgatcccaagcccagccaccgccaccgcgcacagtccggcaccgagtgcggtcgcgagcaccagaaagcccatcgtccacgctcgcccctccgcatgcaccgtctcggcgacgatgacgttcgcgagcagtacggcaaccgtcgcgcccgccttggcgagcacctgggtcacgacgaggccggcgaggtccggtgccagcgctcctgccgccgtcgcgagcgtcgcgagcacgagcgcagcccgcaggacgcgccaccgacccacacggtcaccgagcctcgcgatcggcaacgcgacgagcacgtcgacgcgcaccagccccgaaccgaccccttgcgcgaggggtgaggcgtggagcgtgggggcggcgaaggcaagcgtctgtcccaggagcgttccgcagtacgcaacgacggtggcgacccagaacacggtcgcaacgacgtccagtgacccctgagggaagacccctggcggcagaacacgccgcaccaaccggcccttgccgcgcaccagacgcccgagtgcccagcgcacgagccagccgagtcccggcgcgccgacgtcgcagcgcacctcccaacggccgtctggcaagcggcggcgctcccacgccacgagcgagcccgatccctgcacgaagcccgccgcgacccgctcctcgacgagcagggcgcacgcgacgggtgcatctggtccagcgagcgacctcacccgcacgctgatcggctcgagatcaggaacccaggtgctcgtgcaggaacggaatcatgcgatcccacgcctggcgagcggccagtgcgtcgtacacctcgggtctcgagtcgttgaagaaggcgtggtgcgtgccggggtagatgaagaactccacgtcggcaccgagttcccgcagccgcgcctcgagagcacgcacgcgatcgggagacgcgaagtcgtcgtgctcggcgtagtggccctggatggcagcggtgatacggctgtagtcgggctcggccccctgccacgggatcaccccgtagaagggcaccagcgctcggacctgcgttggcacctcggcagcgagcacgtaggcaagcccaccacccatgcagaacccgatgacgccgacgccctggcgccccgtgcgtcgctccagttcgcgaaccgcaccgaccatgcgcttggaggcatcggagagctgcatcgccatcatcgccttggcggcctcgtccggctcgtcgacgacacggccgtcgtagaggtccggagcgagggcactgaagcccgctgccgccagccgatcaacgacatctttgatgtgatcgttgacgccccaccactcctggatcacgacgacgccagggcccgtctcgccaaccggctgcgcgaggtagccagtcgcgtcgtggccattcatcggaaagtgcacggtctcgcccatgcgcccatgctagccagcagggagtggcggcgtcagtaacgtccgccgagcttgcggtggtcccagctcacgatccgctcgggctcgaggcggatggcgacgcgcttggaggccgaacggcgcatcgcctccgcggcctccgcagaacccagctcgtagcgagcgagcagaccctccccgacccggcgcaccagtacggggtcgtcgctgagcacggcccgaccctcgatcagcacgccgcggagctcgtcgtagcgatcgccgagttcgacgagcccgctcgcggtcgcctcccgcgcaaggttgcgcgccttctgcgagcgcgcatacgtccacgaccacaccacaccgtcgaggacaacgtaccacaagggcaccatgtggatggtcccacgaggcccgtgactgccgaggacgagtgtcctcccctcgctgagcagggctgcgatctcgtcctgggtcatcgccacgtgactacgcctcgacggcatcggcccctccctccagctgcgccagtccgggggcaagtcgcggccacccgtagcgcgacggcaggattcgccgcccgtcgacgagcaccgccaggtccgcggtcgcgaacaggcgggctcgatgcctgttggcgaccactcgaaccagctcgtcgggcaggagccgccaggtgcacgtctcgaccgtcgacggcccgacgccgcgtcgggcgacgagcgtcgggccaaccgcgagttctccgccacggccatggagtccgcaggactcgaggtgatcagcgagctcgatcccagcccggtaggcctcctccagtggatcgatgaccccgagcacgcggttcgcgagcgcgagcacctcgacgccgacgcggggatgggcgacaaggagccgaagcgcgctcgtgagttctgggggcgtcgtcggctctgcagcgatgacgagcgcaaccgtgccgacggtgtcagcatcggtgaggtcccacgcgctgagctgacgcagcgcttcgagcaagctcatcacccggcttggataccccctcgtgtcatggctgccacgtcgagcacgcggtcgacctcctcctcccccaagacgccctcctcgagcaccaggctcctcaggtcccgcccctccttgaccgcacgcttgacgatggccgcagcgcgctcgtagccgatggcggggttgagggccgtggcgatcgccggtgtcgagagcgcgtacgtccggcaccgctcgacgtcggcctcgatgccgtcgacgcaccgcgtcgcgagcaggcgggacgccgccgcgagcaacgtgacgctctcgagtgccgcctgcgcgatgacgggctgcatcacgttgagctcgaagatcgacccggcggcgcccgcgaagccgatcgtggcgtcgttgcccaccacgcgcgcgaccacctgggtcaccgactccgggatgaccggattgaccttgcctggcatgatcgatgagccaggctggagatcgggcaggcgaatctccgcgagaccacacctgggaccagaacccatccaacgcaggtcgttcgcgatgcgatacagcgccacacccagcgcacgcagactgcccgacaccgccaccacgccgtcacgagctccgtggacctcaaagtggttcgccgcctcgcgcacgtcgagccccacccgagcgccgatgcgtgcgagcaccgctgcggcgaagccctgcggtgcgttcaacccggtgccgacggccgtgccgccgagtggcacctcgcgaagctcgtccaccgcggccgcgatacgggtgcgtgcccgtgcgatctgggctgcgtatcccgagaactcctggccgagcatgatcggtgtcgcatccatgaggtgcgtccggccggccttgaccacggtggcaaagtcctcgctccgacggacgagcgacgcttccaaggtcgcgagcgcagggtcgagcgcgtcgcgaacctcgagcgcgaccgcgaggtgcatggccgtcgggaaggtgtcgttcgacgattgcgaggcgttgacgtggtcgttcgggccgacggtccgaccgaggcggagcgtggccagatgcgcgatgacctcgttcatgttcatgttggtcgaggtccccgatccggtctggtagacgtcgacggggaagtgctcgtcgtggaggccccgggcgacctcgtcggcgacggcggcgatcgcctcggccatctcgggatcgaggacgccccggtcgcgattctcgagcgcggccgcccacttgatcaacgccagcgcgtggatcacctgtggcgccatgcgctggcccgacaccgggaagttcccgatggcgcgctgcgtctgggccccccaggccgcatctgctggaacctccacctcgcccatggtgtcgtgctcgatccgcacccgttcgctcatcgcctgctccttggtcatcgccgcgtggactaccctggcaccgatgcgagctgtcgtgatcgccgacggtgccgtcaccgtcgcaaccgtagccgacccgaccgttggacgccacgaggcccttgtcgaggtcacctccgcagggatcaacgccgccgacctcctgcaggcgagaggcctgtacccgccaccacccggggtcgatccgacccggctcggcctcgagttcgctggggtcgtcgctgcggtcggggacggaaccaccgaggtacgccccggcgatcgcgtcatgggcatcaccggcggcggcgcacaggcggagtacgtcgtcgtcgacgcagccacgctcgtgcccgtccctgacgagctcgatctcgagcgcgcaggaggctttcccgaggccgccttcaccgccctcgacgcgctgctcatccaagggcagctcggcctcggggaccgcgtgctcgtgaccggcgcactcggtggcgtcgggaccatcgggctccagatcgcccgtctcgccggtgcccgcgtcacggcgctcgtacgcgatgagcgacgtgcatccgaggcctatgccctgggcgcacaccgagcactcaccctcgacgagctgccaggttcggggccctacgacgtggtgctcgagctcctcggagcagccagcctcacgcacgccatctccgagctcgcggtcggtggccgcgtcgtggtcatcggcgtcggtcagggctcacgcgtcgagatcgacctgcgcacggtaatggggtcacgagcagccctccgtggatcgacgctgcgcgcgcgcccgacccacgagaaggcagcgctggcccgagaggtcgcccaccgactcctgccggcgcttgccgaaggttcgctccagatcccggtcgccgcgacgtggccgctccacgacgccgccgccgcctacgaggcgttcgcgcgcccgggcaagctcggcaagctcgtgcttgccatcggcgacgtctgacgggttgcgctccaagcgcccgatcctcgcatctcgatccgcaggagctcaccagcgacgatggacgcagagcccaacgacgccgagagctcccaggcatgcagctccacgttccccgtcgggtcgagttcctcggcgaggccgtcgagtgtctgcccgggcgcgatgcgaacgacgcgcacgatcgttccgatgtgggggcgggcgacggcgcgtagcgcgccacagcacaccgcgaccacgacgagggcgagcgtggccgcgacccgcacccgttccccgcgcccgagacgacctcggccgggcggcctcctccgagcgaggcgctggttccgggcggagccccggctcgtcggctccgccgaacgcgccggcggtggcgtagcgggcgtagcgacgatcgcgagcgcagtcgaggcgggaggcgtacgaacgggcgcggtcacacccgtggcctaacccgagggtcggacacggcacgcaaatgtgacggctatttgcctatgcggatacatcttggcgatatactggcgacatgccgaggatcgaagcaccaaccgtccgcgaacatcacgatcagcgtcgtgagcgtctcctcgacgcggcacgggcgtgcctcgtcgacccggcgattcgctcggtcggcttcgaacacgtcggaccgcgcgcagggatccgacgcaacagcgtctacctctacttcccctccgagacccacctgtatcttgcccttgccgagagcgacgtccccgccctcgccaagcagttggccgaggcagcggcggcagccacgcacgacaagctcgccgccatcgtcgacgtcgtcctggcgaacgcgccccgggaggagttcgagatcttgcgccgcctggcgagtcgcaccgcgtcccagcgtcccgatctcgtcgcaactcgccttggcgagctgcgacgtgagctcgccgaaccactcgtctcggtgctcgccgacgagggtgtggactccgccgacctcgtcggattgctcgcccttggcaccctcgaggcggcactcgacgcgatcgctcagggcgaagatcgcgacgcggtgcgcgaggcagtcctcgccaccgtgcggagcccgcgcactcccagccgctgagcagcaggccacccggcacggcccgccggccgccgagtcacggttctgcctgccgaaggtcggcgtgcgcccgccgccatgcgctctgtgctgctcatcgcgaccggagttcgctccatgaggcaagtaggccgagcaccagcgcatcgaacctggccaactcctcgagtgaggcgcgctcgccgaggctatgaccctcgccctctgccacctggagttcgcacgcaaggctctcgccgacgcgctcgacgaacgcacgagattgctccaccggcaccacacggtccgcgctgccgtgcgtgatgaggaccgggatgcgccgccgcggtcggcggtgcgcgaggtgcggcgcgtcctggccgaccagccagtcgacgtcgccgagcgcggacgggtcgagcagtgggttggtcaacaccaacgcatcgagcagtgtcgggtcctcgaggatgagctgcaggagcgtccagcctgccgacgacgcgccgatgccgacgcgaggacccgcgaccacgccctcgaatccccgcacgacctcggcaagggcctctgactcgaccgtcccgaaccgaccgacgatacgctcgcgtgccgatcgcccgtagccgtacgaacccgggtagtcgaccgcgacgaccaccaagccgtgtcggagtgcgcgacgccacttgtcggggaccgggaacgcgacctgttcgacgggaccgccatggacgaccagcgcgacaccacgaggtaccgggggccagatcgccacgccgcgtgcggccagccccaaggccccaagtggctcgatgcgagaaccgtccaccccgtccgagcccgcctgccggagcgtctcggacccacggcggacccgctccgaccacggcccccgctcgatgcccacgacgtcaccgtcgatggccgagatcgaggtccacgagcccgacgccacgcgacggaggcgctcgtccaggacgacgagcgcgggcgcctccacggaggcgatcactccgagcaccgcctccgagtcggggatgtagccccgacgaccaggcccaagagggtactcacccacgtcgtagtcgagacccgcgatctggggcacccgccccgcgagtaccgggacgtgcgcaccggcgcgatcgtcacgaacccacagaccgcccggtccgaaccgcggctccaccacactcgcaccgtcaccgccgaaattccccgcgatggcgccggtcgggtcgagaagcatcaccgaccccgtgagccacggctcgcgctcccccgcccgggccaacgcgatcgaaccgtcgtcgtcgacggccacatcccagaggtccgagaccccaaggcggccgaggtccaccacgttcaccagccgagcctggtcgtcgaagacgacgacgcgagcgtcgctcaccaccgcaaccatggctccggcgggagaaccggcgatccaacgcacgccgggcacggtggcgacgtgctcgatgcctcgtcccggcacgactcgcacgacggaaccgtcgacgcacaacacccacaagcacgagctgcccatcgcgaggaccccgccgttgccgggacgcgcccacgctggcgtgacgtcggcgcagccgagtgcagtcacggtgctcgccaccacgaccccgcgagcactgcgctcgatccacgcgacgcccagcggacctgccaccacgtcggcgacgcgctggacgacgtcgctcaccgaggcggctcttcgtagaggccgaacacctcgccgagcgccatcatcacctcgccgacgctcgctctcgcgcgagcggcatcgatgagagcgggcatgaggttgcgctctggatcgcgcgcctcgtcgacgaggcgtcggatcgcagtccgctgggcctcctcgtcacgctgacgccgcaccctcctgagtcgttcgatctgacgcgcttcgacctcgggcccgatcacgagcgtcgggatctcgtcctcctcgttgccggcggtgaaggcgttcacaccgacgatcacccgctctccggcgctgatgcgcttctcgagctcgtaggcagagtctgcgatgcggccctggtagtaaccgtcgtcgatcccgacgaaggccccctcgagcatggaccccccaccgaggcgctcgatctcggcgaagatcgccgaggctcgtgcttcgagctcgtcggtgagcgcctcgacgaggtaggagccgcccaaaggatcgacgacgttcgccacacccgtctcgtaggcgatcacctgttgcgtgcgcagcgcgatgcgagccgcacggtcggtgggcagcgagagcacctcgtccatggagttggtgtgcaggctctgcgtgccgcccagcacgcctgcgagcgcctcgagcgcagtccggaccacgttgatctctggctgctgggcggtcagcgacacgccggcggtctgcgtgtggaagcgcaactgccacgaacgtggatcgcgcgccccgtagcgctccctcaaccaacgggcccagaggcgccgtgcggcgcggtacttcgcgatctcttcaaagaaatcgatgtgggcattgaagaagaatgacagctgcggcgcgaacgcatcgacgtcgaggccggctgcctggccgagctcgacgtaggcgaagccgttggccagcgtgaaggcgagttcctcggccgcggtcgagccggcctcgcggatgtgataacccgagacggagatgggatgccacttcggcatctcggccgcggtgaacgcgatggtgtcacgcaccagtcgagccgatggacgaggcgggaagtagtactccttctgcgcctgatactccttcagaatgtcgttctggagcgtgcccgcaaggcgctctcgtgcgacgccacgctcctccgccaccgcgatgaaactggcgaggatgaacgccgctggcgcgttgatggtcatcgacgtggtgaccgcaccgaggtcgatcccgctaaacaggtcccgcatgtcctcgagcgtgtcgatggcgaccccgcacttgcccacctcgcccaccgaccgagggtcatcggagtcgcgtcccatgagcgtcggcaagtcgaacgcgaccgagagcccggtgcccccgttggcgagcagctcgtggaagcgctggttggtctcgatggccgtcgagaagcccgcgaacatgcgcatcgtccagcgcttcgttcggtagcccgaggcgtagacgcctcgagtgtacggatactgaccaggcagctcctcgtcgggatcgaccatggctcccgcgtcgtccgggtcgagcgcgccgtggcgcccgtagaggggagcgaggggcacccccgagagcgtctcgaaggcctcctcgcgcgttccggctcgacgatacgcctccgaccaagccgacagatcacccatgggccgattctaccgaacgtcgctgacgcctccaaggcccgtcacccatgcgatcccccgacgcgggtggtacaggctgctaacgttggcgcgtgaccatcgacgaccgaaccccggaccgcaacctcgctctcgacctcgtccgcgtcacggaggcagctgcgctggctgcgagcgcctggatcgggcgcggacagaaggagtccgctgacggcgccgcggtcaacgcgatgcgctcgatcctcgcgaccgtgcccatgaccgggacggtcatcatcggcgagggcgagaaggaccacgcccccatgctctacaacggcgaggtgatcggcgacggtaccggcccagtggccgacgttgcggtcgacccgatcgaggggaccacgccaaccgcgatggggcgctggggtgcgatgagcgtgatcgcggtcgcgacgcgtggctcgatgttcttccccgggccgatcgtctacatggacaagctggcctccggacccgagggcatcggcgtcgtcgcactcgacgcaacgccacgcgacaacatccgcgagctggcgcgtgccaagggcgtcgctcccaaagacatcacggttgccatcctcgatcgaccccgccatgcggacctcatcgaggaggtccgtagcgccggagcccgcgtgcggctgatcggcgacggcgacgtctcggccgcggtcctcaccgcgatcgacgagagcgatgtcgatctcctcatgggcgtcggcggctccccggaggcggtgctggccgcggctgcgatgcgctgtctcggcggacagctgcaggccaggctgtggccccgcgacacggacgagcgcgaccgggccctcgcccagggctacgacctcgagcacgtcttcgcgaccgaggagctcgtcgacagcgacaacgtcttctttgccgggaccggcatcaccgacgccgagctcctgcgcggagttcgcatcgtgggcggacgcgtccatacgcactcgatcgtcatgcgctcgcgttcgggcaccatccgcaccgtacgcgcccagcatcaactcacgaagctgagggcgatccagctgctgtcctgagcgagcccgagggcccgtgcgagcggagccccaacggcgacggcgccacgttgctcgagcaacgccgttcctgcggggccaacgagtgcggccggggcgagcgaggcgccaagggcgtcgcgtagcgcggagccgacaccgaaccctcgcagatcggggtcgaagacacgcgcatcgacgagcacccaggccgcatcgctcgctcgtcgcgctgagacgacgccgatgacctcatcgtcgacgaaggcgagggcactgcgctggtgcagcgtcggcgccgcggtctgagtcagccaggctccatcgctgacgacgacacgtaaccgcaggtgcgaccgtacgacgatccagctctcgcccacgcgcgcctcgagcacggagcgccaccatcgcctcggatcgcgcatccgcacgagcaggaccgcgaccgccctcggctcgagcggtgctcggaagtcggtcccgaggtcagcgaggtgttcgagcgactcgagcgcacccccctctcgaatggtcacgtggggcacgaacgggcgatcgtccggccacccgagctctgcggcgagcccggcgatccagccgtcagggtcggccacggccagatgcgcggtcgggcgccggttggcgaagacgccgatccccgagaactccgtcactggtggatccagccgcgcgacgacctcggcgacctgccggaggagtgcagcaacgccggcagcgtcacgctcatgcggcggcagcaacgtgatgtgcggcacgatgcgatcgagcgcgcgcgagccgacgacacgcctcacggcatcgatgccctcctcctgggcatgcgacagcaccagcgcgacggcgacccgaacgcggctcacaccgacagccgagactcccgcagctcgaggcccgcccgatagggggccacgaagcgctcgtccacgtcgctcgcgagctctgcgacgacacgccgccgcgactccagcgacgcctgatcgatgtcgcccacgaactccgcggcacgcgcgagcacgacggcacggttgccaccgacgcgcaccagaccgccgtcgatgaccagttcctcctgggtgccgtcggcgagccagagcttggccacacagacctcgacctcaccgacgaaacgcccgtggttggcgaggaaggcgatgtcgccggtcgggacacgcatgacgagttcttcgacggctccctcgaacacgacctcctcgggagttgcgatcacggcatcgaaggtcgcgcgcatctctacccgagctccttggccttggcccagacgtcctcgatgctgccggcgttcaagaacgcctgctccggaacctgatcgaggtccccgcgaacgatcgcctcgaaggactcgatcgtctccgcgatcggcacgtacttccccttgaggccggtgaacacctcggccacgaagaacggctgcgacaggaaccgctggatgcgccgcgcccgggcaacgatgaccttgtcctcctcggagagctcgtcgagcccgaggatggcgatgatgtcctgcagatccttgtagcgctgcaggatctgctggacgctccgagccacctggtagtgccgctcgccgacgatggtcggatcgaggatgttcgacgtcgacgccagcggatccacggcgggatagataccgagtgaggcgatctgacgcgacagctcggtcgtcgcatcgaggaacgtgaacgtcgtgaacggcgccggatcggtgtagtcgtcggccgggacgtagacggcctgcagcgaggtgatggagcggcgcctcgtcgaggtgatccgctcttggagctcacccatctcgtcggcgagcgtgggctggtaaccaaccgccgacggcaagcgcccgagcagggccgacacctcggacccagcctggacgaagcggaagatgttgtcgatgaacagcaggacgtcttgatccttgacgtcgcggaagtactccgccatggtcagcgcagcgagccccacgcgcagacgtacgcccggcggctcgtccatctgcccgtagacgagtgcagccttcgagatgacgcccgactcttgcatctcgaggagcaggtcggtgccctcacgtgtgcgctcccccacgccagcgaacaccgacacgccgccgtgctgctgcgccacacggttgatcatctccatgatgagcaccgtcttgcccacgccggcaccgccgaagagtccgaccttgccaccttggacgtagggctcgagcaggtcgatgaccttgatgcccgtctcgaacatctgggccttcggctccaggtcctcgagcggcggtgccgaccggtgaatctcccacaggtcgtcagcaccctccaacgacggggcgtccaggggttgaccgagcacgttgaacacgtggccgagcaccgcatccccgacgggcacgctcagcccgcgccccagcgcacgcaccggcacgccacggcgcaggccatcggtgggtcgcagacagatgcagcgcacccgtccctcccccagctggcgcgccacctcggcggtgatggtgacggtctcgccgtcgacctcggcgtccatctcgagagcggcgttgatctccggcaaggcgtcgggagggaactccacgtcgaccactggtcccgcgatcgagaccactcggccaaggacatgctcggcgttggtcatagcagctcactttccttcttcagcgcccccgccgtcgcgagagcctcggctccacccacgatctcggcgatctccgtggtgatcgcatcctgccgtgctcggttcatcgctcgtgtcagcgtccgtaccaactcgttggcgttgtcggtggcggtcttcatcgcccgctgccgggcagcgtgctcggcggcggacgcttccagcaagagtccgaagccctccgccacgatgaggtcacgcaggctcacctcggtgagcaccgccagatcggggtcggtctcgacctcagagcgcgactccgtcccgtccaacagatcgtctcgacgcatcggagcgaggtgcgtgacctcggtgcgctgggacccgagcgagtagaagcggttcgaaatgacgtcgatcccaccgatgacaccctcttcgagctgcgcgatcagcggagtgaagagtcggagcgcctgctggtaggtcggctggtgggtgacgtgatcgatctggtgatcgacaccgacaccgcgaaaatgcgcccaggaaccgaacttgcgcccgactcccaccacgacacccacgtcgccaccgcgacgccgccgctcgaaggctcggatcacgttggcgttgtaggctccgcacaggccgcgatcggcggtgaccacgacgacggccacgggaccggaggcctccagcagaggactgcgcaacgctggctgcgccgcgaccagcgttcgtgtggcgtcgctgagttcccgatagtacgtacgcgcctgggcgatgcgccccaccgccttgacgatgcgagaggcggcgatgagctccatcgccttcatgatcttcttggtcgagttcacactgcggatctgtgcccgcagtgctcgctccttgccgcccgccacgcgctaggccccctgatggagtgccttgaaggccttgatcgccatgtcaagccgctcgcggtcgccaaggcgcttcgactcgctgatctcctggagcacctcggggtgctgagcccgcaggtaggcgaggaacgccgcgacgaaggggccgacctcgctggtcggaacgtcatcgacggcaccgctggtgccgacgtaaatggagacgacctggtcctcgagcgacactggctgaccttgaggctgcttgaggatctcggtcaagcgatacccgcgatcgagctgggcctgggcgaccttgtcgagctcggagccgaaggtcgcgaacgcctccaactcgcggaactgcgcgagttccaggcgaagcgagccagcgacctccttcatggccttggtctgcgccgacccgccgacgcgcgagaccgaggcgcccacatcgatcgccgggcgcacgccagagtagaacaggtcggcgtcgaggaagatctggccatcggtgatcgagatcacgttcgtcggaatgtaggccgagatgtcgcccgccttcgtctcgatgatcgggagcgccgtgagcgagccaccaccgagttcgggcgacagccgagccgcgcgctcgagcaaccgggagtggagatagaagatgtcacccgggtaggcctcacgccctggcgggcggcgcagcagcagtgagagctgccgataggcatcggcctgcttggagaggtcgtcgtagacgatgagggcatcgtctcccgactccatccagtgctgaccgatggcacaacccgcatacggggcgaggtacttgaacggcgctggctccgacgctggcgcggagaccacgaccgtgtaggccaacgcaccggctgctcgcagcgtctcgacgacgctcgcaacgctggtgcccttctggccgacggccacgtagatgcacttcacgccctggccacgctgattgatgatggcgtcgagcgcaatggaggtcttgcccgtcttgcgatcgccgatgatcagctcgcgctggccgcgcccgatcggcacgagcgtgtcgatggccttgatgccggtctgcaggggctggttcaccggctgacgcttggtgatgcccggggcctgtacctcgagacgacggctaagactcgcggcgatcggcccgagaccgtcgagcgggcgccccagcggatcgatgaccctgccgagcagctcgtcacccaccggcacggacaggatctctcctgtcgagcgcacgatctgaccctctcggatcccctcctggtcgccgaggatcacggcaccgatggcctcttcgtccaggttcagggcaaggccgaccgtgccgtcctcgaagcggagcatctcgttcaccgcgaccgacggcaagcccgagaccagcgcgatgccgtcgaagagctgcagcacgcgcccgatctcctcgccgccctggtgcggcgcgaactcctccatgcgtcgccggatgaccccagcgacctcttcctcggagatttcgaagtgctccatcaccatttcactcccctacgcgctgacgagacgacgagcgtcgtcgagctgacgtcgaacgctttgatcccagagacgatcgccaacgatcgccacgatgccgccgatgaccgactcgtccaccacccactcgacctccacgcgctggccgacgagccgctcgaggtgcgtacggacggcgtccgcctcatcgtcacgcagcgaacgagccgtgcgaaccgttgcgacccgcaacgagagctgtcgggcggcgagttcgagcagccgatcgacgacccggccgatcggtcgcacggaactcgtcgcgacggccgcacgaaggatccaggtcgtccggacgctcacgcgcggcccaaacagatccccgatgatggcgaggcgtgcttcgcgcgttccctcgaaacccgacagcacgcgctggagtgcccgatcccgttcgagcacctgtgccacaccgcgaagttcgtggagcaccggctcgagctcgtcgcgcgctccgaggtcctcgaagatggcccgcgcatagccgatgacgcgcccgatggtggcaaagtcgccggggccctcgaggaccatgtcggaggcgaccagctcagggagttcctcgagcgaatgcaccacctcgccgacgacctcccacgcgacgacagcgtcgaagagccgcagagcgagcgagctgacgcgctccccgacgaggtcgtggagcactccttgacgacgatcgacgtcggcggctcgatcgtcgagggcgacagcgagctggacgaagcgctcgcacagctcggcgacgccgcgagcgtcgcgttcgagctccgaggccgttccggcctcgcgagcgagatcacgcagggcgagggcgtagcccttcacgagctcacgcatcagtcagcgggctccgcctctcgcaagaaggcctcgatgagcggatcgaacgatgactgctcgagctctcgtgcgacgatcttgccagcgagctcgaccgcgaggtcagcgacctcggaacgcagcgagcgcagcaactggacacgctctgccgccagttgcgcctccacctgcgcacggatcgcctccgcctcggcacgggcccgctcgctcgcctcctgcctgagcgcctccgcggtccggcgagcgtcgtcgaggatgcgacgcgcgtcctcgcgcgccccctggagctctcgttcgcgctcggcccgcagggcctcggcctcgcgtcgcgcagcatcggctgcctccagatcggcacgaatgcgatccgaacgctgcgccatcatccgcgcgaccggcgggtaggccaccttggccaacaccaccaacaagatgacgaacgagatcaccgaccagacgatctcccccgtgctcgggaggatcgggttcggcgactgagtgacaaccgcctcgagcatgcgatcagccggtgtacttgaggagcacgaagacgacgaagccgatgagggcaagcgcctcagcgagcgcgaaaccgatgaacgcgagcgagcggacggctccagcggtctcgggctgacgcgcgatcgcagagaccgcctgcccgaagatgatgccgataccgatgcccggtcccaacgctgccaaaccataggccaagcccgaaccgagttcggcaagacccttgcgcaggttgacgctcgacgctgccgcgatcaccgtggcaacaacgttgtgcattgatcctctctctctccgctgtggtacccccgggttctccacccgagatctcgatcccccgaccgtgacgcacaggcctcggaacccgacgcgccgggggcatgctagtgcccagccacccccatggcctcgccgatgtagaccgccgtcaagatcgtgaagatgaaggcctgcaagaacccgacgaagatctcgtagcccgtcaccacgaccagcatcgcagctggcagcggcagcgcaacgagggcgatcgacttcacgaagagcgcctcggagatcaccgcgaacgtgatgagcagcaggtgacccgcgagcatgttgccgaagagccgcaccgcgagggcgaacggacgcacgagaaaggtcgacaagaactcgatcgggacgagcaggatgagcaggacccccggaacgcctctcggcacgagcgcgctgcggaagtagccagcgaacccctgtcgcttgatcccgaccgcgaggaaggtgacatacgagatcacggcgagcgggatggtgacgctggtgcgagccgtggccggcatctggatgaaggggacgacctcgaacaggttgttgaagaggatgaagaagaacatcccgacgagccagggcagccagctcaagccctcagggcccatcacgtccaacacgatggtcgagcgcacgaaatcgacgcccgcctcgacgacgttctggacgccccgtggcacgagttgggcgcggcggccggcaagcccgaagagcacgagcgtgatcgccgccgatgccagcgtcagcaccgcgatcttgttgaacatgaacgcagtgccggaaaaggcgatcggacgccagttcagcacctcagcgatcgggggaaagctaatggcggcgagcatcaccgaagcaccctccacggacgcagtccgtcgtcaccgatccgcccggacacacgccgcgcttcgaggacgaccgcaacgagatagccggcgatcaccaccgtcgcaaagacaccgaggcgcatccagtgagcatgcaccagggggacggtgatcgcggtcagcagaccgagcccaaggatgagcgaggcaaacgccgccaccatcaagcccccgatgccaaacctcgcgccctcgcgaaacgccacgaccatgatcgcgaaggtcagcgcgacgccggcgagcgcgaacgcggcggtctcgaggccagcgataccatcggcgatgccgccacctgcgagggcaaccggcgcaaccaaggcgagacgggtgagaaacccgagggcgagacgcgtctcgggactggtggtactcatgccctcggacgccccccgaactcgggagcatcgagcgtacgggcggcctcacgcacctcgtcgggtacctcgagcgatgcctcgagcacgcgcccacgaccaggccgctcgggcgcacgagacggtgcggactcgacgacagcggccaccgaccgctcgagtccctcacgcgctcggtagatcaacgagagcaacgagccgacgaccccgaggccgccgatcacgaagccaaggatcacggagtgagacgcgcgcccggcccagaagccgagcaggatcacgatgacgagcgtgccgaaggcctccacgaagtgggccacagcctcactcgcccccgagatcatcgggtgcgcacccgcgcctcgtttcaccgcgtcctctccccacgactggcccactcggccgcgctcatgctagcaggcaacctcggagcggccgccgtcaggaaccctcccgggtacccgagtgacgccgtagatccgggtgcaacaaggtgaacagcagcaccgccgccgccacgaccacgatcgggagctcggccgtcaaggacggaacgaacgacggcaccaacgcaaaggctgacagcacggcggtccaggtccacaagatcgccaccgcccgtcggggcccatgccccatctcgcgcagccgatggtgcaggtgcaagttgtcgggcgtggcgacgctctggtggtgccgtgctcgacggagcaccgcgagcaccatgtcgaccatcggcacgccgaggatcacgaacgggatgacgaggggcgcgaagaagaagaacgtttggtccgagacgttggcggtacgacccccgacgacggacgtcgcggctgcgagcagcaacccgagcagcatggcgcctgcgtcgcccatgaagatccgcgctgggttgaagttccagggcagaaatccgatggccacgccagcggttacgaaggcgacgaccggaccgatcgacgactccggcagctggcccaacgcctggaggtgcaagctgtagatcccaaaggcgatcgacgcgatcgcgacgatgcccgcagcgaggccgtcgagaccgtcgatcaggttgatcgcgttcgtcatggcgaccacccagatggcggtgagcaacggcagcatggacggcgcgagcacgacgatacccgcaaaggggaccttgaaccagaacatcgtgacgccgaagtaccacaggatgctcgcagcgagcacctgggtcgcgaccttggccggcgccgacaggtcgaccacgtcatcgatcgctccgagcacacagatgacggtcgcggcgagcgcgacccccagcggctctgacgagtcgaagaacaccgcgcggaaaccaccgatcatgctcgcggcgccgaaggcgacgagcacgccgaccagcatggcgagaccgccgagggttggcgtcgcacgttcgtggacgtggcggccaccgggttggtcgatcgcgccgactcggagcgcgagcacccgcacgagcggcacggccaaggcggtcacgaccgcgccgatcgcgccgaccagcagatagcgcatcaggacgcgaggccaggcggcacgaaggccgcacagagctcgcgaacctgctggcgaacctcccgaaccacttcgtcggtgcgggcgcgcagcacggtcgcgatcagcgaccccacgcgcttcatctcctcctcacccataccggtcgtggtgagggccgccgtcccgagacgcagccccgaggtgacgaacggggaacgcggatcgaacggaatctgattgcgattgagcgtgatgcccgcggcatccagcaggtcctgggcggtcttgccgtcgagttctggatcgaagtcgcgaagatcgacgaggatcaagtgcacgtcggtgccgccagagacgagacggaaaccctcggcctcgagcgaggccgcgagcgtctgggcgttcgccacgacccgacggccgtagtcgcggaacgacggtgaggcggcctcgcgaaaggcaacggccttggctgcgatggcgtgctcgagcggtccaccctgcagtcctgggaagaccgccttgtcgatggccttggcgacgtcctcatgaccgacgatcgcagcacccctcggtcctcgcagggtcttgtgtgtcgtgaaggtcacgacgtcggcaccgcgctcccccgacgcgagccacaacggattggggtacaccccagccgcgatgagaccggcgacgtgggctgcgtcgaagagcacgcgcgctcccacctcgtccgcgatggctcggatcggggtgacgtcgatgacgcgtgggtacgcggtcgcccccacgacgatgaggcgcggatggtgcgcccgtgcgaggtcggcgagctggtcgagatcgagccactcgcgattcggatcctcctggcggacgccatagccgacgaaacggtagagctggcccgagaagttcacgggcgagccgtgggtcaggtgtccaccttggtcgagccgcatcgccaacaccggatcacccggcgccaagagggcgaggtaggcggccgcattcgcgttcgctccagcgtgcggctgcacgttggcccacggcgcgcgaaagagcgctcgcgcgcgctcgatcgcaagggactccacctcgtcgacgacggcgttacccccgtagtagcggcgaccggggtagccctcggcgtacttgttggtcaacaccgaaccggtcgcctcgagcaccgcagcggaggtgaagttctccgacgcgatcagctggagcgtcgaacgctgccgctcctgctcgcgcacgaggagcgcggcgagttcagggtcctctttgctcagcacgcccatggctcctcccttctcgcctcattgtaggcgtctcgcccgtggagcctcagcgaacctcgaccggctcgccgagcacggcttcgacgtccgatggcgcgaccgcaccctggcggagcacccggacctgcggacccgtcaggtccacgatcgtggacgcgacccggcccgagggacctggagcccacaggacgccagcgagccgaccagcgaccggactgccgtgggcgacgaggtcggcgagcgccgtgtcgacgtccgatggcgtcgccacaccgtgccagttcgccgaggaggcagcgagcggccgaccggtggcgagttcggccagccactcgacgtcggggacccgcagtgcaacgctccggcccgagggattgaccacgtccgcgagcgttggggcgtccaccacggccgagatcggtcccggccagagcgcgccgagggcccggagcctcgaccggcgacgtggctcggcgtaggcgagcgcctcgtcgatcgatccgacgagcaccggcggcggcgtcgtggtcgagcgacccttcaacaccgcgatgcgctcgagcgcgcgtcgactcgtcgcggatccgaccaaccccgggaccgtgtcggtcggcatgaggaggaccgaacctccatcgagaatcgtggccgcgcgtcgaaacgcctcgactccttcgagcgagggctcagccggctgatcgccgaggagttcacgaagccgcacgagtcgctccaggccaccgcgcgacgagcacccggggccggccggcaagatcgcgttccacggtcacatcaccgtagccctgcgcgctcgcctcggccaccaaccgctccccttgtgtctcaccgatctccatgaagagccaccctcccggccgcaaggcgacccgcgcaccaccgatgactgccatcggaccctcgagacccgacgggcccggtacgagtgccacccgaggttcgaacactcgcaccgcagggtcgagacgctcccactcggacgctgcgacgtaggggggattggcgaccacgacgtcgagcgactcaggttctgccccctcgaaccaggagcgacgcacgagcgtgacgagcgcacctgtcgctcgaacgttctcccgcgcgagcgcaagcgcacggggatcgacgtcgctccccgtcacctcgaggcgcggaccttcgagggcaagggagatcgcgatggcacccgagcccgtaccgacgtcgagcacgcgcatcccggtgcgcacggccgcgaggacgtgctcgaccagctgctcggtctcgtagcgcggaatcagcgcacgatggtcgacccggagctcatgacctcggaacgaccacgtgccgagcacgtactgcaggggctcgccggccgcgaggcgggcctcgagacggcgcgcgatgactgcggcgctcgcaccggacgaggcggcgcgtcgcgccaccgcctcgtcgaaccagcgtcgctcagcaggtcgcatctccgcgctcacgcatcgcgcaacgcggcgagctgctcctcgcgctcgtggacgaggagcgcatccgacagctcgtcgaggtcgccctggaggatctggtcgagccgatagagcgtcaggccgatgcgatggtcggtgacgcggttctccttgaagttgtacgtgcggatcttctccgaccgaccccccgagcggatctgcgccttgcgcgtggcggtgagctcggcttgacgcttgtcttgctcgagcttgagcagacgcgcgcgcagcacctggagcgccttggcgcggttctggatctggctcttctcgtcctgcatggcgacgacgatccccgtcggcaggtgcgtgatacgaaccgcagagtccgtggtgttcacggactggccacccggcccggtcgatcgatagacgtcgatgcgcaggtccgacgggtcgatcgacacctcgatctcgtccgcctcgggcagagcggtgacggtggccgaggaggtgtggacacggccctgggtctcggtcaccggcacccgttggacacgatgcggacccgcctcatgcttgagccgcttccaggcgtcatcccctctgaccagcagggtgacgtcgtcgtagcccccgagatccgacacgcttcgcgacaggacctcgaccttccacgaccgtcgatcggcccaacgctcgtacatatcggcgaggtccttggcgaagaggttcgcctcctcgcctccttcggctcccctgatctcgaggatcaccgcgcgaccgtcgttggggtccgacggcaggagcaacagctcgagtgcctcgcgagctcgcgcgagcgcggcatcgatctcatcgagctcggccttgagctcctcacgttcggcggggctcgcgccccgatagagctccctcgccgcgtcgcgatcgccttcgagcgcctgcacccgtcggagggctccgacgatggcctcgagctctttgtgacggcgagcgacctcccgggcgcgtcgctggtcctggaagatcgcaggatccgccagttcctcgagcacccgagcgtactcgtgctcgaaacgctcgtaccgatcctcgctcatggcgtctcctcgataagttcacacggtccaaaggcctcggcgatacgagccccgaggggcgcgctccccgcgacgacgagccgaacgacgctcgaccagtcaccggccagggcacgcgcctcgatggggagccacggatcgaccgctcggccgaacccgacgacggtgccgtccggcgcccacgcccacgctcggcccgccgcctcacgaacgcgatcgggctcgaagggccgcagcggctcctgctcgagccacgtggctcgagagcggcgcgcaatcgcgcgcggcacgctctcgaccccggggcttcgaccatggtggccatcacggagtcgccgggcgagcaggcgcgcctccgccagcagaccctcctcgtccaatccgagctcccgacgcatcgcccagtcgcgcggatcgacaccgacaacacgctcgccgtcggctcgcccaccgatcgtgacaccagccgattcgacgaggaccgcatccggccacgacgtcacgccgaccggcacgacgtcggccacggctcgatacaaggcacggagccacgcatcgcgctcccagtcggcgtcggtcgtgacaggcggtgcccagggctcgacagggacggggcgtcccccaacgagctgctcgagcaccgcgtgcgtccccttgagggccgcagcgacgcgatcgagacgctccgttggcccgagcgtcacgatacggacacgctcaaggtggcgatactcgacccaggccgcaaccgcgccggccgcgcccgtcgtcgtcaccacgacgatctcaccgtctcgacgacgcgcagcgccgtctgcgaacgcgccacgatcggggagctcgacgacgacgccgtcgggagccagcgcgttcgcgacgacaaacgcgagctcagcgtgcctgctggccgcgccgtgctcggtcaccgtagcggcgctggaagcgctcgacgcgaccaccggtgtcgacgagcttctgtcgaccggtgtagaacgggtgacactggttgcacagctcgatgtgcagttccgacttggtcgatcgggtctggaacgtgttgccgcatgagcagtgcacggtcgcgaccacgtactggggatggatcccttccttcacgatgcctccttcacactgatggtggactccgagagcgctgccgaggatgcctgggctgcgctagatgccagggctacgcgcgatctcggcgagaaactccgcattcgagcgcgtcgagcggatcttgtcgatcaagagctcgagacccgcagccggtgtgccctcctggctgatcgcaccgaggactcggcgcagcttccagacctgcgccaactcgtcgcgagtgaagaggagctcctcgtgtcgcgtcgacgaggcgttcacgtcgatcgctgggaacaagcggcgctccgcgaggcgccggtccaggcgcagctccatgttgccggttcccttgaactcctcgaagatgacctcgtccatcttcgagccggtctccacgagcgcggtcgccaggatcgtgagcgagccgccttcttcgacgttacgggcggcaccaaagaacttcttcggaggatagagcgcacccgagtcgacgccaccggacatgatgcgcccgctcgcgggctgggcgaggttgtaggcacgagcgagacgcgtgatgccatcgaggatgatcacgacatcgtgcccgagttcaacgagccgcttcgctcgctcgatcacgagttcggcgacctgggtgtgctcctccgcgggccggtcgaaggtagacgcgatcacctctcccttgaccgagcgtcggatgtcggtcacttcctccggtcgctcgtccacgagcaacacgaagaggacgacctcagggttgttgcgctcgatcgcgtgcgcgatctgcttcatcacggtcgtcttcccggccttcggcggcgagacgatgagtccgcgctgacccttgccgatcggcgcaacgagatccatgatgcgtgtggtgagctcgagcggatcctcggcgttctcgagcaccagccgctcgtccgggaagagcggcgtgagatcctcgaagcgagggcgacggcgagcatcctcgaccgtcatgtcgaagacgcgctcgacgcgcacgagcgccgggaacttctcgttctgggagctcgcccgcgcctgaccgacgatctggtcgcccttgcgcagcccgaacttgcgaacgagcgaggccgggacgtaggtgtcccgcgatgacgtcagacggccattcgctcgcaagaagccataaccctcgtcgcgaagatcgagcacaccgacggcctcgatgagctcttggacctgcggtccttccgcctcggccggccggtcaccgcgatccttgttgcgccgacgacgcgagcgacgactactgccctcgtcgccacgacgagcaacctcaccgcgcacctgctccgatgcttcaggagccccgtcgctctctgcgtgtgcctccgtccgcgctgcggccggactggcctcgccgcgtcctggcgagccatcgctccgttgcacactcgcatccacggcgatcggaggcagcagccgcgcgaggtcgaccgcaaggcgatcggcctccgcgagggtcggctctcgggtcccctcggtcgcgctctcggcttggggccgacgctcgcgtcgccgagtcgacgactgaccccgctctcgcggtccgctcccgacgacgctcagcgcgtcacgagcctgggcatcgtccgcgggcagcggcggaagcaccgcggcggctgcgtcctcgttcgcgaagaggctgcgatccccctcgtcgctcgcggatcggcgtgccatcgacgacgcctcgatcgcctggatgatctccgctttgcgcgatcgggacgaaaccttgacaccgagctcacgcgcgatcgccagcagcgactctcgatcgcggcgtgccagatcaccgagcacgtcggtggaactcaccatggggtagatcccttcttggtcaggaggaacaggcgcagcactggcgcggtcacgccagtccagcagctcgagcaatcgcgtcaagacctgcagacgacggcacgggtccctccacagtgcgcagcgcggtgtccgggtccttcaagccatgccctgtcaggatgcacactaccgtgtctgaccgcgctaggtccagtcggaggaggccagcaaccgaagccgctgaggcgggctcgcagaacaccgactcctctcttgcgagcagtatataggcctcgagaatggcgtcgtccgagaccgcgagcaccgtcccacccgagtccgacgtggcgttcagggcaccttgccacgaagccggacgcccgatccggatcgcgctcgcgatcgtctcgggatgctcgacgacctctccgcgcacgatcggagcagcgccctcggcctggacccccaccatcctgggcagacgcgtcgtcgcacccgcggcatgcgcttcgcggtagccacgccacgacgccgtgatgttgccggcgttgccaacgggcatcacctggaccgtcggtgcatccccgagctggtcgacgatctcgaacgcaaccgtcttttgaccctcgagtcgatccgggttcacggagttgacgagcgcgaccccatcggcctcggccagctgccgcacggccaccagggcatcgtcgaacgacccctcgatcgcgacgacgcgcgcaccatagagcaacgcctgtgccagcttgccccgtgcgatgcctgccgacggcacgacgaccacgctcgccaggcccgccgctcgcgcatacgccgcagctgcggccgaggtattgcccgtggacgcgcagatgaccgccctcgctccgcgagccttcgcgttggtcaccgcgagcgccatcccgcgatccttgaacgaaccggtcggattcaagccctcgagcttcaagaacacgcgtgcgccgacccgctcggacagatgcggtgcgtagcgcaacagcgtccccccttcgccgagcgagaccagctcagccccgtcctcgatcggcaacgcgctccgatacgcctcgaggatgcctggccaccgcagccgtctcacaacgccatcgtcgtgtgccatcgctcgcttcctcacagcacccggtatcgttgccgacgtccgaccacgtcgccgagcgtcaccaactggcgatcgatcgcctccatctgctccagcgtcgcctcgtgcgtcacgagcatgaggtgggcgtggccctccccggctccgagctgctccacctgcgcgatcgacaccccttcctcgccaaacacctcagccacccgcgcaaggacgccagcagcgtcgcgcacgagcagcgagatcgcgaatctgccggtgatcgacccagccgacagcattgtcggctcctctcgagccggtgccgtactgcggcgccccgcccggcggttctgcgcagcctcgaggatgtccgcgagcacggcggccgcagtcggcagcccacccgctcccgggccgatgaagaccagctcaccgaccgcctgaccttcgacgaagatggcgttggcggcgtctcgaacgcccgcaaggggatgctccctcggcacgagcgcaggaaagacctcgacgctcagcgcctcgccatcggcctcgtcgagtcgccgcgccgtggcgaggagcttgatctcagacccgctcgcgtgcgcgaagcgtacgtcggcggcggtgacgccgacgatgccctcggtccgcacgtgatccgcgcgcacgctgcgctcgaacgcgagggatgcgagaatggcggccttcgcggcggcgtcgcgaccgtcgagatctcgactcgggtcggcctcggcatagccgagtcgctccgcctcggccaccgcctccgcgagttctgcgcccgtctcgctcatgcgcgtgagcacgaagttggaggtcccgttgacgatgccttgcaaggaccagagacgctccccgaacagcgacgtgcgcaggactcggatcagtggcaccccacctgcgacggcggcctcgaacagcagatcgacaccgctcgcctcggcgagtcgctcgagcctcccgaggtggtcggcgagaacgtccttgttcgccgtcaccaccgccttacccgccagcaacgcgcgctccagcgccaacagcgccaccttcggctggcccatcagctcgacgacgatgtcgacgctcggatcggtgatggcagcatcgaggtcatcggtgacgagtcccatgggcacccaggcgtcacgtggtcgctggatgtcacgcacgacgatggaggtgagctcgatcggttcaccgaggcgccgctcgagcagcgcagcgtcgcgatcgagcaaccggacgaggctcgagccaacgacgccacacccgagcagcgcgactctcacgagcccacctccagacggaacagatcatcgagctgctcgcgacggacgatctcgcgggcgacgccgtcacgaaccatgaccacgctcggacgcggcaaccggttgtagttcgaccccatcgagtagccgtacgcccccgtgaccggagtcacgatgagctcgccagcagcgaggtcttccggcaacagggcgttggccaccagcacgtctccggactcacagtgcttaccgaccacgcgcatcgccgtcgtgtgcggcgcctcgagtcggccggcggcgacggcctcgtagccagacccgtagagcaccggtcgagggttgtccgacatgcccccgtcgacggccacgtaggtcctcacccccgggatccgcttgaccacgccgacacggtacagcgtgatcgcggcgggagccaccagcgcgcggcccggctcgacgaaggtgcgctccggatccatgccggccagcgttgtcgcctcggcgatggagcgcccccactcctcgagcgtcggtgcccgttcgtcacggacgtagggcacgccaatgccgccaccgaggctgacctcgtcgaccccccaggcttcgcgcaccgcccccatacgcccggcgagctcgccgaagggatcgaggtcgaagatctgtgacccgatatgggcgtggatccccacgaccgtgaggccgtgcgcacgcgcccacgtgagtgctcgctccgcagagccatcgtcgagctgaagcccgaacttggagtcgacctgccccgtgcggacgaaggcgtgggtgtgggcctcgatccccggcacgacgcggagccagagtcgccgacggccgagaccaagacgcgcgatgcgctcgagctcctcgtgggcgtcgacaacgattctgccgaccccaacctcgtcggcgagcaggagctcatcgacgcccttgttattgccatggagtacgatacgctccgcaggcacgccgcctcgacgagccgcctcgagctccccggccgaggcagcgtcccaccagagcccggtgtcggcgacgatgcgggccatcgccaccgcagagaacgccttcgacgcataggtcacctgcagcgcacccagccccgaccgcagctcgtcgatgcgtgctcgtacctcgtcctcgtcgtagacgaacagcggcgtgccgaagcgatcggccagctcgtgcacgctgatgccctggatcgtcagctcgccgctcgcgccgatgcccgccccacgaggccacaggcgcactgggagcgcaccgaggcgctcacccacgcctacatctcctcgaccgcgcggaccccgatcaaggcgagcgtccgcgccagcacctgaccggtgaggtccgcaagtgcaaacctggccccgcgtaccagtgggtcgggctcgaccaggatcgggcagtcgtggtagaagccgtggaacgccgaggccgcctccagcagccaggcgacgacgcgatgcggcgcacgttcgacgatcgcggtctcgagcacacggttgaggcgcaagagcacacgagccagctcgagctcgcgagggtggccgagggcagtgagcgatgcggcggggtcgagagcgagacccatggctgccgcctgtcgacggagcgccgcgaccctcgcatgggcgtactggatgtagtacaccgggttctcgctcgactcggcccgagccttgacgagatcgacctgcgaggcacggtcgatcgacgacgacagcgcgagcaagcgggtcgcatccgccccgagttccttcacgagccatgagagcgcgatcgccgttcccgcacgcttcgagaacttcacggcagcaccgttgtcgaggagcgacaccatctgcccgagccgaatctcgagacgccggtcgtcgatcccgagggcgcgcatcgctgcatgcaggctcgccacctgcccgtggtggtcggcgccgaacacatcgatcgcgaggtcgaatccccgcacgaccagtttgtcgtagtggtaggcgatgtcgcccgcgaggtaggtgtagtcaccgttcgccttgcgcagcacgcgatcacgcgtatcgccgaagcgttcggccgcaaaccagagtgcaccgtcggcctcgtaggtcgcgtcgagagcactcaggcgtgcgacgacctcctcgacgagtccgccaccttcgatcgctgcctgggagtaccacgaatcgaagtggatgttgagctcttcgagggtggctcggatcatggcgaggatctcgggcacagcccagctgcccgccgcgaccacgtcgtcggggccgtcgtagcggcccgagagctcgtggacgtagtcgccgcggtagccctcttcggggatgggctcccctcggcgtgccgcgaggatcgaggcaccgagcgagcggatctggccgccagtgtcgttcacgtagtactcacgcgaaacctcgaaccctccgtgggccaacaagcgtgcaagggcgtcgccgtagatgctgagccaaccgttgccgatgtggagaggaccggtcggattcgccgagacgaactcgacgagcgcccgtgcaccgtgaccgacgtcgacagcgagcgcggccgcaagatcggccgccatcgcctgcacgtcgccgagcagggccgctgggctgagatggatgttcacgaaaccagggccagcgacctcgagacgctcgacacggccagcgacacgcggttcgagacgcgcaacgagtgcctcggcgagcacacgaggtgcgaccccgaccgtgcgcgccagctcgagcgcgataggcgtcgccaagtcgccgtgcgcgcgctcgcgcggctcgacgagtgggccgacctcgaccgcatcagcgatgccgcgagcgcgaagctcctcgtgcaccgccgtcaccagaacctcgtggagccaacccgcggtggtcacctacgtcctttacgctgccaggggcgcttgcccggggatactgccgagccagcctaccggcccgcggcatcggaaccacgaggtcgcccgacgagtacactcgaagcgtcgcagcgtgtggcccccgtagctcaggggatagagcaccggcctccggagccgggtgcgcaggttcgaatcctgccgggggcaccagagcgtcgcgcgtcgacgagcctggtgcctgagcctggcgacttgagcacccgtcgacgacgcgtggttccgacgagggcacgtcccagtgggctcgcatccggtgggctcggtccccgatcgagcgaggccggtactccgttgctaccgagccagcttcgcgaggatcgcctcacgtgcggcctcgcgatcgtccaaccggtagaccgtctggcccacccggaaggtctgctcgtggccgcgccccacgatgagcacgacgtcggactcctcggcgatctcgatcgcgtggccgatcgctccacgccgatcgagttccacgatgatctgcttgtggtccacgtcgagcgtgcctgcgagcagctgcgccacgatctcacctgggtcttcgtcgccaggattgtcggccgtcaagatggcgacgtcggcggtcgctgcggcccgtcccagctcgggacgcttcaggcggtcacgtcggccccgagcccccgcaaccagaatcactcgtcccttcggggagagcgctcgtgcggtcgcaatgagcgctcgcagcgaatccggcgtgtgcgcgtagtcgaccacgaccgtgaacggttgtcccgcgtcgatccgctggaagcgccccgcgacctgatgacactcggccagcccccgctcgatcgtgtcgccctcgatcccgagcgcttctgcgaccgccaccgccgctgccgcgttgtaggcgttgtgaatgccgtagatgggcacacgcagacgccagcgacgccggccgccgacgaccacggtgaagatcgtcccgtactcgtcgtagcgcacgtcctcgacgcgatagtccgaaaacggggctggcccgtaggtcaccgcagggatgcgaacctgggtcgcgagccgcacgccccactcggtgtcggtgccgatcaccgcctgcttggttcgctcgggtaggaagagctgggccttggccgcgtagtactgctcgatggtgccgtgatagtcaaggtgctcgggcgagaggttggtgaagaccccgattcgaaagctcgtgccgtcgatacggtgctggtcgattccgtgcgacgacacctccatcacgacggagtcgactccgtcgtcgaccatctgccggagcaagcgatgcagctcgggcgcctcgggcgtggtgaacatcgacggacggttggagtccccgaagcgcgcctcgatggtgccgatgagtccagttcggcggccggcaaggctcaagatggagtcgatgaagtacgaggtcgtcgtcttgccattggtgccggtgatgccgacgagatcgagccgctccgatggacggccgaagaaccccgcgacgagcccgccgatcgcgtgccgcaccgacggaaccacgagttgcgggatgtcgagtgccacctcgtgctgcacgagcagcgcgacggcgccacgcgcgatcgcatcgctgacgaagtcatgaccatcgaaacgcgatccccgcgtcgcacagaacatcgctccaggcgagaccgaccgtgaatccagcgtgatgtcggcgatcgccaccgaggggtcgcccaccagacgagcgcttggcacgagtccatgcagatcacgcagcgtcagcacaacggcccttgcctcttcctctctgggttcttcagctaggctagcgctccccatggagcgatcaacggccccctctcccacctcgcacccagcgatcaccgtgagcgtcgtcatcgccgcctacaacgccgcggccacgatcaccgacgcgctcgagagcgtgcaccgccagcagtatcccccgatcgagatcatcgtcgtcgacgatggctcgaccgacgacaccatcgcggtcgtcgagcgcagcggccttacgagcgccatcatccgtcaagccaatcaaggcccgtcgcgtgctcgcaacgccggggtccgcgcagcccacggagactggatcgcgttcctcgacgccgacgacgtgtggcatccagccaagctcgccgagcaggtcgcggtcgtcgagcgccacggcgacgcagcgatcgtcgccaccgattgggcgcgggccctcgaccagctcggggtgcctgccgcgagccacctggagtggttcggctaccgcgacctcgtcgtcttgaatcgctttcagacctccaccgtcctcatgcgacgcgctgtgctcgatgcgatcggaggattcgacgcctcgctcgacggcgtcgaagattgggactgctggttacgcggtgcactccacggcccggtggcactccttcacgccccgctcgtcctctaccgcgacagtccgggtggcgtctcgaaggatctccgacgcctgcgcgcaggagcgatcgccgtcatggagcgcgagcgccagcgcggggtgctccatcccgacgacgcacaggaccttctcgcatggcacctcgaacggctcttcgtcgccgaggtcctggttcgcgattggcccggtgcgctcgacgcgctgaaggacgtcctgctcgctccgccccacgctcaccttcgcgctgcgaggggcctcctcggaccgttcctcctcgaacgactcaaccggcggcgcggtcgcgccgcggcgtgatgacgtggtgccacaaccagagtccgagcgccaccaccacgatcgccgccagcacagccgtactggtcaggcttgccgaggtgaggaccgagctgtagttccttccagccacgtaaccgagacccgtgtagagcgctgcccacccgacgccacctaccacgttggccggcagaaagcgacgacgatagggcatctcggccatgcccgcgatgcccggcaccagcacacgaaggacggtcgtgaagcgaccgacgacgacgccgagtgctcccctgcgttggacgaatccaaccgctcggtcacgttgtcgcttcgagagcaggcgctccgggaccttggcaaggagcggctcgccgaaacggcgccccacccagaacccgaccgagtcaccgacgatggcccccagcgcagccagtgatcctgactcccacaccgggaaccggtgctccgcagcgagcaccccgccgagcaccaccgacgtctcgccagggaagatgaacccgagaaagatcgacgactcgagagctggaaagccaaagaccaggaccaagaccagccatgtcggaaccgacagcaaaagccgaatgaataccgccacgccacgcgctccccgagtaggctagatcgggagactaaggagtccgatggtactcgcagacgtgctcggtccgttcgacctgatcgtcgtgttgatcgtagcgctcctcatcttcggcggttcgaagctcccgaaggtcgcacgctcactcggaacagcgacccaagagttcaagcgcggcgcccaggaaggtccgaagcgcacgacgtcggagcccccttcgccagagagtccctccagcgacgacgcaagctcctagcgcggcacgccccaccgcgctgtcgcaccaccatcggtgatgcgtaatcgcctgtgacaggtgtgggtgatgcgaatcggtgctgcgtgacgtcacctcgcacccgtgagcgcgaaggctcgtcggcaccaagacgaggaaccaaagaccggctcagtgccacctgccccggggacggctgcgacgctcggcccgactatcggtacgaccgtgcgagcgctcacgcacgagtctcttcatcgcgcgctccgggcatcgcggctcccgcgcgaagctcccgtcgacacgattcactccggcaccacatgctggcggcgctgcgcgtacgcacggacggagagcgtccggcccgagcacccagctcaccctggttcgatggctcgtgcggacgcacaggcatctgctcgctcgcccaggagtgtccacacggccgagagactctctagggtggcgttctaggaggtggcgatgcgagcagcgttctaccgtcgctttgggtcactcgacgacctcgaggtcggtgagctcgacgaacccaagctcgggcccgactgggtccgcgttcgcgttgaggccgcggccgtcaatcccgtcgattggaagattctcctcggtcgcctagccccgatgatctatgccacgtttccagtcgtacccggttgggatgtcgcgggcacggtcgaggaggtcggacctgccgtcacgcgctttgcacccggcgacccggtcttcggctatgcccgcctcgacttcgtgcacgtcggcacgttcgccgagatcacctgcgtccccgagcgagtcctagcacgccgcgacggcatcgacgcggccaccgcagccgcgatccccctggccggcctcacggcctaccaggccctgaccgaacgactcacagtcgcagcaggcgaacgtctcctggtggcagccggagccggaggcgtgggaagcttcgcaatccagatcgcgcggatcctcggtgctgacgtcctcgcgacggggtcggccgcgagcgccacggcgatcagcgacctcggtgccgagccgatcgatcgcaccgtcgcgctcgcggaggctctcggtgggcggcggatcgacaaggcactcgatctcgtcggtgcagactggtcccgcgaggcgcttgcgatcctcgccgatccttcgcgtctcgcctcggtcgccgacccgagcgtgcgggccctgggagggcactacgtcttcgttcgaccagaccccgacggcctcgacacgctcgccggatgggttcgagagggacgtctcactgttccgatcgccgaacgattcgagctccgcgacgtgcgccaggccttcgagctctccatggggggccacacccgaggcaagatcgtgatcgacgtcgacgcatgaccgtcctgctcgacccgtccgacgtgaccgctcggctgacgcctgccattgccatcgaaggggtgcgcgacgcgctccgggccgcagctcggggcgaacttgccgcccctgcgcgcacagtcgttggcgtgggagacggcgcactcgtcttcacgatcggagcagcgccgtacggctatggctttcgggtctacgatcggttcggctcgacctcggtcgacgaccagctcgtcgcgctctggtcgcgagacggccgactcacggcggttgcccacgggcccgagctcggccgccggcgcaccggagcgatcggcgcgatcgccatcgacgcgttgcgtccaccgggcccgctcaccgtcggcatcgtgggtgcgggacagcaagcgtggcaccagatctgggcccttcgcgcgttgcgccagatccacgaagtgcgtatctttcgccgcaacgcggccgcgcgagccgaatggctcgagcgcttccgccgcctcgtcgaccacgtcgccgaagccgagacagcagaagacgcggcggtcgaggtcgacgtggtgatcttggcgactccctcgacccagccagtggtggatccgagcgcggtgcccaaggacgccctcgtcagctccctggggcccaaggacatcggagcctcggagctgcccgcgctcctcgtcgatcgtgcacgcatgatcgtcacggacgcaccagcccaactcggcccatcctcggttgcgaccgatcgcgcgctcacgccactctggtcgctcatcgaggatcctccgcgcaggcgcgaaggatccgtcttcctttcggcggggctcggagggaccgaggtcgccgtcctcgcgcgcgctctcgacgctcgcgccggctgacttttcggccacccaacccgcccacggcgcacctccgtgcgaccgggagggagggagcgacgacagaacaacgacccttggcgcgccgccccactccggccattacgggctcggtaccttctcgcgacctcagcgcgaccgcgccgagccaaccgcacccggagccctaccatgccctcgatcgatggtcggccacctcccgcgaccctgctccgagacgagggagcggcggggctcgtgtgccccgccgctccaagccacactgcccgccgcgctactcgcgcgtacgggccatcccggcgttctccggctccgaccaggaggcgcgcttcgactcttgggtcgccccgtacgctgcaccgagcacgaagccgatcccgatcatcaccaaccagactccgtacacgaagcccagcgcgaccaaccagacgccagcgcccagtacgaacgggaagatcgtgtgctcggggaactgtccgatcacgccggagatgtcagctggctccacgacggacacgtcctcggggcgcggcttcatccgcctggaccaccagccgatgtagagacctggcaacagcccaagtccggccgaggccagcagcagcacggaaccggtcgactcgtggctccagaagaagtacacgagcaagatgacgacgaagaacgaacctaccccgaggtagacccgcgactcattccgcactctcgtcacctcccgtcacgaccggcactgcatcagagtgctccgggtggttcatgtcccacaccgggcgcgtcgagcgcaccggcggcagcgaatggaagttgtgcgctggcggcggcgacgaggtcgcccactcgagcgtatgaccatcccacgggttgtcaccggccggtaccgggtgacgccacgaccagtagaggttgacgatcagcatcgccatgccgataccgaggacgtacgcacccaccgtcgacacacggttcaagaatgtgaagttgggggagtacacgcccacccaccgcggcatcccgcgaaggccaagcaggtattgaggcatgtaggtgatccagaagccgatgaagctgatccagaagtgcgccttgccgatcccctcgtgcaagagccgcccggtgaacttgggataccagtagtagaaccccgccaacatcgcgaacaccgtcgtcccgatgagcacctggtggaagtgtgcgaccacgaagtaggtgtcgtgcgtgtagaagtcgatcggaggcgacgccaacatgacgccggtgatgccccccatgacgaacgccgcgatgaatcccaccgcaaagagcatcgaggtgttgaacttcacctgcccaccccacatcgtcgcgatccacgtgaagaccttgatgccggtggggaccgcgatcagcagcgagagtgccgagaagaacggcaacaggaccgtgcccgtggtgaacatgtggtgagcccacaccccggtcgacagacccgcgatcgcaagggtagcgaagaccatccccttgtagccgaagatcggcttgcgcgagaacaccgggaccacctctgagatcatgccgaagaacggcagggcgaggatgtagacctcggggtgcccgaagaaccagaacaggttctgccacatgacgggcacaccaccgccggacacggtgaagaagtgcgccccgaagtgtcgatccgcgtacagcatcacgagcgccgccgtcaagacagggaaggcgatcaggatcaggatccccgtgatgagcatcgaccagacaaagagcggcatgcgaaacatggtcatgccaggcgcacgcagatagaagatggtggtcaccaggttcaccgcgctgaagatgcccgagaagcccaccatcgcaacggatgcgatccacaggtcagccccgggtcccggcgagtaggtcgccgtcgacagtggggtgtagccggtccaaccaaaggcggccgcaccactcgccgtcaagaacccgaacagcatggtggtgcccccgaacaggtagaaccagtacgagaggctgttcaaccgcgggaaggccatgtccggagcgccgatcatgatcggcaccaggtagttggcgaacccagcgaacgcgatcgggcccgcaaacagatagagcatgatcgacccatggatggtgaccagagcgttgtacgtctggagcgacacgacatggccgttcgggttgaacagctgcgtgcgcatgagttcagccatcaatcccgcgatgaagaagaacaccagcgcggtgtacatgtagttcttgccgatcaccttgtgatcgacggaggtgacccaccggtagaacccccccggctcccgatgttccccctgctccaccggctgctctgctccgaggagcagctccggctcgtgcagcgtcgtcatgcgctggccctcccttgctgctgatgaatccaggtcatgaactggctcgcggacacgaccttcacgtagaagagcatgtcagcgtggtacaagccgcacaggtgcgagcaacggcccacgaaactcgcatcgtgctgcggggtgaaatcgaagtagttgacgacaccagggagcgcgtaccgcgagaagtcgaagttcggaaggtcgaacccgtgcacgacgtcgttcgacaccagccggaacgtcgacgtctcgccgacgggcagcaccaacgtcgggtatcccgtcggcccctgggtgatctcggtgacgtggtagctcggatagacgaacttccagccccactggaacgccgtcacatcgacgcgcagcgccggtttcttcgcgacagcatcgaccttgttctccactcgaaccgtgaagaagaacagcaccgcgacgatcaggatcggcaccgcggtgtagaagatctcgagcggcgtgttgccgtggacctgcttcggaatcgcgtcgccccggcggcgaaaccggatgatcgcgtagatgagcaaggcaaacgtgatgccgcccacgaagatcgaagcgacgaagaacccctgccagaggtggaacgtcgcgttcccttgaactgtgttccccgtgtaggccccaaacgtcggtagcttgcaggccgcaagcaccgtcccagcagcagccacgaccgcaggtccgcggagtcgtcgacgccaccgtcgacgattggtgatgctccgcctcgacatctcagtcacgtggaacctccagaatccccggtcgcccatgaccattgccgttaccgctgcccgccgattcggactcgtcgtcctcgtgtgcatgtccgttcgactgcggctgcgtcgccgccatcgcctgctcctcagggagcgtctcgaacgcttcttcatgaccgttgtgcacctggagctcgacgaaggcgaacgcaccatcgtcggtacgacggatctcgaccggaaccttcggctcaccaatgtgctccttgtgcccgacctcgcgcgtcagcaggtacgtcgcggtaccggcgagcaccggcatcgcgatcaagagcacgcgcatcgtccacagcaccaagttgagcgaggtatcgaagaagttcgcgagcacgtcggtcgcactggcgaagaagagcacgatgtagaacatcagcacgcccacaccgatggaggtccgcaccgggtgctcacgcggacgatcgcagatgttgtgctcctcgttgtctcgcgtgaaccgacgctcaatggccggccaggcgtacaagagcccaaaggtgatgccaggcaagagcaccgccgggaagaacacgttcgggatcatgtgtccgccataggttgggccgaagaccacctcccagctcggcatcagccgcagcgcgccgtccaaccagcccatgtaccagtctggctgcaccgcatagctcaccttgtaggggatgtaagggccatacagccagatcgggttgatctgcaccagaccaccgagcgccgcgagcaccgccgccgtgatgaagaagaaaccaccggcctgcagtgcgtacgctggccagaacgcgatgccgaccacgttgcgattggttcggccccgccctgggtactgcgtgtgcttctggtgccacatgatcgcaaggtgcgctccgatcaagcccgcgatcgcagccggaaggatcagcacgtggatgatgaagaagcgcgggatgatcgcggttcccggatagttcccaccgaagacgaagaaggcgagatagctcccgaccaccgggatcgagagcaggatcgagaacgcgatgcggatgcccgtgccggagatcaggtcatcgggcagcgagtagccgatgaacccgttgatgatcgacagcacgagcagggtcaatccgatggtccagttgatctcgcgtggcttgcggtaggccccggtgaagaagatgcgcaacaggtgcacgacgatggccgcgatgaagacatcagccgcccagtggtggatctggcgcatgacgaggcccgcgcggacgttgaacgagatgttcagcgtcgacgcgtaggcctctgacatccgctggccgcgcagcggagcgtacgagccgtggtagatcacctgctgggtggacgggacgtagaacagggtgaggaacacgcccgtgaagatcaggactacgaacgagtagagggcgatctcccccagcatgaacgaccagtgatccggaaagatcttgttcagcgagttgcggacgaaccgtgccgagccaaagcggtcgtcgatctcgtccgccgcttgcagcgctcgttcctccaacgtactcatgcgccacgctcccagaacccaggaccgacgggctcgtcgaacccggcctgcgcccgaaggacaccctcgctgtcgatgtagagcggcagctgtgggaggggtcgcggcgcgggcccgaagacgttggtagccccggtcaagacgtcgaacaagctctggtggcacggacagaggagctgctgggtgagttcctggtagagacccaccgggcaccctgcgtgcgtgcacaccttcgagaacgcgagatacccctgtggcccccacgtctcacggcccggccgcgtgacgaggtcggttgtcgctggacgaaccagcacaacctgatcgatcgcgttcatcggggagttctcccaaccctcggggaacaccgtcagcatcccgccgacctcgaggtcgttcaccgtgacgacacgaccactggccgtcacaagccgtgaacctgccttccagtcggtgaggaacagggacttcccggggacggggccgagagagcgaaggaacgggaagaggttgatcaacccgaaggctccaaccgacgcaccgagcagcctcaacaagaacgagcgtcgctgcacctggttgagtcctcggctcagcgatgcatgcatcgcctcgcgctcgacgtcgtccgagcgaagctcgtgacgctcctgcacgtagggaccctggggcacgaggtacttgccccacgcgacgataccaacgccgatgccaccgagcgccacgaacagcaacgcgccttcgacctgtggctgtccaccgagccagtaggtcacgcccaagccgatagtggcgagcaccgacaagctgaacgagatggcgatcagccgctcgacgaacggccgacgctctggcgtctcctctgtcgaggaggttggaccagtcctcgagacggtcatcgaggagccctcccgccgatccaatagccagcgaccatcaaccctcccaaaccgaacacgatcgcaacgagtccctccgtgaccggcccgacatgaccaagacccgcgccgccgcgatcattcggcgcgtggaggtactcgacgtagcgaaccacgtcggcgacctcctggttcgacagcgtgccggggccgaaccgtggcatgttgccagggccggttcgaatcgcctcggcaacttgcgtcggggtggccggatagagcgacggggcgaacacgttgttcgcgagggcatcgcccacacccgtgatcgtgtgacaggcggcacaatcctccgagaagaggaactcacctcgggatatgttggccgccttcagattgacgctcggaatgccaggaccccccggcgccaacgacacgatgtacgaggcgatcgcctcggcctgctggttggtgaggcggggcggcttctcgatcgcctgcgtcgtcggatcggcgagcggcatgcggccggtcgtgatccagaagtccaccgtggcggctccgaggccctgcaagttcggcgcacgcgtcgacccttgcgcgtccacaccgtggcacgtctcacagtcctcagcgaagagcgcttgcccctcgggaatcagacgcttcggagggttcacgtacacgatcggtgaaccacccgacgagccgccggagttcggtgcctgcgccagtgccgtcgacggggccgccaccatggccacggcagcgagcgtgccaaggccggcgacaccagcgatcgccgacagcacgcgcggtcgtcgcagcgaacccttgctcaaccaacccaccgagttcactcccttcctcggacgcacctagtgcaccaggaacaggcacgcaaagagcgcgacccacaccacatcgacgaagtgccagtagtacgacagcgcctggaacccagggagatgtcgacgtccccccttgacgcctcgcaggcgcagcagcaagaacaacatggcgacgaggcccacgatcacgtgcagtccgtggatccccgacatcacgtagaacagcgacccgtaggcattggtctgcggaccgaaggtcaaggtggcccactccaccgcctggttcgcgatgaaggacccacccatgacgaaggtgagcgccacccaccacatcgccgcacggggccgatcgtgctccgcctcgaacaaggccttctgcatggtgacgctcgacagcagcaagatcgtggtgaagatcgccgactgcaccgtgtcgaggtgcgtgcccgcgggtggccacggcgagccgacgtgtgctcggatcgtgaagtaggcggcgaagaggccactgaagaacatcagctcggatccgagccacaccatcgtgcccacaccgagcaacgacggtttcgagaacctgatcggctcccgccgtggcgcgccagctagcgtcgcctcgaccatgaacgcaccctccagcccactcaagcctcacccatctgcgagtgcctcgtggagccaggagggagccgacgctgctgcacacagcacgacgtgctgcgtcgctcgcgtcaacgcgacgtagatcgaccgctctcccgtcggtcccttcgcaagggccgccgcatcgagcacgactaccgcgtcgaactccatcccccgaatcccaggcacatccgtcactctgatcgtatcgaggtcgccgagtcgagacaaaatcgagccgataccccccactgtgttctcggcgacggaggggtcgaggacgagtgcgacggagtgcacctcgttcgcgagcgtccgcacgcgagcgagcgcgaactcgaccacgttctcgccaagatcgtcgatcagctccacggccccaggggtccgacggagcacgacctcggcaccttggtcatcgccgaggatgcgctcacggaggcgagcgaccgctcgtccgatacgcgcaggcgagcgatagttcacgcgcagctgctcgatcgacacatccttcaggcgcagctgctcgatgacggcgctccacggctggaccccccacggggccagcgactgcgcccggtctccgacgagtgtgatcgatgagcccgacagccgccggcgtatggctcgagcggccatcgggctcacatcttgggcctcgtcgaccacgacgtgtccgaagacccgcccctcgtgggtgccgagcaggctgtcgagctcgtcgagcagcggcacgtcctcgacctcccacacgtgccgagagggatcctcccccggctcgagcgcaaggagagcagcctcgtcggcactcaagacgccacgcgtggccgatgccagcagagctggacgcgcgcgcatgtcatagagcacctcctcggcgctcagacggggccacagccgtgccatcacccgctggaaggcctcgagatggcggatctcctggcgcacttcgcgcacgatgtcctcgtccgagtcatccgggaagcggggaggccaatctgccccaggaccgaacagcgccacgactcggtcgtcaccaccccacgcctccctgatcagcggcccgccttggaggaccgcgtgtgcgagcgcgtcgaggagcgcatcttcgaccgagcgacgccgctggttgtggcccccgcgcacggatcgagtcgcagcgatcgcgcgacgtgagagctcgggcgtcacggtcagcacacgagatccgaacgggatctcgatacgatggcggagcggacgctcacgatcgcgaaccgccctggccagaaccttcaccatgcgcgggcttcctcgcagtgcgcgcgattcgggcgtcgagtccgtatcgccaacaagcgtccccggtcgcagtgatgccaatgaccgcagctcgaccccactctcgccgagcgaaggcaagacgtcgcgcacgtagagcacgaacccaggggtcggtccgaccacgagcagcccctggtgttcgagccgccaccgataggtgtagagcaggtacgccgctcgatgcagcgcgacggcggtcttgccggtgcctggcgagccttccaccaagagcgcgtggccaagaggtcgtcgaatgagttcgtcctggtcggcttggatcgtagcgacgatgtcgaccatctgagctccgcgcggtcgctcgagcgctgcgtagagcgcggtcggtccggcagtcacatcctcgctgccacgccccgacaacacctcgagctcgagccgacgcagctcgccgtgttccaccgcgaggtgccaccgacgctccacgcccatcggcacctgtgccgtcgctcggtagaacggttcggcgaccggagcgcgccagtcgacgacgagtggatcgccgtgctcgtccgacagggagacccgtccaatgtggaaccgctcctcgtcgtcgcggtcgagtcgtccgaagaccaaggcgtggtcaccaagttcgagggcctcgagtcgacgcagcgcattctccacgaagacgtctcgctcgagccgagcctggtgcgtaccaccacgctcctgggcgagcgcctcttcgagcgagcgctcgacccctccccgaaccgcgccaagccgccgataggccagctcgacgaagcgccgctcctcttcgaacgcctcgtcgaccacgcggccccaccctcctagactcgggagcacttcagtctatggcctcacccgtgcactcacctgagccagcgctcctcgcggcgcttgcccgtcggcccggtcaccacgttcccgtttggttcatgcgccaggctggtcgctccctccccgagtaccgcgcagtgcgcggcgtggagtccatcctcacggtcctcgaggatcccgaactggccgcgacgatcaccctgcagcccgtcgagcgctaccacgtcgatgcggccattctgtacagcgacatcatggcaccgctcgccgcagcaggggtcggggtggacatcgtgccgggcctaggtccgacgttcgacccgccgatccgtgcacgcagcgaccttgcacgtctcgaccggttccaccccgaagcgctcgaggccatggcgtcaacggtccggctcgtcaccgccgcctcccccgtgccgctgatcgggttcgccggcggacccttcaccgtggcgagctacctcatcgaaggtcgcccctcgcgtgactacagcgccacaaagcggctgatgctcgccgatgccggcctgttcgccgccctcctcgagcgcctgaccgacatcgctgcggccagtatcgccgtccaagtcgaggcgggcgcaagtgcggtccagatcttcgactcctgggccggagccctgtccggaccagcctttcgggaccacgtcgcccgccacctccggcgcctcgcagccgtcatcggcgagctcggcgttccgtccatctacttctcggtcggcacggcgcacctcgaggccgacatctgcgaactcggcttcgacgccgtcgggatcgactggcgcgttgacctcgaagggttcgcgactcgccacgggagccggctcgcactccaggggaacctcgaccccgcatatgtcttggcccccgtcgatgtcgtcctcgccgaggcacgagcggtcctcaccgcctcggctcccgcgcctggctatgtcttcaatctcggccatggcgtcctgcccgaatccgatcccgacgttctcgcccgcgtcgtcgacctcgtgcacgacgagggcacccggctgcggacgaacgcgctggaggcgacttcgtgaacgtcatcgtcgtcgggggaggcatcagcggacttgcggctgcatgggaggcggcgcgccacggtgcatccgtcatgctcctcgagtcctccgaccggctcgggggcaagctcctgacctcacacgtcggcggctcgctcgtcgaactcggccctgattcgctcctcactcgcacaccgagtgccctcgaactcgtcgactcgctcggactcgacctcgtggctcccacagccagccgagctctgctctggtcgcgaggtgcgcgccgccccatccctccaggcctcgtgctcggcgcaccaccgaacctcgaacgtgcgctcagctcggatctcgtcggtcccatcactcgccttcgcgccgcgtggggtgtgatcgcgcgatcccggcgtggccacgagaccgacgacctcggtcgactcgcagcgtggcgttgggggcgaacctggagcgaacgacacatcgagccactcgtcgggggaatcaacgccaacaccatcgtgggcctgagcgcccgggtgagcgcacccagcatcctctcgatgccgcccagcggcccaccagcaccagccccctcccgaccgacgcgccctgcgttcgtcgccccttctggaggcctctccaccctcgtggacgccgtagcgcaggtcctcgtggacctcggcgtcgatgtgcgctcctccacctcggtcaccgaactcgctccggcccctcacggcaccgccgtcaccacctccgacggcagctcgttcagcgctgatgccgtcgtcctcgctgtaccggccttccgtgcggccgagatccttgcggcctcagcgcccgaagccagcctcctgcttcgcgggattcgctacgcatccgtcagcgtcctggccctctcgatcgcgccgacgctcgcgccgtcgctcaagggcgtcgcgggggtgctcgtcgaccgacgcgagggtctcatgaccaccgccgtctcgctggcgtccgagaagtggccgcactgggcaggggacgacgcgttgctccgcgtgtcggcgggcaacctccacgacgtgcgcccgctcgatcgggacgacgatcgcctgcgcgacgatctcgtcgccgaggccgagggcatcctcgaggcgaccctcgagatccgcgatgcccgactcgcgagatggacgaacgccttccctcacttcgcgccgtggcatctcgatctcgtggagcgaatcgatcgcgaactgcgcgacgcactgggctcgaccgtggcgctcgccggcgcgtggcgtcgcgggagcggcatcccgacgtgcatcgcgagcggacgcgacgctgctcgagcgacgatcagccgagacaactgaccgcgccgtcaggcctccgaccgctcggccaccccggccgcatcaaaggtcgccatctccgcgaggatgcgcgccgcggaccgcaccagcgggatcgccagcgccgcacccgagccctcaccgagacgcaaatccagatcgagcaggggacgcagaccgagatgctcgagtgccgccgttgcgccgggttcgaccgatcgatgcccggcgatcacaaagtcagccgccacgggatcaatccctgccgcgaccagcgtgccagcgagcgagatcaccccatcgaccaccaccgggatccgcacatccatcgcgccgagcactacgccagcgatgactgcgatctcgccaccgccgagctccgccaagacgctcatgggatccgtgggcgggccggatcgtgcgagggaccgctcgatgacctcgatcttgcgagccagttgcgcatcgtcgatgccggttccacgacccgtgaccgcagcgggtggcctgcccgtcagcgccgcgatcaccgcagcgctcggcgtcgtgttgccgatgcccatgtcgccggtggcaaccaggtcgatgccgtaggcgtgcaggctcgacaccagcgcgcggccagcctcgaccagtgcgcgagcgtcatcgagatcgagtgcggcttcttgggcgatgttgcccgtcacgcgccgtcgtgcgacgtcgaggagagctgggtggcgctccagctccgtcgcaacaccagcatccaccaccaccaccgacgcgccgacctcgcgcgccagcacgctgatggcagcgcctccagcgaggaagttcgcgaccatctgcgccgtgacgtccctcggccagggggtcacgccctcgtcgacgacgccatgatcgcacgccgcgacgacgatagcaggacggcgcggcaccggcggggggtcgaccccagcgatgccggcaagctgggcgccgaggtcttcgagcacgccgagtgagcctgccggcttggtcagacgaaggtgatgcgccctcgccgcagcctcagcgcgttcgtcgcgccccttggctgcggatcgcgtggcgtccaccccacgatcggtcggcgcgcgcatcaagcgacagggtccgggacccggggagtcccaaacatgaaccggctgaagatcacgtacttgccgacccacacgacgccgaaggcgacgagtgatgcgaggttgatgagcacggcatcggtcaggtgaccaacgtgggccgccgaggcgcgagcctgcgtccacgcgacggtctcgatcgaaacccacagcccgatgaaggccagtgcccagaacgggatgacctccttcaggaggtgtgagcgtcccgacttgccccaagcccagcgacggttgaggtagtacgaagggatggccgcaacggccgtcgcgaccacgttggaggtcacggcggaaaacacgcgcatcacaccaaagagcaagaacaggatcgcctgagtaatcagcacggaaatgaccgaggtcacggcgtacttgaccgacgccggaccaaaccgagcggtgatcgcgtcattgaggtggagtacgagggagcgcacgcggctagcctaccatcgagtagcccgtcgtcggcgacgcgtgatcgtacatcgatcgcatcgaagggatcgttcatgagcgaggctttggaagcggtccttgacctgctcgatctcgagccgatcgaggtcaatatctttcgtggacagagcccgaaggaggaccgacagcgcgtcttcggcggtcaggttgctgcacaggcactcgtcgcggctggtcgcacagtcgagcgtgatcgaagggtccattccctccacgcctatttcattcggcccggagatccgaacacaccgatcctctacgaggtcgagcgcattcgcgatggtgggagcttctcgacacgccgagccatcgccatccagcacggtcgtgccatcttcgccctttccgcgtcgttccaggtccccgaagagggcctcgagcaccagctctcgatgccagaggtacctgatcccagcgccgtcgggacgctggagcagcagctcgagccgtggtcctcgcaggtacgggaatggctcgaccggccgcggcccttcgacattcgcttcgtcacgttgccgccactcgcccgagccgaggggtcccgcgagccagtccaacggatctggctccgtgccgacgggaacgtccccgacgaccccttgctgcacgcgtgcctgttcgcctacgcctccgacatgacgctgctcgataccgccctcatcccgcacgggttgacctggttcgacggcaccatcttcggtgcctcgctcgaccacgcgatgtggtttcatcgcgagggccgcgccgaccagtggttcctctacgacaccgtgagccctacctcccagcagggccgaggattggccgaaggcgccatgtacgaccaagccggccggcggctccttaccgtcatacaagaggggctgatccgtcgggtgcgctgaagcggtctgccgcgcgcacccgacgccgatgtcagcgctgctcgaccggaacgtagtcgcgcttcggagcgccgatgtagcgctggcgagggcgcacgatcttggcgtcttgatcgagcagttcgttccagtgtgcaagccaccccgacatacgagggatcgcaaacagcaccgggaacatctccacggggaaacccatggcttggtagatcaggcccgagtagaagtccacgttcggatagagcttgcgcgagatgaagtactcatcggagagcgcgacctcctcgagcttcagggcgatatcgaggagtgggttcttccccgtgacctcgaacacgtcgtaggcgacttccttgatgatgcgcgcgcgaggatcgtaattcttgtacacccgatgcccgaagccctggaggatgccatggccacgcttgatggattcgacgaacgcgggcacattgtcgatcgagccgatctccgtcagcatgcgtacgacggcctcgttggcgccgccatgccgcggaccatagagcgccgcgcaggccgctgccgcggatgagtaggggtcagagtgcgctgagcccgtgacgcgcatcgccgtggtcgagcagttctgctcgtggtcggcgtggaggatgaacagcacgtcgatcgctcgaatgagacgcggatctgcctcgtagcgaggctcggcgatcttccacatcatcgacaggaagttcgccgggaacgacagcgagttgtccggatagacgaacggcatcccttgcgagaatcgataggcagccgcagcgagggttggcatcttggcgatcagacgaatgatctgtcgatgtctggcatcgggatcgaagatgtccttggcgtccaggtagaacgtcgagagcgcggcgaccgccgagaccaagatgcccatggggtgggcgtcgtagtggaatccctcgaggaagcgcttgcgaacgttctcgtggatgaaggtgtggtgcgtgatctcgtcgacccacgtctcgagctcgctcgcggtcggcaattcgccgtggagcagcaggtacgccacctccagataggtcgagcgttcggcgagctgctcgatcggatagccccgatagcgcagaatccccgcctcgccatcgaggtacgtgatcgcgctctcggccatcgcggtcgataccagtgcgggatcgaggaaccagatgcccggcagcgccttgctccaatcggccgccgaaaccgtaccgtccacgatggggatctcgacggacacgccggtgcggttgtccgtgatggtgatcgactcaggcattgcgacccaccttcctactcagtcgaaactgaagggtcggacgccaccgattcggtgacactccgaccccccaaccgataacggtacacagcggtgtcgcgctccacaaacccgaccgaccgatagagcgcatgcgcagccacccgcgtgggccgcgacgtcaggtccacggtggtcgccccggcctcctcggccagtgcgagcgctctggtcacgagcgcgcgtcctaccccgtggccacgtcctcgctcgtcgaccacgacgtcctcgatgatcgcccgcagtccggtcgggatcggtaccagcacgagcgtggtcataccgacgacgtcctcgccagcccacgcaaggaggagacgcgtcgcctctgaggacacgacccgttcgagatcggcctcggtcaacggtgcagccgtggtcgacagctgtcgaacgaggtggttgaccacggcgagcatgccgggctcgacggtggtggcctcgcgaaccacgacggccgatggcgacgcgatcatcgccgccagcctaggagcgccgacgcgatccctcgaaccgcgaggatgaggacgactagcatgggagtcaatggtggagttcgcctggcaccgccgcgttcgtcagcgccgcaggccagcggcgctcatcttggcgttgtccggttggaccgacgctggcgaagctgcgtccaccgcagcgtccacactcgaacgactcgcggggctcgtcccctacgctcacgtcgaccccgacgagctctacgacttcactgcggtgcgtccgctcgtcgagatcgacgagcgtggggtgcacggcatccaatgggggaccctcgtcctccggggcccggctcgccaacgcggtcccgcgatcttctccctggccggaccggagccgcaactgcgatggaaggcgctcgccagccagattgccgaggttgcacaaggactcgcgatccagcacgtggtcacgcttggagcgttgctcgcgggcactccacacacgcgcccagttgcgctcgtgggattctcgactcgtccggaacttgcacgcaagctcgatctgctgccctcgcactacgaaggtccgaccggattcttgagtgttgcccagggcgtgctgcaaagttcgggggtcgacgtgacctcgatctgggcggaagtccctcactacctggcacagtttccggcctatccggcggccctcgcgctggcgcaagccaccaccaccgcgctcgacctggatctcgatcccacgccggagctcgacctcctcatcgcgcggacggcggccgaaatcgaccagtacgtcagcgacgatccagaactcgtctcctacgtcggatcgcttgagcactcctacgagatcgatcaacgaacgcgccgatcggccgagcggatctcctgggaggcacaacagtacctccgtcgtttcaacgcggagtgacgccgtcgacgcgtccgggccgaggcggatcgaagtaggcggcccacgcgcgggtcagcggttcgtctcgatgaaaggcgcgctcgagccacgggagccgcatcagcgcagccacgttctcggggagctcctcacgttcgaaccaccgcaccgcacgcacctcgagcggatgcgcccgaagcgtcccgccgaccggacgacacaagaagatggtcgaatacatcgcgaccctggtgaagccacgccgcaggccgtcgatctgaccgaggatcgcctcgggcacgacctcgatgccggtctcctcgaagacctccttcacgacgacttcggccgcggagtagccgacgtcggcccaacccgtcggatagagccacacacccgagtcggctcgctggatgagcagcatgcggttcgagtcgtcgacgacgaccgccccgaccgcacacttgggcgtgacgtagccggcgacaccctcggcgactcccctgatgagcgcaccgacggtctcgtcctcgggctccccgataggggcttccgcgttgcggagtctcaccacgactcgcaagatctcctcgtagcgctcgcgctcgtacccagaactcgtgaacgcgagtcccgtccgcgcaatgctctcgatctcgaggagcgccacctcgagatcgcgtcgctcaagctccatgagggcacccctctgtccgcgcacggtcactcgtcacatcccatgctacgctcgagccgtggccgcgcaggtgacctgcaagcactacctcgtcaaaacgctcccgagcggagaccgcctcgagcgatgccgagtcgacgccgcgcgcacactgcccttcgactgccctgacggctgcctcttctacgagccgcgtgctcgtatctcgcggctcgggtgggtcgatccgcgaagcggagactagagccacccgctcgatcaccgacgatctccatcaccgacgatccggcagctcgaccgcggctgcgttcgccgtgccccgggcaccgcgcaggacgaaccggcagccccacgcgccagccgcgaggtcgctcagctcagacgtgcgtccttcgacacgacacccagcgactcggccttcgctcgaccccactgcacctgaatcgcggcgaggtctggcgaaatgtcgaccgcgctgcgcggcaggaggccgcggcgctcgagtcgctcgacgttcggtcgctcgacgtgggctcgcaccgactcgagcacgagacgacgcaccaagccgatgggcggctcggcctgctcctcgacgggtgcgccgagcagggcggtcagctcgttcgccacgtgctcctcgagtgcatccagccacgtcaactcacactcgccctcacgcgcgagctcgttgccgaggcgcaccatgaaggccgggagtgcgtcgagcaacgcctcgagataggcagcgctcgcgcgagcaaacggaagagcatcagccttgtggtccatcgcgatcagctctcgaccacgtcgccgaccagctcgacgtcgacaccgacaccgcggagccactcgatcgcctgctccaaattgtcggggttcccttcgagctcacagacgatccagccactgtcgtcttccacgttcgcccgtcgaatgttcgcgatgacaccgtgatccctcgccaacgtggcgatcacgggttcgttgatcagctcgccctcgtaccagagcttcgccttgaaccgagccatcccgcctcctccgaacctaccggacccaccgagtgctgacgcccacgaaggtcggcgagatcgagcgtagtgtacgtgaagccaaggcgcgagccgagctcggtgagctcctcggcgtgcgccaacaccgccgctgcgagcgctcgtggcacctggatccgcgccgtatcgccatggtggcgcacacgtacatcgacgataccgaggcggtgcaacgcggcttcgaaacgctccacctggctcagacgacgaggcgtcaccggcgtccctgtcgggatgcgcgacgcgaggcaggcggcagccggcttgtccgcgagccagtcgacaccgagctccctcgcaaggctacgaatggatgccttgttgacgccgagctccaagaacggcgcgcgcaccccagcctcctcggcagcgagcatgcctgggcgccagtcgccgagatcgtccacgtgcgcacccgtcaccatgacggcacggcgctcctcggctaccggcccagccgctcggaacaggtgggtcttacagacgtagcaccgcatccggtcgttgcgaacgtaggcggggtcctcgccctcgtgtgtcgcgacctcgacatgacagatgccgttctccaagaccagccgggcgatggcgtcgcgctcgtcggcggcgagcgaggccgaccggccggtgacggcaacggcttgatcgccaatcgcgcgggtgccggccaccgcgagcactccggagtccacgcctcccgagagcagaaccacgacccgttcctgccgctcgaaccacgccgtcagcgcgcgcagctcagtagaggttcgcaccccgacgagcctaggccgcggacacctaggagccctctgaacaagcccctccctggtggtggctgagcacgcccacccagcccgggaacgagcccagctgacccgttcccatctcgctcctcaccctctcctcctcgcccctcctgtggggcgaggaggagaggacccgagcgcctctcaggtggcaagcacccagccaccacccacccgggtgagccccaggcgaaggagcaccttcaggttccaggtggcacagagcagctcgaagtggagtcggttgcgcacgagccccaggtagcgcagcctcgcgccggagagcttgcgtttgagctgtgcgtggatccgctcgacgttcggtcgggtgcgctgatagtcgagacgaacggcagggtccccaaagtgcgcccgctggctgattgcgtgccaggtggcaggggtgaaggtgaggacccgtcctcgcttcgagcgcgtgcagcgatcccggagcggacagccggtgcagtgcttgacaaaggaagcacgacccttggcggagatgggtactcggtgtccttggggacagctgacccatccctcctcgacgacgaagtcatcgatggtaaagccaccagggaccgccatggcaaggggccgaggcttgatcacctcgtcgtggccacgagcggcgagctcgttggagacctcgctcgtggcataggcgctgtcgccatagaccgtgcgcgggccgtcctcgtcacgaaggagctcgctcgccactgctgcgtccggcacggtgcccttcgtgatggtcgcagcggtgacgatgccactgtctggctcgacggccacgtggcccttgtagccatcgatggcacgggcacgtgacttgtggacgtggcgagcgtcagggtccacggtggagatgaccctgtctgtggctacccgcctcgcgatgcgccagcgaccttccttggcatcgacacactccacgtcttggcccgccacgagcccaaggagaccaagggcttcggtctgtggctcggtgagggatgcgagcttctctgcatgggcgaggtgggcagtggcatcggcgacgagggcactcaccgtgcgcaccactgcctcttcgtcccgatagtcgatggcaggctttgcgcgggtgtagtcgatcgctggtgacagaggaatttcgcgtagttcggggatcagcctgcgtacccggttgatctgggcgacaagttgggtcatggtgtcttgggtggcaaccgcatcggcgagcacggtggagtcgacgacgcgcttcgtcttgcccttgagcacccccgtggcaccgatcacctcggccacgagctcgccgatgagtcttggggtctcggaggtggcgatgcgcctgcgccagtaggtgagcaccgtggggtgaaagcctgggtcctcgagatcaagaccaagggcgtacttccagcggaggttgtagcggacctgctctgtcgcctcggtgtccgagagcccctcgagcacctggagcaccatgaccgcgagcaccctcgaggcggggatggagggtctgccggtcgtggaggggtagagatggcggaagcgctcgtcggggaagagctctctgcggtgctcggcgaggaaggcgtagatggaccctggctcgatgagcgaggagcagaaggcctccgtcgcggtgaggtgtgcctggtctgattcggtgcccagcatgcaaaaagtctagctgagctgggcaaatggcgcttgacaggcggagggaagcgcttcccgtagccgccctacgtggaggagttgttcaggggactcctagggccgagcgaggacctccgctggatcggcgagaaacccgacgtagaagcgaccaaactcgccgtagtaggccgacgcctcgtcgtagcgcaatgtgtagacgacgtccttgatgtcgtccggtcgtttcgcgaacaacgtcacaccccactcccagtcggtgagtccggtggcacccgtcaccagttggatgactcgtcccgagaacttgcgccccgacgccccgtgtccatacatgagccgctcgcgctctgcatacggcagcgcgtaccaattgaaggcgtcgccccgacgcttcgccatggggtagaagcaccagttcggaaagccctctggcggcaacaccgggtagaggcgcggacgcttgcggtcctccggcaagtgctgtgagtactcggagacctccgtgatggagacgaaggaatcgacgagcgtgagccccgctcgcgacaggccggcctgcaggtcacgcaagaccgcaaagtcctggtggagggccatgacggcgacctgcgcatggtgaccgagcagactggccgtcatcacctgtgcccccgcagtctcgcactgcttgagttcgcgcagtgcctcctcggcggcgtaaccgggacctggattggcgaacagatgcagcacgccgaggccggttcgcacctgcgagccgccgacctcgtccgaacccatcacctcagtgctgtcactcatgattggtctccatcatgctcactcgtgagcgcgcgatggcgcatcgcagcctcgcgtcgatcagcgatcgtgccagcgccgagggcgctccctgccggtagcgggaccgtcatgggttgcgactcctggagccgatgcgcccgagccacagcgtcgtggtacgcctcgatctgcgcacgcatggacgggtctgcgtagaccgttccatcgatgagcaacccctgacggcgctccatgatcgcgaggatgtcgtcaccggtgatcgtcttctgagtctcgagagcatgagcgacggcgaggatgtcgtagcggtgctcctcgacgatctgggccacgcgctcgtagagggcctcgagtcgccgctcgacacgatcgccgatgccccctttgcgagggtcgtccgcaggcccgactctccggcgctgcggcccgtagccgccgatgccgaggtcgcgaaccgcatccagctggagaatggtgtcgcccataccccacgacgtgtccatcagggccgcgagcctcgaggcgctgaagagatcgcccgagacgcccgaggtgttgtcgccgccgaagaaggcgcgctcgccagcgagcgatgccagacccaccatgatgtccgcttcgaactcagagcgccaccgggtgaatcgctcctccttgggcaagtaggacacgagtccgaggaagttcgaacccttctcgatggtggcgatgtcgatcaccgaattacgccgcacgacaaccgccgttaccgcatggcacgcctcgtggacggcgacggcgtgccgctcgcgctcgacgtactcgacgtcttcgggcagaccgaaggtcttgatctgcttcgcacggatcatgtccggccactcgatgacctcgcggccctctcggatcgcgataatcagcgcctcgttcaccatgtccttgatggcggctcccgacaagtacggagtcatggtggcgagccggtcgatgtcctcgtccgagagagcgtggtggaccttggccaagtagccctggaacgtcctgatgcgaccctccttggacggatagcccaccttgtagatgcggtcgatccgaccggggcggagcagcgcctcgtcgagcacgtctggaaggttggttgcgaggatggtgagaatccggtacttcggcggttcctttggcttgagcccgagcgcgcgccgaacgaccctgttccagaacccacgtggcttctgcaagcccgacagctccgtcagaagggcttggagcgtcccgtccatgccgccaaaccccggcactacgtagcgccagaccgatcggccttgcgcgcgaggctccggcgcactcgcacgagcacgacgaagttcctcctcgaagagcacctgctgggtcgccggatcgaagtaggtgccaccatggcacgtgggcgcatcaccgaggatcggcgaacccgcgaagcggaatctgccatcggcaccagcgatggcgcctcgcgaaccaagcgagtccgcctcgtcgaagaaggcgacgaccccgccatagcgcaccgcgagcttgcgcagacgacggaagatcgacttgaccttcaaaataccgaccccgatgaacatgttcgcgaaggcaccgggctcgacgaagacgaacggcacttgggtctcgccggcgaccgcctcggcgatcagggtcttgccggtgccaggcgggccccacagcaagataccggtcgggacgtagccacccttctcctcgatgcgctcgggatcggtcaggaagatcaggttctccttgatccggtcgagtaccgcgtcttggccccagacgtcgctaaagcgcgtcttgacgtcgccagggaagtagacctcgtagccgcccttggagagataccaaaagatcgcgacgaaggagccaaccccgatgagcagatagaccccgatctcgatgatcgtcgggagcgagttcatcaccatgcccggcacgacgaacagcgcgaacaggggcgagacgtggtagtgggctgccagcacgaccgacaccagcgcaaggagaacgatgatcttcgcagctcgcgcgatgcgatagcgcgtccaatcgtcgcggccgtggccgaggcgctggatcggtcggacgacggcttcttcccacgcctggttccaggacgacgagcgctccaacgccagcacgttcacctggcgcaccacctcgaggaccacgagtacggtgagccaccaatcgctctgaagggtgctcgcaagcgcgacgcccaccggttcgagcggattcgcgttcgtctttgtcgccgtcacccaggcgatgagcaccgcgaggacgacgaggaacttcaagcggtcccacagcgactgcggaggtcggcagcccggccgcgcagcatgccgcctggccccggtggactcggtcatggtgttgcctccactccaaaggaacgaatgattgagtcgatcacacctgcattgcgtgcaaagcacgcgacgtcacatcccaccccgaggacataggcccacgtcgtcgagggattcacctcggcgatctgctcgagttcgatcggcgagctcgtaccgacgcgctcttccacggtcatctcagaaccccggaacccgcccttgcgcacgaacgtctggtaggccttgaccgagaagtggtcgatcgacgacgacggattgaagggatcctgctggaggatcagcgtgcgcaaggtcgccaacgagaacgaatcctgctcggcggaggtcaacgcctgcgccttcacgattccgaatgggaacccctcgctgaagccgttcgagaccgcagacaggccagcgacgtgcttgccaacgatgatgttgccccagagactctgctcgacctgtcgaagcgtcgtcgaactcgcacgaggatcggccgaccggaagacctgctggaccgtaaagcgctgccaacccgaaggaatcgcgtagtagaccgactcgcctgcagcgtcgccgtgactgacgtacgagagcccgctcgccgagcagctcgcagcgagggcacccaacgtgatcgtggccagggttctgcgcccccatcctcgcgaacgagcgaacgaccacactccaccacgccttcctgagcgaatggatccccccgctcggggaccgagccctcttccatgctaccgccttagcttgtggacaactcaggcgcaccttcacgcgaggtgagagcgcagaagccagcccagctctgccacgtccgaggtttcccgctcggctcctgcgaccacgccggtctcgagcagcacaggccccacaacgcatcaaaggggagcaggcaagcctgctcccctttgactgtgcgtcgcctgccgcatgcgacccggcgacgccgtcgtcccttagaagtcctccatcccggcgccagggttgaccgccggcttgggctccggcttgtcgaccacgaccgcctcggtggtcaggaagagcgccgcaatggacgccgcgttctgcagcgccgaacgggtgaccttcacggcgtcgatgacaccggccgccaccagatcctcgtaggtcccggtcgcagcgttcaagccctcgttggggttggtgagtgccttgactcgctcgaccacgaccccaccttcgaggccggcgttggtcgcgatctgccgcaacggctcctccaccgccttggcgacgatcctcgcaccggtcgcctcgtcaccctcgagcttctctgccttgtcgagcaccgcacgctgggcacgcagcaacgccacgccaccgccgggcacgacaccctcttcgatcgctgccttggtggtcgagacggcgtcctcgatgcggtgcttcttctccttgagctccacctcggtcgcggcgccgaccttgatgatcgcgacgccgccggacagcttggcaagacgctcctgcagcttctcgcggtcgtagtcggagtccgtcgcctcgatctcgttacggatctgctggatccgacccttgatgtcggcgtcgctccccgcgccctcgatgatcgtcgtctcgtccttcgtgacctcgacgcggcgcgcgcgacccaacaggtcgagcgtcgtgttctcgagcttgagcccgacctcctcggagatgacctggccaccggtgaggatcgcgatgtcctgcagcatggccttgcggcgctcaccaaagccaggagccttgaccgcgaccgaccggaaggtgcctcggatcttgttcacgaccagcgtcgcgagcgcctcgccctcgacatcctctgcgatgatgaggagcggcttgcccgcttgcatcaccttctcgagcaccggcaacagctcacgcaccgacgagatcttcgagctgaccagcagaatgtacgggtcgtcgaggatcgcggtcatggcctcggtgtcggtggcgaagtacggcgagatgtagcccttgtcgaagcgcatgccctcgacaaggtcgatctccatcccgaaggtctgggactcctccaccgtgatcacgccgtccttgccgacgcgctcgatcgcctcggagatcatggctccgacctcaggatcggcagcggagatcgcggcgacctgcgcgacctgctcgcgcgtctcggtctccttcgcgatggacttgagcgcgaggactgcgtcggcaacggcctcctcgatgccacgcttgagtgacatcgggttggcacctgccgcaacgttcttcaggccctcgcgaaccatcgcccacgcgagcacagtggccgtggtcgtaccgtcaccagcgacgtcgtcggtcttcttggcgacctccttcacgaggtcggcaccgagcttctcgaacggctcctcgagctcgatctccttcgcgatggagacgccgtcattggtgatcgtgggtgcgccccacttcttgtcgaggacgacgttacggcccttcggtccaagggtcacccgcacggcgtccgcaagcttgttcatgccctgctcgagcttgcgccgagcatcctcgtcgaacgcgatgagcttggccatcgttgcctccctggtctctcgcgagcagcgttttcaccacgtctgtgacggctctctcggccgcccagcatgcgtggttagcactcagctatgccgagtgctaatgatagcacctcgccgctgcttagccgccggcgaccgcaggaacgaccgacaccacatccccgtcgccgacggtggtcgcaagaccatccagaaagcgaatgtcctcgtcgcgaacgaacacgttcacgaagcgccgcggctcaccctcggcgtcgaggatacgctcggcaagctcggggtgctcactcgccaccacagcgagcacctcaccaaccgtctgcgcctcgccgaccgtgagttcgcccgcgccgcccgcaaggctgcgaagctgcgctggaatgcgcacccgtaccgtcactccaacccccatttccctctcgctcccgaccgctagcgcgcctgggctccgagtaacgaccaaaacgcatcgatcgatggacggatcacggtgccggtatcgacggtctgctcgatggcttcgaccgtcttcaggccattgccgctcaggtacgcgaccaccgtctcgtccggtcgaacgatcccctgcgaggccagcttggcgagcgtcgcgaccgtcactccacccgcggtctcgacgaagatgccctccgtgcgcgccacgagcgcgatcgcttcgaggatctcgtcgtcagagaccgcgccgatcgcgccgccggtcgctcgtgcgacatcgaccgcgtaactgccgtcagccgggttgccgatcgcgagcgacttggccaccgtcgatggcctgaccgggcgcaccaacgagcgacccgcctcgaacgcctgcgcaaccggtgagcacccctgcgcctgggcaccggatacccgcacgctcggcggctctggcatgagtccagcgagggccagctcctcgaaacctcgatggatgcgcgtgagctggcttcctgaggccaccggcacgacgacgtgatcggggtagcgccaacccagctgttcaacgacctcgaaaccgagggtcttcgagccctctgagtagaacggccgcaggttgacgttggcaaagccccaatcaccgcgctcggagacgatctctgcgcacagacgattgacgtcgtcgtaggtcccgtcgatcgcgacgatgttcgctccgtacaccgcggtggccaacaccttgacgcgctcgagattcgcgggaatgaagacgtaggcctccatccctgcccgagcagcgtgagccgcaaccgagttggcgaggttgccggtggaggcacacgatgcgacgcgcatgccgaactcacgagccttggagagcgcgacggccaccactcgatccttgaaggatccggtgggattcaccgtgtcgttcttgaggtagagctcccccagaccgagctccgcggccagcctcggggcgggcacgagcggggtgaagccagcaccgaggtcaatacgggcctcgtcgcgctcgatgggaagcagctcgccatagcgccacaaggtcggtggccccgactggatccgctcgcgcgtgacacgtgccgcgatctgctcgtagtcgtaggcgacttcgaggggaccaaaacagaactcacacacgtgggttgggctgatcggataggtccgcccacactcacggcacaccaggttgacaaccgctgacgacatcgtccctcccgccgccatcgctcgggcattggcacctggttcgacgtatcgaactggttgccgcggtatcacagggcccgtccctacaccgctctcgatgattcggcgtcactcatgctagcgactcggtcggcgctctgcgctgctcgcacgcgtgccaatggacgcacacgacctagcgtgaggtcatggctccagcgcgccagtacctcttcgtgacgaatcgagggccgttcgcgatctcgccgtccgggtcgctccacgaggcgggcggtggcctcgctgccggcctgcgaggactgctcgcaacgggtcaagcgcgatccgtcttcgccgtcgacgacggaccagaacgcgagcactggagcgccgtcggcgacgatcgcctcatcccagctgctgtcccggaggaagtgcaccgtagcgcctacgacaccatcgcgaacgagctcctctggtactgcgctcatcagctgttcgacctcgcgttcgagccgatcgacgacgctcactcgcgaagggcgtggtcgcactacgaaacgttcaacgagctcatggccgaagcagcgcacgccgttgccaatgttgacgacgtcatcgtcgtcaacgactaccacctctatctcgtgcctcgggcgctccgagcacgcggctggcaaggcacgctggtcttcttcctacacatccccgtgccgaccgagcaggagtacgcggtcctgccggcagtggttcgtcgggccctcctcgatggcatcgccgaagctgacctcatcgccgtccacgcaccgacgtgggccgagcggctgcgagcactcttcgatgcgagcggactcgtggcgccgccgatcgtggtcgcccccctccccgtcgacgtcgttggattgctcgagcgtgccgcacgtcccgatgtcgccgaagcgggcgagcgcctcgacgcaaccggcggcgcactccccacgatcacgcgcgtcgaccgcatcgagccgtcgaagaacctgctgcgtggcgtcgccgcgatcgaccggatgctggagctccgccccgacctcgcgggccggttccgagccctccacctcgcctacccctcgcgcggcaacctggacaagtaccatcgcctccgttcgtcgctcgtcgacatgatcgacgccgtcaacgaccgctggcggcgttcagggtgggtgccgatcgaggcgcacctcagcgacgacccggcacgatccatcgctgcctaccagcgcttcagggtgctgctcgtcaacccggtgcgcgacggactcaacctcgtcgcacccgaagcgagtctgctcgcccccccagacgcccacatcgtgctctcgcgtagcgcgggtatcgcagagcacatcggagaccatgtgacgctcgtcgacccgttcgacgtcgacgagaccgctcgtgccctcatcgatgcgctcgagcggcccggtgatctcgaaccggtgcgccgctgggttcacagcaattcctgggatcgctggcttgccacgatcaccccgaccgccacggagacgcgatgacaggctggagggacgtcgtcacggctctcgtcagagcgcaccgcccgctggttgcgctcgacttcgatgggaccctcgcctcgatcacggcggatccctcgcgcgccagcatcgctccggatctcctcgacgatctgagcgggctcgcgcgcacgctgcgcatcgcgatcgtgtccggaagacctcgctccttcctcaccgatcagcttggcgaccttgccgtgcggatcgagatcgcctccaactacgggcgcgacgagacggccacgcccgcagatcgcgacctcctcgaccgggtggcgagaggccttgcggacctcgcggccgatggcgcgctcattgaacgcaagccgacgtcggtggccctgcacgttcgggagcatcccgaactcgccgctcgagccgcggtgacggtccagaggttggccgccgcctaccaccttgatcttcaagaagctcgccaggcatacgagctgctcttgccttcatcggcgacgaagggcacggcagtctcgtccctgatcaccgacgacaccgacttcgtgctctacgccggtgacgacgtcggcgacatcgccgccgtcgaagccgtgcgcggtcacggcgggccgtcgtggtgcctcgcgatcgactctggtgagctccctcctgcgctcgcggcgatcagcgacgaggtcatcgatcagcccgaactgcaccgccgtctccactccctccgcgaactcctcgcctcgcgtcacgccgatcatgacggtcctgtcgacgattttgctcaacgaagtcgcgaggccgaccgatagccaccgcagtgatgacccgaggagggccatgatggtctcggttggcacggaggtaggcgccgctccgtcgcgtcgtgccgacatcttgcgcgcaacgtgggagctcctcgccacgaccggagccagccacctcaccatccgccgcgtcgcccagggagcggccgtcgaccccgccctcatctaccactacttcgggtcgaagcgcggcctgctcggagcggctcgcgacatgccagagggcctgagcgacatcctcaaggcccagcgagggccactcgaacggcttcggatcctgcaaaccccaccgtgggcgacgtgggtcagcgccctcgtcgcctcggtcatcgatgatcgagaggacgcgctgcgatcgctgcacgaactcatcgcgagcgtcgacaccaacggcgccctgccgcgccttgcgctcctcggcttcttcgccgatcgcttcttgctgcacgtgtggtcagctggacccgatccggccgcgccgttcgatcatgagctgctgcgctagcgcgcgcgggtcatccgcatcctgaaggtcggcctcgagcggcgatgggacggtgacgagacgagccccgggccacagtgcgctgagacgtgtcgcacttcgatcgacgctggcgacccagccaccagcgagatcccatgctggaccatcggcccgtcgcacgacgaaggggccctccagcgccacgcgccacatccagctcagcgcatcgacggacgcccgaaagagatcaacgggcaccacgacgacgaggtcctgcggtcgcaggtcgagctcctcaagggcggccacgatggcgcgatgcggaccgaacccggcatcagcgacagccgcggctcctgacaccccaggaccgacctcgacgacgcggtacgacgcacgttcgagtgcgtcgcgcaaccactcggcctggatcgcccctccctcgcgggggagacgagccttgtcggtacccatacgccgcgatcggccacccgtgagcaggagcgcgacgcgcaggcgtcgagccggagccgactcctcatgccaccccaccatcctggtaggctaggtccatggacgcagcgacgccgttgatcgatcccttcgggcgggagatcaccgacctccgcgtctccatcaccgaccgctgcaacttccggtgcacctactgcatgccggaagagggtatgcactggctggaccgaggcgaactcctgagtttcgaggagatcactcgcatcgcgcgcgtcatggcgacagccttccggctccagtcggtgcgcatcaccggtggcgagccgacggtacgagcgcaggtaccgtcgctcatcgaacagctcgcgcaggttcgtcgccccgacggcaccggtctcgagctctccatgacgacgaacggcgcgacgttcgcactgctcgcggacgacctcgtctcggccggtctggcgcgcgtgaacatctcgctcgacaccttgcgtcccgagcgcttcgcacagatcacgcgccggacccgcctcgaacgggtcatcgagggcatcgacgcagcaatccgcgtcggtctgtcaccggtgaagctcaacaccgtcgtgatgcgcggcgtcaacgaggacgaactccctgacctggtgcacttcgcggtcgatcgtggcatcgaagtacgcttcatcgagttcatgccgctcgacggggacgggcactggtcgccccgcgacgtcgtctccgaggccgagatgctggagctgctcgccgcgcacttctcgttccaccccctcgcacggtcatcggctccggcgaccacctacgaactcgatgatggatctgggcgcttcggggtcatcccgacggtgacgcacccgttctgcgacgcctgtgaccgcgtgcgcctcagcgccgacggccgcttgcgcacgtgtctgttcgcgctggacgagcacgacctgcgcccgctactgcgcggtggcgcaggcgacgatgcgctcgccgagcgcatcgtcgccatcgtcggcacgaagtgggcaggccatcagatcggtaccgtcaggttccgccggccatcgaagtcgatgagccaaatcggcggttgaatcggatcgctccgtggcgaatatgccacccggcgagtcattcctggcctagagtgtggccatggccgacggcaagctgacccacttggacccgctggggcgggcccgcatggtcgatgtgactccgaaggagcccacgcaccggagagcgctcgctcgctgcaaggtcttcatgaagcccgagaccacggcgctcgtcgccaacaacgccgtgaccaagggtgacgtgctcggcgccgcgcggatcgctggcatccaagcagcgaagcgcaccccggacctcatcccgctgtgccatccactcctcgtcggctccgtgtacatcaacttcacgctcggcgacacctacgtcgaggtcgaagcccaggtcgagaccgtcgaccgcaccggggtcgagatggaggcactcacggcggcgtccgtcgcagcgctgaccatttacgacatgtgcaagtcgtacgaccgcaccatggtggtcggtgacctcgcgctctgggagaaggtcggcggtcgctcaggccactggcgtcgggaggaggccgtcgagctgtgaccatgcgggtgctcgagggaatcttggccatcggctggatcgccatcctcagcgcaccgatcgtcgctcggcgcaacgaccctgacggatttgtctcgctgcgacggtaccgcaaggctcgggtggcactcgcgcgtcgcttcgatggtacggtggcggttgaactcccgattccttcctctccacggggctcgtcccaacagctggtcagacgtcgtcgggtctatctgctgctgggagccgccctcctcgctgggctcatcgcactgcccgtcgatccgctcggagggtttctcacgagcctcgtcgccgcgaccatgttcgttggctacgtacggttgatccgccggcagcggacaccgagtagttcgattcgccagatggtgattcagcccgaaccgagccgctagcatgctcgttcatcggcgaccacgccgatgaaccctcgggggtgtagctcagctggtagagcgctacgttcgcaacgtagaagtcggcggttcgagtccgctcacctccaccgacggtcagcctcacctgctggatctggtgggtccgatcacggtttgcatgacagcacgcgatgggttcaccagcgcgcgggcacgtgctcaacagacccgaccgcgccgagctgttggcacacatcgacgggcgcagcggccgttcgacggcatcgtctcttcgcgctcggctggtgcgtgtgcccacctccgcgagcggcgtctcgcaacgatcggttgaaccgagtgtgcagcgagccggcccgcttcgagcccctgggagtcctcgggatcgggagtgccgggcatacccgcagttcggcacgggctcgccgtggcgtggtcctcaaggaggtagcgatctccttcgtcggccgccccctcgagacatcgatgggggcagggggagcagtctcacccaacattgacatggaggggaactccgagcacagcgggttgcgccgctcgaggctgcctggcgcaacaatccggagcgcttcgtacgcaagccgccggagccgcctgccctaccgaggcacgtcttgatcaatccgccagaggaagtggcagcgccgacacagtgaagtgccgaccaggggtgtccgtcaaggctttgacaggttccggagggcgtacgatgcacgagcccacacgatccccgtgatgccgatcccccgtctgcgaggaatcaacgcatcgtgcgccgataggtaggccacctcggtggagattccccgtcagcgagaacacaacgctgccaccgcattcaggtgagcgctaccggtatggctcagtgctccgatgtgctcgggagccttgacagaacatcgtcgtcggatcgaccaaggagctgtgccagcgctccgagccgctcggggaccaggcggtagtacacccacatcccgcgccgctggcggctgacgatcccggcatcgagcagaaccttcagatggtggctcacggttggctgcgccaggccaagaggagccaccaggtcacacacgcaggcttcacccagaggcgcaccctggagtaggctgatcaattggagccgagcaggatcagccacagccctgagcagggtggcgagtctctgggccgctgcccgatcaagcgtcgggcgcgtcagggttggagtgcagacatcggccgccgtcgactgaccggcatcaggacggaccagcggccgtacggcgttcctcacagccctcatcctacaaccgccctctcggcaccgaagggatccgtcgaccgtggcctggatatattgatgaccatcaatacattacggtgcaaccacgcaggtcgaagaccgaccgccccgttgggcggcgtcaccaacgtgcagcagcactggacgtcaccgacgagcagcagccatcggcacgcgcatcgacctcgaaccgtgccagcgacgaggaccctcggacccaggcacgctcctctgataacccctcggtgtcccttccctccacggcggttggactctcagggagtcacgaactcccgaaggccgcgccgtagtgccactgcgcggaacacccgagcgcgccgacagtccccatcgcggagcgcttcccagtcgtgcagccgaaggcgtatggagctcgcgtgctgagcctccacggacccgccctcatcgtcacggccatcgcgatcttcgtcgcgaccctggccctcgtgatcacgcaacccaagggactgtcgatcggctggtcagcgaccggaggcgcgctgctcgctctcgcgctcggcgtcgtccacctcaccaacgtcgtcacggtttggggaatcgtctggaacgccaccgcgaccttcgtcgcgttgatcgtgatttctatggtgctcgacagagtggggttctttcggtgggccgcactccacgtcctgcgcgcagcccacggcagtgccgtccgtgccttcttctacgtgctcatccttggcgcggtggtcgcagccctctttgcgaacgacggcgcagcgttgatcttgactccgatcgtgtacgagcaagtgcgtgcactcgggttcgggcctcgtcaggcgctcccgttcgtgatggcggcaggcttcatcgccgacacaacgagcctcccgctcatcgtgtcgaacttggtcaacatcgtgagtgccaactacttccacatcggctttgctacctacgccaagacgatggccccagtcgacctcgtggccttcgtcgcgagcaccgcggtcctctacctcttctatcggcggatgctgcctggtcgttacgatccgaacgcgcttgccgctccccacagcgccatcgcggaccacggcctgtttcgggccagctgggtggtgctcggggtcctgctcggcggctacttcctctcggagccgctccacttcgtggtgtcgatccccgccggtcttgcggcgatcttcctcctgctcctcgcctcccgctctgccgcactctcctcggccgccgtgctccgcgaagccccgtggaggatcgtggtgttctcgatcggcatgtacctggtcgtcttcgggctgcgcaacgctggtctgaccactttcctctccgacgccctcagcgcaaccgctcgcgccggactcgtgccagcggcccttgcgagtggcttcggtgctgccgcgttgtctgcggtgatgaacaacttgccgaccgtcctcatcggtgcgctgtcgatcaacggagcacatctcgcaggactcgctcggacggcgtcggtgttcggcaacgtggtcggatcagacctcggcccgaagttcaccccgatcggctccctcgcgacgttgctctggctccacgtcctcgagaccaagggcatcaagatcagctggggccgctacttccgccaaggcatcgtgctcaccgttccggtccttgccatcacgctggcggccctggcagggtgggtcgccattgcgcactgaaacagcgtcagcccgcgatcgatcaaggagccttcgagagcaaggagcaaccatggacccacgacgtcgtctcgaccagccgcagccgacgagtgacccccgaccgatccggtgccgatacccggccgcctttcacggaggagacctcgggccagccgagaggcgcatcggtcatctcggacccggtgccgctcgatgggcgcagaggtcagcatgatgcgccttctgtgcatcggagggagcgacggcgggatctctgccgcgttgcgcgctcgagagctcgacgcctcggccgagatcaccgtcgtgctcgcagacgactacccgaacttcagcatctgtggcatcccgtaccacgtctcgggcgacgtcgccgactggcacgacctggcccaccggacgcgctcagacctcgaagcgctcggtatcaccctgctcacgggacacaccgcccgccgcatcgacgtcgctgggcacacggtcgtcgcaaccgatgccgacggacgcgagatcagcctcggctacgaccgcctcgtcctcgccactggcgcgacgcccctccgcccaccgatcggcggactcgaccagctcggccacggggacggtgtccacgccgtccacgccatggaagaccttcacgcggtcatggcgagtctcgccacccgcgcaccgtcgcgagcggtcatcgtgggggccggctacatcggcctcgagatggccgaggcgctcacaacccgcggcatcgccgtgagcgtgctcgaagcgctcccccacgtcctaccgacgctcgacggacccctgggcgacgtcgtcgccgaggaactcgctacccacggcgtggcggtctacacctccacaacggcgaaggccatcacgacggaaggccgtcggctccgcgtccacgccacgtgggcacccgaggctgagcccagagcgctcgaactcgacgccgaactggtcctcgtcgtcaccggggtcgcccccgacaccgcactcgctcgcgcggccggcctcgagctcaccccgaggggcgcgatccgagtcgaccgaaccatgcgaaccaacgccccagacgtccttgcggccggggactgtgtcgtcacgtaccatgccctcctcggcgagacgtatctcccgctcggcacaacagcccacaagcaggggcgtatcgcgggcgagaacgcccttggcggcgatcgccacttcgccggcagtctcggcacccaggtcgtgaaggtcttcgacctcgtcgcagctcgtacgggcatccgcgacggcgaggccgagcgcgccggttttcgaccgcgcaccgtcgcgtcctctgccgacgatcacaaggcctactatccgggcgccacctccgtccgggttcgcatgacaggcgatctcctgagcgggcgcctcctcggtgtccagatggtcggggcactgaccagcgctgtccacaagcggatcgacaccgcagcagccgcgctcttcgccggcctcagcgtcgatgaactcggcgacctcgacctctcctacaccccgccgctcggcagtccgtgggacgtcctccaggtagccagccagcgctggatcagtgaagcacggcccgtcgacgacgcacactgaggcgtggacggcgcgactcacacaacgagcaggggccgtcgcggcgaactcgcgacggccaggctaaggggtctggcgagcgcgagactgccccatgtcgggtgagctcggggctgattccgccgaccgcgcacctaccagttcacgacccgacatgaagcgcgacacttcgactcgtgcgctagcgcaccccatcccgtcatcgcaccccgccgcgggcactctggtccccaccaggggccaccgaagcacacgagccctccccgggaccaccccgagccccatgggatcggcgcgcagactcctggctcccgactgcgctcgtgagcgtgcggctgcgacctgcacgtcgagcggcgctgtggtagcctgatgcttgccacgggagcccagtcgggctgagagggcggaagagccgccgaccgttggaacctgatccggctcgtaccggcggagggaggcagtatgaacaccattcctgtcgcgtcattgcggcgccgtcacgtcgacgaagcgccaaccgatcacgtcgtacaagctgcacacccgcagcagcgccgcgtggttcgtgaggctccgccactgccccatgacctctctggcgacgacgataccgtcctcgtccccttcttggaggtggcgaccgccgagggtcccgtcatcctgccgacgagcctgcccggtgccccactcggatcagacggcctaccacaggtccgggcacaggtcctccgccatcgctatggcgccaccgtgacccgtacgctgcctggggggccgctgcccaacggtgctcccgcccgtcccacgtacgccgccaaccagatcctgacgcagcggaccctcgcgcgccgcggatttggctcgtgggagctgcgcttcgtggcagcccgagagcaggtcacgctcgagcgcgtgctcgacgacgtcgcgagcgggcgggcggtcgtgccggcaaatcccaaccatccggaactcgaaccgacgatcatcggccggaactaccggaccaaggtgaacgtcaacctcggggcgtcgagcgtacgcgccgacatcgacgaagaactcgccaaggtcgcggtggcgctccagggtggcgccgacaccatcatggacctctccaccgggaccaagctcgcctgggtgcgcgagtggatcctgcgcaacagctcggttccggtgggcaccgtgccgatctacgaagcgctcgatcgcgtcggtggtcggcccgagcggctgagctggtcgctgttcgccgaggtgctcgaggagcaggcgctccagggggtcgactacgtcacggtgcacgccggcctgctccgcgactacgtgccgctcgcggcacgccggaccaccggtatcgtctcgcgcggcggctccctcatggccgcatggagtcagcatcaccaacgcgagaacttcttgttcgagcacttcgatgagctgcttgctatcgccggtcgctacgacctcacgctctcgctcggcgacggcctgcggcccggctccaccgcagatgccaacgacgaagctcagctggccgagctccgcacgctcggcgacctcgcacgacgagctggagaggtcggcgtccaggccatgatcgaagggccaggccacgtcccactccacaagatcgcggagaacgcactgctcgagcaagaactctgcgacgatgcgccgttctacaccctcggacccctcgcgatcgatgttgcggcggggtgggatcacgtctcatcggcgatcggagctgccgtgatcggagcgcacggggcagccatgctgtgctacgtcacgcccaaggagcacctcggcctcccgaacccggaggacgtgcgtgcggggctcatcgcctatcgcatcgccgcgcacgcagccgatctcgccaaggggatcaacggcgcacaggcgtgggacgatgccatgagccgagcccgctacgagtttcgctggaacgaccagtttgccctcgccatcgatcccgcaggagcgcaggcacaccacgacgaaagcctgccagcgcgcgcagccaaggatgccgagttctgctccatgtgtgggccgaacttctgcgcgatggcacactcgcatcgcgcgcttcacgacgcctgacggcaaccgagacagcgctgccgatcgacactcgttcgcgtcgcgatccgatcggcgcaccgcacagcacactcggcgacagtcggccatgcgtcgctgtggtcgatctcagccgagagcactcgcatctcgagccggacctgggtcgacgatggcgtcggaacgaccgacaatgcctcggcgacccggtaggggcatcgaccgagctgggcaccggaacctcggaccagcacgccaccgagacgaccagacgctcggtagcccggctcgggcgcgcctgtgctggtgcgtgagcgggcccgctcgcgacgtcatcgtcgggtgcgcaccagcatgcctgaagtctgcttctcccatcttgctacggtggagccgtgccaaggccacagaggacgtcgagctcccggtcgtcggaggggctcaccacgaatccagaagtgacgtgtcgcccatctcgcagctggtcgcgggggcaccacccctacgctggtctcacagccgtactggccaccaagcacgacaagctcccgctcatcgctcctccactggaagcagcgatcggtttgcaagtcgaagccgtccccgtcgacaccgacgtcctcggcacgttcactggcgatatccctcgccctggacctgcgctcgacaccgccatcgccaaggcgcgccttgggatgagagcagctggccgttccctcggccttgcgtctgagggcagcatcggccccgacccagccctcccgttcgtccatgccgatcgagagatcgtcgtcctcgtggacgacgagcacgggatcgtcgtgtgggagagccatgcgagctgggatatcgtcgccgcctcgacgaccgtccgccccgacgatgacctcgaaccgtttctgcgcgaggcgcacttcccggagcaccaggtcatcgtccgtccgaaccacggagtgctgcatccgatctacaagggcattgcctccctcgaccacctgacttcggccattgcagagtgtgctcgtgctgcgacagacggtttggcccgcgtcgagactgacctgcgggccaacgcgtgtccctcgcgtcggagcgcgatcgcagctgctgctcaacgccttgccgatcggatcgctgctcgctgtccgggctgcggcgcacctgggtgggggcgtgtcgacgtactcgtcggcatcccgtgcgcgtggtgtggcaccgaggtccccacaccacgcgccgagatcgacggctgcgtggcctgcgattgccgccagatgcgtcctctcgtcgcagccgagcatcgagccgacccgagcgaatgtcctgtgtgcaatccgtagtgaagaacgagagacggtagcggtcgtcacacagcgagcacggcggagcgcgtgaacgttggccacctcgcgcaccgacgcctgtccccttgaggacaggatcccagcgtcctcgagacgttcgacaatgctgatcaacgaggcccatggctgcttcgttctccctcaccagagggaacaccgctcgccgcgcgcgtgctcgtagatcgcgcttcgcctccggtcggtcaccaccagtcagcgagctcggtacgacataccgcagacaattgtcgacgccgttcgagaactgaacgatgtcaccggtgaacagtgaacagccgaccatggagggtgatcgctgtggaagactgggcactcgtcaggcggctggtagctgagggcgtccccaaggctcgcatcgccgagcgactggagttctcgcgcacgacggtcgtaaggctggccgcccggagcgagccgccgagctatcggcgagccccgaccgacagatcccttacgagcgtcgaggcccgggcgacggccccgctcttcgcagacgagcgtgacctcagccagttccgaacggatgcagcctcactggtcctcgaccagcgccgcgccatcgctgactgaggtgccccagaagttatagacacccaggttacttcatgcgagccccctccgcgacgaggtgctcgaagacgactggggcaaggtagccgatcttcgagcagctgcgctggtggttgtagaactggatgtagctctgtatgccgcggcgcagctcggcgaggtcgccaaaggcgtggcggtagaagaactcgtgtttgaagatcgaccagaaggactccgcgctcgcgtggtcgtagcaggtgccggttcgccccatggagcgcgtgatgccgtgtcgggcacagaaggccacaactcgatggtcgctgaactgactccctcggtcggtgtgccagatgaccccctgcgcgttggacccacgcaccgcgacggcctggccgagggcctcgagcacgagcgtggtctccatgcgctccgcgacgctccatccgagcacccgccgcgagtgctcgtcgcgcaccacacacaggtatgccatcgcgccggcgagagcgaggtaggtgatgtccgaggtccagagggcgtgcaggcgccccgggtcgaacttcctggcaacgaggtctggtgggtagatcgccttcggatcggcgtgggtggtcgctgggcggaacctcctggggctgataccgccgatgccgcccctggccatcgctgccgccaccgtgttgtggctcgtcaccacgccagcggctcagagtgccgccgtgatccgtcgtgcgccgtaggtgccagaggatgcctggtggaccgcgaccactcggtcctcgaggtcgcgtctcgcacatgcccgacgcgacggtgctacctgggtgcgtcgccatcggtcgtagccagcccgggagacctcgaggaagcgtgccatccgcttgatcttgaagcgagcgtactccgcctccatcagcgcgaatctctcttgcgtggtggcttcgcggcgaagtacgcggctgcttttcccaggaactcgttgtccttgcgcagctcctcgagctccctgcgcaacctgatgagctccgtgcgctcctgcgccgtgaggggcgggctgccagtggcgtttgctgcttcgatccgcctgcgctcctcccgcacccatcgatagaggttgtgctccccgatcgcgagctcacgggccacctctgggacgctccggccgctgtcgatgacccggtgggccgcctcggtccggtactccagggtgaacttccttctcgacgtccccatcgacctccccttccctctgccatggtacgtgtgacttacgacgtgtcaacggaatctggtgtaggcagcggccttcttttgacccgggatcagcggtgcgaactgacccacccgtggcacaactataggtggtagtggtgaggatcgtggtgctcggcgtcacctcccttcgccatggcctcggccgcctggggcaacagtccaccggggagccgctgcttggtccggtccttcaggcggtagctctcgcctcggatgttcaggaccgtggcgtggtgcagcaagcggtccaatatggccgtcgcgagcacctggtcccccaccagggtgccccactcgccaaagcccttgttcgaggtgcagatgatgctcccggtctcgtagcgagctgagatcacctcgaagaagattcccccggcctccgtcgaaagcgcccggtaaccgatctcgtcgatgacgagcactttgggggcgaggtacttgcgcagacgcctcgggctgcccatgccctcgaggtcggccaccatgcgggccatggtggtgaagtagacggagtgcccggcctcgagagccgacagggcgagccccaccgcgaggtgggtcttgcccaccccaggaggtccaaggaacaccacgttggtggcgttcgccacgaaggcgcacgaggcgagctcgttgacgagggcgcgatccaccccggcggcaaagtcgaagtcgaagtcgccaaggcccttgcgatggggcaggcccgagagcttgagcctcgtctcgtagctgcggtggcgacgctcgtcgcgttcggcaccgaggagggagatgaggaagtccacataggaggcctcgcgttgggtggcggcctcgatggcggccccgacgagctcggcgctgcggggaaggccgagctcgccaaggagtgcttcggcgacctcaagcatggctcagcgcctcgtaggcatccagcgagcgcacctcgaccgtggtgtcgacgagctggcgggctcgggggccacggagtgcgccagcgagctcggcgcgtgggatgccctggtactgctggggcaggtagaccaccgtgcgggtcttgaacccaagcgagtgggtggcgatcacccttcctgtctcgtcggtgatctcgagggtgcgccctctgggcagcacccacaccgtgcgcgtgacgtaggcgattggtactccgtagctgacgccgccgaaggagacgaagccatcgaggctcacccgacgagggcggcgcacgaaggcatcgagctcggcgcgtggcggcaggggacgtagggcctcgcgctcggcacggtcgaagacctccatgggcgtagcaccgaggctcggatgcagcctgtggtcgcgctcgaggctccagcgatgggcctgctcgttgaggtcggcgaggtcacggaagcggcgggctggccagaagtgctccttcgcgtagcggatggagcgctccaccttgcccttggtctcgggccgtcggacccgacacagcgagatcgagatcccgaggtagcgggcgagatcgagcagctgggggtggtactcgtagccgcttgcggcgtccccgccgagcacgacggtcttcatgtggtcggtgagcaccacgttcgtgagtcccccgaagtggcagaaggcctcgagcagcgcaccgatgaagccgtagctgtcggcgctcggggcgaaggtgacgaaggtgcgccgcgagtagccaagcgtcgccacgagccccgggatgcgtcgctcctcgcccctggcgtccacgtaggagaagatgccccagtccacctggagctggtggccaggcggggtctcgtagcggcggatggggacgggtttcggaggtgcggtgtggcggatggtgcgcacgtagtcgcgcacgatggtgaccttgccggtgtagccgagctcggcgatccgttccacgatggccggggccgaggtgagcccgtctgccaccagccggtcgatctcggccttgtaggggtccagcttggaaccccgtcgggggcgggtggccttccccgaggtgccggcgccgtcgcgcaggtagcgccggaccgtgttccgggagtggcccgtgcgccgcgcgatctcgcggtagccgtagccctcagcctgcagttcgaatagcctcatcaaagacctgcccttcagcatcgggttgcccccttcttctggacccttgagggcaacctaccctggagggtgggtcatttttgttccgctgctcgtgggtcagttctagcccgctgcctacatctggggcggctcagatgggaacgtgaccttcgtgggtttgctattcgtggcaagcgtcagacagccagcgctgtacttgcgttcaagcaccaaccggtcacatagcacctcatatcgcttggcatacgacgcacccgcgaagatcggatcaactggaaagtacggttccacgttgcgaacgggcgcatggactttcgcacagtcctccagcagaaagaagtacccgaggaaaggcgcgggatgcttaccgaatcgaccttcccggtatgccgtccaaatgtcctcggcgttgccgatggcttcttccgttcggttgttgaagttgttaccgaagctcggaccgacctgtgacttgaattccacagccacaaggagctggccgtcaacgaccaccagcaagtcccacttcctttccggtcggtaatagccgggcagctcgagcgccgtgcggaccctgacatggtcaggctcgagcccagcatcgacgagtacgtccgtgagcagcacttcgagcgcacccatctgcgctcctcccgtgaccgcaccccgggtgcctgcgcttccccccatttgcttgacagtctgaatgtaggccacggccacctcttcgcgggcccagatgagctcgtactcgacgggcggtaggtacccgaggctcgagtgcaggcggacggtgttgtagcgctgaatccagctagcgatggcagagcgggcctcgtcgaggttcgcgaagcggtagcgagccaccagctcgcgctcgcaagctcccgcagaaggcctcggccacggcgttgtcgtcgcgaggtcgcgaccctgcccaccgactggcgaagcccgagcgtcgcgcagagctggcgaaccttccgggagaggtactggttggcgcgatcgctgtggacgatcgccccagcgaggctgccccgagtcccgagtgctccgcagatcgcctcgaccatcaggtcatcgggcatgcgacgctggagcgaccagcccacgatgcgccttgagcgcgccctccttggccaccgtgcggatgcgcatgatcacactgcgatcgacctgccactggtccgcggcctcgatcaccgtcacctcctggcgcaccagctggaggaagatctcgtacttctgcagagtggtcaggaaccgcttcgcacggcgtccagcccggtcagttccacgggtctcctcggtcatcggaacatggtcttccactcgtcgtggagacccgcggatgctgcttgattcgtgggccgatccctatcgcgaagtcaggcgcaaaccaaggccgtgtggctccgtgtgatcctgggaagcaccgaatcccacacaacggagagagggcggcagataccgtcgtgccgtcatgacggcatagtggtaacatgaagccatggcaaagaaaaagacgaccgtctacctcgactccgatgtactcacggcgacgaaggctgcagcgctcacctccaagcggtcggagagcgcggtcatcgaggatgcgctgcggtcatatcttcggagcggccacggcgatgcggcacgagatgagctgcgggaactcctgaagcgtgtggccttggcaagcgaccttgacgaggatgcagcgctcgcgcaggcagtagacgaggtccgagcggttcgtcaggagcgtcattcgcgatcggtgcgtggtgggtgagctgcgtcgtgttgtcttcgacacaaatgtgttcgtggcggcggtcacctcacgagacggcgtgtgcgcccggctcctccttgctgcgacaagtgggcggtatcgcctcatcgtctctccgatgctgctcgacgagctttctgcggtgctcgtgcggccgaagttccggcgatacctgagcgtcgaggacgcgcgtcggttcgtggaggtgatccgggagctggcagacgtcgtggacgatcccccggaggaggatgatcccatcaccggtgatcccgacgacgacttcctcgtcctcctggcggaggtggcgggtgccgacgtgctggtgtctggagacccggacctcaccacggtgcagcgtccgggacttgtcgtgaggacgccccgggcgttcctggaggacctggagcagccgatctgacggcggacatccccggcagggctcagtgagccccaccgggaacgagcccgggcgctatgccgccggggctgctggagcgctcttccgggagagcgcttggagtcggttggcgacgatctcgacagtgcgtcgagtgctggcgtcggtggcgtgccactggcgtgagttaagcctgccagccacgtacacgagccgacccttcgtcaggtatcgggtcgcaaactcggccgcctgaccccagagcacgacgtcgaagaagcccgaatgataccctgcctgcacggcgatccgtacggtcgtgacgtgcttcccggaaggagtctcccgaagatcaggggatgagatgaggcggccgatgagggtcacctggttcacggactctccccggctctggcgggatgccgccattgcggcggtcatcgtggtggttgtgttactgcgcattgctgcacctcttgttgtgtggatcgatgccacggtgacaagcgggcagactgccgagcggaattggccattaagccggtacggcttctcgctcttgggccttgcagcggacaggcaggggtctgctatcggggatgctcgcgtcccgtatggcgttcgtagacgatccagaagggtccagaaactccctgccaccgccttgacctgccaggatggagtcggcgaggctgctcagcgtagtgccctcctgtagacctcggatggaggtggagggcaccagcccctgcacgtacgcagctgactccgtcagcggcgagttctcggagcgtcaagggcagcgctcgatcgctgccaggcgctctgttgccgttgagcgcggctacgagcatccgagcactataggcaccgccgaagcaggtgactcgctggcaccttgtctgcaggaggagcatcctccttgggcgtgacaacttccgctggggcggtgatgccgtccacccccaaaggagatgcggaagaagcacaagatgatcgacacgagattgatcagggcactgcgtacgcatgccctgtgcatgcacacgcagggatccctacgagggcgacatcggcaagcccgccgctgcgcaaccgcagctcaccggcgacgtcgcgctgcgcacaccctgcatcggcatgcgtacgtagcgctgagcaggtcccgagaaatccacccgagaaactcgcccctcggacgagcgccggaatgacaaaccgctggccagacacctgcacccctgcacgaggtgcgtgcttgaccagcggtcatagtggcgggggcaggatttgaacctgcgaccttcgggttatgagcccgacgagctacctggctgctccaccccgcggcgtggagaacagtgtagcggcgctccctctaccccgccgccttgccggtcacgctcgcggccttgagctccgacaggatctgaccgatctgctcgatgtcgctctggtaggccccgaggttgccggacttcaaggcggcttgcgcctcactgtagagctgatcggccttggcgagcagcccggcggctgaactcggaacggtagccgtcgtcgacgtgcgcgacgaaccctgcacgcccgacggcacgacgccgaagatgtcgcgcaggacacccgcgaacgtcggctccatcgcaacctgcgtcccgtacacgccgatcacttccttgatctcaggcagcggattcgcctggctcgagacgtacatcgggcgaacccacaggaggttctgaccgagcggtagcgccgtgaggcccccgagcgacacgttcgagccgtgctggtcgagcagcgtgatctcctgagacacattggtcgcagacacgatgcgcgacgcaaccaatgcggggccgtcgatctggcccgaactcggagtcgtcaacgccacgagctgcgtcggatcggacgccgacgcctcgccaaagagcaggccggtcaggttctgctgcccgccgctctgcgagaacggcacgaatgcctccatcagtgccagctgcggcgaggaggtgccgggcacctttgccatctcgtagatcgggctcatcaggttttggctcgtgccgccgaagctgaacgagcttcccgacgagatcgagccgttctgcggctgtgccgacagcgaccacgcgttgccacccgagtagaacgtcgacggattcgtcacgtggtagatgccgtacatcgccgactgcacggcgaggagatcactcgggtagcggaggtgactcgcgatcgcggctggcatcgccgagaccggctggaagacatggggaaacgccgcctcgtaggcctggatgatcggatccgaggggtcggtgacatagaagtgcatggcaccggtgtaggcgttcacgaccaccttcaccgagttgcgaacgtagttgaacgacgtgttggcaagcggtgcgctcgacgacagcgcctgcgtgttggcctgctccgaataggggaagttcgctgtggtggtgtagccgttgatgacccagtcgatgtggccgtcgacgatcaccggatagggattcgacccgtagtgcaacaccggcatggccatctcgacgcgctggaggagatcgcgctcgaacatgatgcgcgagtgggtggtcagcaggctcgacaccaggatgttgatgtcgccgaagcgcatcgcaaatgccgcacgcacgagcagcgacgagagtcggacaccgcccgagccggcgtagtgggtctccgacgacgccccatcggggagctggtagtcgatctccgcttggcggctgtcagcgatcacgtagcccgagagaccttggccgtagtagacctgcggctgcgtgagcgtcggagcaccgcccgacgaggtcggcggaagatcacggatcaagaagatggggttgcccgcggccgagatctcgttcgccggtgccagcgcgacaccgtaaccatgcgtgaactgcagatgctggttgacccaggactgggctggaaggttcgctgcgttcagctctcgaacgccgatgatgaccggtgtgggcttgccgttgatcgtgtcgttctcgatcgagagcgaggggaactggtagtacgagcgaatggcctggagcttgccgaaggtctgctggggcgtcgaggttccccagagccgcgccgcgccaagggagtccaggttcgcctgctccaccgacgaactcgtattcgcggtcgcagaatagggctctgagggaacatcggcgatgtcgtaggcgtagcgcgtcgcagcgatgttgcgcgcgatgtagggaagctccttctgaccctgggcgggatccaccacgaacttctggatgatggccggatagatcgctcccagcacgatcgagatgaacgcccacaggcccagcccgatgaccggcaacacccaaccctgacggaagatgttgatgacgaacaggacgcaggccaccgcggagatgaagatcagcagattgatcgcggggagctgggcgtggacgtcggtgtagctcgctccctcgacgaagcccctggtcgagaagtccaactggtaacgctggaagtagtaaccaatggccttgatgagggccatcactgcgagcaggaccgacaggtgggccttcatcgagggtgcgacccgctgctctcggcgctggggctggatcgatccggtcaggtacccgacgaccgcggtgagcacgaacgtgaaggccgcagcaaggaagaaccacgagatcaggaactcgatgaacgggagtcgaaagacgtagaacccaacgttgacgtgaaattcggggtctcgcatcgggaaggactcgctgtggccgaagagcagccagttcttccattcggcaggtgcttgggaggcgacgatgagcgtcgtcaccacggcgagcacgacgggcagcacccaccgacgacggttggcgaaggcgcgatagcgctgcaccagttcgtcgtcgtggtcggccggttggcgcaggccctggcgttgcgcgacgaccatgctggtgagcgcccctgcgaggtagatcgccgcgaacacgacccacagctcgaccttggcgagcaggaccccgctccacacctcgccgaggtgatagttcgagaaccagaggtaatccgtgaagaagacggcgagacccttgagcgacagcagcaacacgatcgcgatgacgaccacgccgacgaggatgagctgcgcccgtgatggtccgcgacgctcccgggtcatgtcctgggggacgcgcataccatcacgagcctaggcgaagaccggcacaacgaggcaccggcacccgggatgcgctggcggtctctcatgacctgttgggaaagcctcgtcagcagcgacgacctcggcgagtgcgttgtcctcgcagtcggggcaggcacgacgcgtcgggtcgaggagccagcggtaccctcgcggcgcaccgacgctccgcacgcccgcgaagaaggcatcggtggcggcgtcgtgcgcaacctcatcgagtcgaccggctcgaagctcgcggtggattgcaccgacccgctgcgcgagctcctccggctcgccaccatcctccatcgtgcgcacgagcatcgcgagcacttcgtcgtcgagacgagcgacgagccgtgcaagtgcgtcagcgacgacgccatctgtgccctggtggtgcggcgcgacgatgccgccgagaccctcggcgaactcgaccccagccgccacgttccgttggatatggagttcgcagctcgcgcgcaacacggacgggtcggcccgcagctcgacgagacgagcggtgacctcctcgggatcgcgctggcgcaagtcggcaagcacctcgttgatgaggtcccccacgacgcgcttgacccggcgcgcaagatcgaccccgcgcggctctgcgagctcgagatagcgccggtacaacgatggtggacacgtattggcatcgtcacgatcgggctcgacgtcgccaactcgccccgcatcgccatcgtcggcctcagcgccgaggaccgcggactcgccacggtcgtggttcgtgtcgccaccacgctcgtcgacctcgtcaagttcgagcgtgtcgtcaccgtcatcgcgcacggccaagggctcgcgctgggcccgatcaggggacacgacctcgccggcgccagccaccgcctcgctgggagtgacgacatctgcagtgatggcgaccgcaccaccagcgtccgcgaggctcgagaacaagtgctcgaggcgctcgagacgctctcgtgcaaccgccgaccgatggctgggggagtcgtcgaccggcttacgtgcaccctcgccgagagcctcgctcgagggctccgagtccggtgacgttgcgtccgatggcgtcgcacctgggagatccgtgtccagaagtgcctcgtcgtgcggtgcaccgtcagccagtgcggtgtcccggagctccgtgtccgctgacaccgagacggccggctcctcgtctcgcgacgcctcgacgctctcgggcccctcgtgctcgtcggctcgagccgcacgtggccccccctcgtcccgtgaggcggtcgccaccgcatcgacctcaccggtcgtcgcaacgcgaggagcgagcacgtccgaggcgagtgagccggatggcccctcgacgacccggaccccactcgccggcgcaccctccccagcgagcgccgccgaaggagccggggcaccaacagggtcggcatcggaggcggtgctcgtcgcgtcgtgggcctcgtcggcgatcatccgaatgagcgacgtcacctcggcaagatcgaggtccggtcgcgcgagacgctcggcgacctcgctcaggtcggaggacgaacgctcgcgcgtgtctgcgacgtccgtcgacggatcgatcggcgtggtggtctcggccccgtcgctcggaggactcggaggctccgcgactgcgctactcggtccggcgatctcacgccgttcgacgaccgacggctctgcatcaaccccatgacgccgcgttcgccgctccaccgcgtcgacctggaccagcgcctctgtcgcaaccgttcgcacctgctcgagcagctggcgcagcgaaaggcgagtgaggtcgagattcgcaagttcttcgcgccgctcggccaccttggcctcggcgtcggcgaggagcttacgggcgtgctcgttggcgcgcagcaccagcgatcgcccctcttgcttcgcgctctccacggtggtctgggcagtccgatccgccattcgcgtgagctcactcgcctgagcgcgaacctgctcgaggtaggcctccgcagcctgccgcgcctcgccgagggcggcctcggccgcatgacgtgcctcgtcttcgatgcgctgcgcctcgcgtcgtgcacgctcgaggaggtcggcagcctgggcttctgcccgacgacgcagtgctgcggcggcctcggtcgcgctccgcaagacgtcggcagcttcgcgaccgacgagctgggcagcgcggtcggggtcttggagcgcgccgtcgagctcgttcttgaccttgagtgcctcggctcgcgcctcgtcgcgctcgagttcgcgcttggctccctcgcgacgagactcctccagcgcatcgcgcaggcgggcgacctcgtcgcgaagttctgagagcgtcgaccgaacgcggtcacggtcgaaaccgcgccgcacgaccgggaactcttcgtctggctcatctcccgagcgccacatcgctcctcctaccgagcgctgtgcgccgccgcctccggccggagccggtcgaggagctggagggctccacgcaaggtggcagctgcaagcacgcgcattctccccgccgcgtcggccctcgcctgcacgatttgcgatgttgcgacgatgaccgtctggatgccggcaactctagccgcgaggagacgctggcgaagtccggacacggccacgagtgccccgctcggatcgatcccggcgagcgcggcgatcggctggcgcggggcgcgggcgagcagcgcaggacgaagttcgtcggcgatcgccaggcccaccgccagccctgacgacgccgtgtcggcgtcgggcaggcgcagctcgagatgcaccggcgtgatggcggcggtcgcaggtgaggtcacgagtccgagttccccggcgaccgagggcaccgtcaccgacgagacgaaccgcgagagtcctgaggccgtcgaacgcaccaacgacaaggtcacacgcgtgtgggtgacggccgcggcgacggcgctggcgaacgctgctggcgtcggcacgggaacgccgtcgaccccgaccacgagatcgccagcgtgcacgacaccccggagcggagacgtcgggagcacaccacgcaccacctggccctccatcgactcgacccgaacgccgactgctcgacaggccgcgaccagcgcagcgatctccgactgctgcgatgcgctgagcacggctggatcgccagaacgtgcccccacgatctcggggaccaccgattcggcggggtcgaagcttgcgatcagccaaccaagtggcgagagcggtcgcgcggtcgtggtcgcgctcgcgatgtccagcgtggcgggcggccgccccgccacgcgcacgagcggcgcgatcgccacggtcgcacccggcgcaagggccacctcaccgatgcgtccgaacaccccccacccgagcaggaggagcagccatccgacgacccacagcttcgccccggcaacgacggcgtcgctcatcctcctctgacgcacgaggggagcctacgagttccgaggccgaaccaatctgtaatgatgattacactcatgagcagaccgaaggaggctctcatgacaacatggctttctcgcgccgaagccgcgtcagaactcgtggcggcgagcgcactgctgttcgaggcggaggtgatgtcgcgctccggtcacggcaatctctcctgccgcatcggcgacgacacgatcctcatgacctcgtcgggatcgatccgcaacctcgatccttcgacgctggccgtcgtcggactcgacggcaccgttcgcgaaggggcgatcgcgccggagaacgccgagatcatcgagatgcacacacaggtctaccggcttcgccccgagctcggtgcgatcatccacacccattcaccgaacctcacggccttcgcctatgcccatgagccgctgcccattcgctccgagcccatgcttcggttcggccaggcggtcgcggttcccgtagcgccctgggcgcctcgcggatcacacgagtcggtgggcgggatcgtcgaagcactgcggaacgccccagagagtcaggcggtgctcctcgccaatcacgggttgctggctctcggtgccgcaccaacggcggtggctcgcctcatcgtcgccctcgaggaagcggcgacggaggagcgcttcgcggcagccctcggtggcgccaaggactttcccgccgatgcgctcgccaaggtccaagcctcgatggcgagggtacggtgagcacgtccgaccgcttctcgtcgattcgtgacgggtatctgcggttcttcggctcggtccccgcgtcgttcgaggagcgggcgcgggtggcgcgtctcgttggtcgagaggcgaccctggaggccgcagaggccctccgagccgccgcgatctacgacaatccgctcgggccgcgcctgcagcagctcgtccacttcggccagctcctcgtgctcggcgaggagggccctgcggcgctgcacgcccgcaccgcggttcgccacggcgcaacgatggccgatctcgtgggcgtcgtcgagactgcgctcatcacggccggcgtccccgcctatgcgctcgggatgcgcgtgctcgcagcactcgatcatgtcgacgagtccgacacaccctgaactcggcgcgggctggctgctcggagcagtccaccgacacatccgttcgcgctgggcggagcggattcgtgcctacgacgtcacgccaccgcaggctgcggcgcttcgtgccctcgcgagcgccccaggactgtcgctgcgggagctcgcgcgacagatcgaagcagagccgatcaacctgtcgcgcacgctcgaacctctcgaggaacgtggcctcgtgtgtcgcgagccgagacccaacgatcggcgcgctcacgcgctcgtgctcaccccacgaggcctggacctggccgcctcgctgaccgcggccgcggccgagttcgagcacgagctggccacgctcctcgacccaggcttcgaccagacggtggcgtggctccatcgcgccctcgccaccttgcgcacgtccgagccgtcgcagccaggctgacccgcacggcctggcgtacccgaggcgcacacgacacgtctaccatctcgacgacggcacccgacgggaggcacccatggcacgactcgagatcgacgcagggtgcgctcgctgcgctcgggccggcacgcacgcccaacatctcgctggcccgatggacgtcgtcgagcgacccggactcgacgccgtgcgctacgtcgacgatgagggccgagccttcgcaggcttcgacgccatcgtcgccgtgctcgccggtcgctggccacggttcgctcgggtcggcacgatccgctgggtgcgggccaccgggacggtggcctaccgagcggtggcgcacgtccaccgcgtgggagatcgacccgacagctcccagcacgagggctccgagcgcccgccgcgaggctaggtcatccgcgagaaccgacggatcgcgatcggcgccgccacgatgacgaaccccacggcgaccgcgagcgatccgaggagcgaggcgccgaggctcacaccgaccagggcgcgggctcccgagccgacgatctcgaggcgagccgcgtccatgaccagcgagaccggctggtagcgcgcgaacccctggagccaacccggcagggtctggatcgggacgaacgcactcgagacgaacgtgaggggaaagagcacgggaaagctcatgagctgggccgcctccgcactcggagcgtagagacccacgatggcgaacaaccaggacagggcgtagctgaacgccaacacgacgaccaatccgaccacgaggccgacgagatgatgcggacggaatcccacggcaagtccgacgacgacgacgatgacggcggtcgcgaggttgcgtacgaggtcggcggccgtacggcccagcaggaccgcagcacgcgagatcggcagggcgcgaaagcgctccatgatgcccgacgcgaggtcttcggcgagcccgacgctggtggccgctgcgccgaagatgatcgtctggaccaagatccccggcatcaaaaagtcgacgtaggggaccccgagtcgagccgtgatcaccccgagcgacccgccgaagacgtagcgaaacagcaggacgaacatgaccggctggatgaacgagaagaacagcgactgtgggacgcgcaggtagccacggagcacccggcctgcgagtacccatgcgtcggcgatcacgctcccgccacgttcgtgtgcgatcacggcgctgctcatgccgccccctcggtactcagctgcccgttggtgatcgcgagaaacacgtcgtcgagcgttggttcgcgtatcaccatgccctcgatcgcgaccccggcgccgtcgagcgcacgcagcgcgatcatcgctgcctgcgcaccgttctcgacgccgagctcgaccacgcggccatcgacgcgcggatcgggaaacccggccgcccgcagcgcctcgacgaccatgggcggcggctccgcggcgagccgcacctcgaccaccgtcgccccgaggcgagccttcagggaggctggcgttccctcggccacgatgcggccgtggtcgacgatgacgagtcgctccgccagtcgatcggcctcctccaggtactgcgtggtgagcagcacggtggtcccgctcgctgcgagatccgccacgatcgcccagagcgcgaggcgactctccgggtcgaggccggtcgtgggctcgtcgaggaacagcaccggcggctcagcgaccagtgctgcggcaaggtcgagccgacggcgcatgccgcccgagtaggtccgcagggggcggtctgcggcccctgcgagaccgaaggcctcgagcagcgaccccgcacgctccctggctcgacgccgaccgaggtggcagagccgaccgaccatctcgagattctcacgagcgctcaggcgtgggtcgaccgcagcgaactggccagcaagcccgatgcggcgacgaacgacgtccggctcgccaatgagatcggcgcccgcgacgatggcacgtccgccgtcggggacgagcaccgtcgtgaggatgcgtaccagcgtcgtcttgcccgcaccgttgggtccgaggagaccgaacacctcgccgtgggcgacgctcaagctgacgccggcgagcgcgacgagatcgccgaagcgcttcgtgaggtcgtgcgcctcgatggcgagtggttccatcccggtcaacctactcgctgtcgagatctggcgcgtcgctcagtgtgacggcagcagatcgccgatctcggctcgctcggcgatcagctcgtcgcgcgtcacggcgatccgagccgcgagcggttctggcacatcgagtccctccacgacgtgtacccgctcaccgtcggagcggaccgggaaaccgaagaagagcccctcggggatgccgtactcaccggcggacaccacaccgagcgcttcccagtcgtcggctgcgctcggatggatcaccgagcgaaccgagtcgatcacggcgttggctgcgctcgcggcgctcgaggcaccacgcgccttgatgatggccgccccccgctgctggaccgtcgggatgaagtgctcgtcgaaccatgccgcgtcgtcgatcacttcggtggccggcttgcccccgatacgcgcgtgccagtagtcgggcacctgggttgcggagtggttgccccagatcgcgaccgtgcgcacctcgtcgagcgcaacgcctgctcgctgcgcgagttgggtacgagctcggttctgatcgagcctcgtcatcgagaaccaccgctccgcggggatctctcgggcgttctcgcgtgcgatcagcgcgttcgtgttgcacgggttgcccaccacgagcacccggacatcagaggccgcgtgctcggcgagcgctcgaccctgaggacgaaagatcgcaccgttgacgccgaggaggtcgcggcgctccatgccagccttgcgcggcaccgagccgatgagcagggcccagttcacgccgtcgaaaccacgtgcgagatcggtggtgagttccatccgacggagcaacgggaacgcacagtcgtcgagctccatcgcaacgccctcgagagctgccatcgccggctcgatctcgatgagcgacagctcgatgggcgtttcgggcccgaagacgtcgcccgcagccagccggaacagcagcgaataggcgatctgaccagcggcgccggtgacggcgacacgaacgggtgtggtcatggtgctccttccatcatccccccgtcttctcgtccccccgacgaatgcgctccgcgacggcgtggccgaactcgctggtcgagaccttggtcgcgccatcgcgcaaccgtgcgaagtcgtaggtcacgatgccctcggcgatggtccgctcgagcgcatcgacgatggcgtcggcgacgtcattccagcccaggtactcgaacatcagcacgccggacaggatgaccgaacccggattcaccatgtccttgccggcatacttcggggccgtaccatgggtcgcctcgaagatcccgtgaccggtgacgtagttgatgttgccgcccggtgcgatgccgatgcctccgacctgggcggccagcgcgtccgagaggtaatcgccgttcaggttcgtcgtcgcgatgacgtcgtagtcccgaggccgcgtgagcacctgctggaaggcgttgtcggcgatcgcatccttgacgagcagcttgtcgccgggatcaccaccacagtcgtcccagccaacggcgacgtccgcgaactcctcacgcacgagctcgtacccccacgcacggaacgcaccctcggtgaacttctggatgttgcccttgtggacgagcgtcaccgagcggcggtggtgatcgagggcgtagcgaatggcagctcggatgagccgcttggacccatgggccgacacgggcttgatcccgatccctgcatcggcgccgagctcccacccgaagcgctcggcgaggaactcgcgcagcgcacgggcctcctccgaaccagcctggacctcgaggccagcgtagacgtcctcggtgttctcgcgaaagatcaccatgtccacccactccggatggcgcaccggcgacggcacgccctcgaaccagcgcacgggccgcaggcagacgtagagatcgagcagctgacgcagggcgacgttcagcgaacggatgccgccaccgaccggggtcgtgagcgggcccttgatcccgacgagatactcacgaaacaccgacagcgtctcgtccggcagccacgacccggtctcgcggaaggccttctcgccagcgagcacctcgcgccactcgacgcgacgcccatgggccgcgagtgccgcatcgaagaccgtcctcgcggcgggccagatgtccaccccggttccatcgccctcgatgtaggggatgatgacctcatcgccgacgatcagccgaccgtcggctcccatgcgcaccggagttgccacgggctcatcctatcccaccgtctcaaagcgccccagtcaggcctccggatcctgcctcgagccgccacgtgcaagacgatccgcccagcgctccacgtcggcaagctcgtcggcgttcgggaaggcgtcggggtccgccagcgcggcgccgacgagctcggctcgatcctcccgcaccaacagctggccggcgaagcgctgactcgcggcctccaccgccgcgaggtccatgccgaacaggttcgcgagcgccagcgtcgccggctcctgctcgcgccgatccgccaggctctcgatccagcccgcacgcccaaagaggcggggccgtagctcctccagcgccgctcgcgcgacgcccagcacgaagctggcggtcgtcgcgagttcgcgaaggttggcttggcgtgccgggctctcctcggcctcgaagaggccctcgagcccgaagcctccgagctcaccgagtcctgcgatgcccccgcgctcgaggagcctacgacccatcgcctcggcatcagcacgcaggtcgaggaggaacaaccgcagctcgacgtcgagacggtcggcgacgttcggcgaggcgatgagcggtccgcggaccgcatcctcgagcaccacccagaggccgacctccgcggcgggtgccccgagttcggcggcgactcgtccgatcgccgctggcgcgaccgtcgcgccagcgtggagggatcgtggcagtacgagctccgtccccgacagcgacgccatcgcgaagtgcccaaggaccgagccgagctgtgcattgaccatcatcggaccagcttgggctgcgagggtcgcgaacaagcgccccatctcgggatccatcgcgtcggtgaactggggctcggtgacgaccgtgccaccgagagcacgctcgaacaacacgaggtactcgcgcagctcaccgacgagctcggtgtacaggtcgcgtgggtggagggtgcgcacgccgatctcgacctcgcccacgacacgcaccgcgagcgccgactcgggaaggtaacgagacgcgatcggaccgagctcctcgaacggcgcgcgttccgtggcgccgagcgcgtcggctccggagagcgcgagctgggcaaactcgtcgcgcacccgtgacggatccgacccctgggcgctcatggcacgcgcgaggtcccgcagtaggaactcgaacgggttctggggctcctcatcgctcgccatcgctcctcctcgacgtgcctgccgcacccaatgtcgtggcacccacgcagcaccccaccctattcgccccgggaagcggacgaggagtcctacgatggaccaggtgagccacctcgaggctacggtgcgcgtcggccacgacgcccggctggtcacctggtaccgctggagcccgacggcgacgtgggtggtgatcgtcgagcccggcgcgacccatgactacctcgtcccggtgatcgaccagctgggtgcagccacctacgacccgatcggcaacgggcgctcgcgtcaccttccgcccgatgcgatcggccgcatcgggcgcaacctcgccgcggacgaactcgcagcgatcctcgaggcgctcccgggccccaggcgactcgtcagccaccacagtgcgtgcatcgccgcactcgacatcctcgccctcgtgccggagctcctgagtgagatggtgctcgtcgctccacgtctcgggcctccgcccgcacggctcgaccccttcgcgacggagcatgcctcgtcgccgtggcacgacgcgacccgcgcctggatctcggccgacccgcgaccgctcgagcactggcgcaccgaggtggcaccctcggttcgcgacgcgctccgggtcccggcgtcgacgagcaccgtcgcggtgcgcgcgctcgtcgacgccgacgacacggaggcccgtaccctcgccgagaccctcggagttcccacggaggtcttccccggacgcgatctcgcgctcgccgactcgtctcggttggtagccgcccttgctcgctgagtgttcgcgcagaatccggcgctgctcgcaagctgtgcagcctcgggcatctagcctggaagcacacctcggtcgagtcgtcgcgcgacaacccgcgagtcgacgacgaggtgcgtcatccaccgggcaatggggccagaggtgcgaggaggcatggtggtaagcgggtcgtgggagtcgacgacagccaccacgtggcttcgccttgagggcgctcccatcgatgaagccgcggtcgcgacgttctgccggcggccctccgtgggcgcggtggtcaccttcgctggcacggtgcgcgatcagggcgagggcctcagcggtatcatcgccctgcactacgaggtcgccctcgaactcgccgccgcacgcctcgatgcgatcgcagcacgtgccttcagcgacgctcccgagctccaagcgctcgcggtccaccatcgtctcggacgcgtgccgctcggcgagcccgccgtcgtcgtcgccgcagccgccgcccatcgcgacctcgccttcgacgcggcacgcttcgtcatcgacgccgtgaaggtggcggttcccctcgtcaagcaggaactcaccgaggtcggcgcacgatgggccccgagcgccacgcccctcgaagacttccccacacagaaggatgtgacgtcatgatcgagctgctctacatcgccatccccatcgcgctcgtggtcatcgtcgcggtcgtctccagcatgcgcgagcaccgtccccatgacgtgcgctcgagcgtctccacgttcgagcacgcccgtcaggcgctcgagcgccgcaccaccctcgacgcgagggagcgccccctccgtgagcgtggatctcggggtgcacccgagtgagccgtatcgccctcgatctcggtacggcgacgacgcgcctcgcgatcggtgccgagccgccgcacgcgctggagagccttgcggccatcgacgtcgagcgaggcgacgtcatcgccgttggcagcgcagcacgcgccgtggtattgcgtgagggcggtcgcacgtcgctggtgcacgtcgtcgacgctggcgtcccggtcggcccgcaggtgctcgccggcttcctcaagcgcacgctacgcgaggtcggcctccgctccctcgggcacggcgaagtcgtcatgtcgatgagcgaactcgccacgagcgtcgagcgccgcatggctgcgcgcctcatcgaccgcctcggtgcgtccgccgtgacgctcgtaccgccgtcactgagcgtactgcgcgccgtcggcgccgatccagagttcggctcgttcgccatggtggtcggggaagcctacaccgaagcaggcatcgcggcgatgggcagcctttgcgcgagtgctgcgagcaaggacggtgttcgcgatctgcgaagggccatcagagagtacctctggagcaatcacgagctcgccatcagcgacgagaccgcctccgaggtgctcacccaactgtgcgatgtgtctcgccccacccagagcgcccgtgcccgcatctggggacgacgccgaaccgacgcagagagtaccaacgtcatcgtcgatgcgagtgcgctggtcgccgcgatgactccgacgctgcgctcgatcgaacagctcgccaacaccgcgctcgcgcgggcgcatgcccagctcgtcgccgacatcgccgaacggggcctcgtcctcgctgggggcggcagctacgtaccgggcctcgccgcacgtctggcgaacgcgctcaagatccccgtgacggtcgctgacgagccactggacgccgtgcttcggggtctacgcaccagcgcgcgactccctcggcgtcgttcgcccgcgccctcctaaggggcgcacctgacgcacgcacctcggcacgctgccaagtgccctgcttgcaagaccccgtcgcacggtgctgacgccgctgcaccgctctcgcgccgagtccccgcggtccaaggtccggcgcaccgacgagccccgcgtgctcgcgtcggtgagcccatctgcgcaatgctcggcagcgacgagtcgcacgacacgccgacccggtggattcgacccgaagggccgagccgcccagcgacccaccggagccgacggctcgcccggcatgcaccacgtcgccctcgccagaggtgacaggtcgctcggtcggtaagtccacgccgatggcccggcggatcgatcgtacgttctcactctccgtgaagtttcttctctcagtggtcgatactcctcctgtacgcaccgatgacgggtcgcacgggccctggaaccggcgatcaaggaggagctatgcgtcgccacggatgggtagcaacagtcgtcgccagcgccgcgctcgcgctcggcatcgtggccactccggaagtcgcctaccgcacgccagctgcaccccggccgcagacccgagcagcgctcgcagcccccatcgtcggggtggccgccgacccaagcggccaaggctactgggaggtcggcgccgacggcggcatcttcaacttcggcggcgcgcccttcgatggcaacacctacaccttgggactcacgggtctcggtgggtcacgtccgctcgcagctcccatcgtcgggatggccgcaacccccgacggcaagggctattggctggtggcggccgacggcggggtgttcagcttcggagatgctggcttctacggcaacacctacaccttggggctcacgggactcggtgggtctcgtccgctcgctgctcccatcgtcgggatcgtgcccacccccgacggcaagggctattggctggtggccaaggacgggggcgtcttcagcttcggagacgccggcttctacggcaacacctacaccttggggctcaccggtctcggtggctctcgtccgctcgcagccccggtcgtcgggatggccacaacccccgacggcaagggctattggctggtggcggccgacggcggggtgttcagcttcggagatgctggcttctacggcaacacctacaccttggggctcacgggactcggtgggtctcgtccgctcgcagctcccgtcgtcgggatcgacccgagccctaccggtgccggctacaccttggtcgcggccgacggcggggtgttcaccttcggggacgcgagcttcgacggcaccacctactcgatgggctacacgggacttggggggtcacacccgctccctggcgccatcgtgggggcggccgaggcccccggggacaccgggtactggatgaccagcgcgagcggctccatcttcgccttcggatcggcaccgttcgacggggacacctcgactatcggcctgacaccgaccgtccagaacgccctcgccaaccccagcacgaacctggccccaaccttcgacgcggcctgcttcgagcagttcctcgcgagcggaacggttgggtcgaccgcctgtgatcaagacgccatcgccgccatcgatcaagcccacagcgacgagggcctcccgccgctgtcgctcccgtccaacttctacgcgctcacgaacgccgagcagctcttcgtgctcgtgaacgaggaacggatccagcgaggcctcccggcgctctatgggctggcaggcaccttgaacgccgacgcgaccgccggtgcccagtccaacagcgaccccggctttgcgttcacgcagtcgtggccatggcttccggacgcggggagcaactgggcaggcgactatgcgccagcggcgagcatgttcgattggatgtacaacgacggttggggcggatcccaggccgcgacctcgaacatcgactgcacatccgcaacggcacccgggtgctgggggcaccgtgccaacatcttgatcaccgttccccaaggcgccgtcggcgtgatgggagccgcgagcatccccgagagcacactgggtgcgagtggctcccccttcgaatcggacaccatggtggtcggattcgtcccagcagcgtccgtctcgggcctaacctacacctacacctggtccgaggccgtccaagccggagccgatccgcagccgtaggccaagcccagctttcgaactcaaaggcgacggcgactcgctggccgccgtcaatcgcaggacctccagcaagtccggattaccagagacatgacgagtatcattcggataccaggaatggtacatcacgaaccgaatggtacatcacgaaccgaaacgagctgacctagtgcaaacaccgagcccgggcatcgatcccttaggagccctcacggcatcgatatacgactcgcctcggctctacgccttcctcatcggaagcggggtgtcgaccggagccagacagccaagcgcgtgggaaatcctagaccagctaatagcgcagtatgcgtcagcaaccagtaccgatgtgcgcgcgcttggtctaacaccaaccgaatggtggcagcgcactttcgaatctgacgcggaatacagctcagtcctggagcgactcgaacccacaagaggaggccgccagcaacgcctcgagaaactcttcatctcaagctcgccttccgacgcccacaggcacttggccaagctatgttcgattggacacgtgcaggtgatcatgactaccaacttcgatcgcctgatcgaggacgcactaactgagcaggccgtccgattccatgtggtcgatcacaacaatgtcaagggaatgcaaccccttgtgcgcggtgccgtcacagtaattaaactcaatggcgactatgccgatctttacatgaaaaatacgagaatggcactgtctcactacacgcgaccatttacgaccctaataaagcgagttttgcaagaatatgggctcgtggttgttgggtggtcgggtcggtgggatgaagggttgcgaaagctgattgagagcaacagcgcacgcctctaccctatgtactgggtcgcacatcatggtcagctacatgacgaggcacagcggttgcttgatcagcgtggtgcttacaggattgactcacacggagctgacgacttcttcggccggctagccacaggactggagcgtctcagtcaactagcatacacacgtgccaggcctataagagccttacgaggcggccgagtattcaccattagtagtaattggagtccagtttcatcgccaagcacccaaagcggcaagttgtggattcgcactgccgtcacactcatgccagcctcgcagcagggagtcggttatgtcgatgccgccgaaatgtggggatacattgacactccagaaagaagagcgatccggaccgaacttgccgccgcgcgggccgcgtatgacattgccagtcttgttactgtcggccagctaaattctgggcttccggtcgacatgctgaatcaacaaatggaatggcacctttcgaagactgaccagctagatcgagattctgtttacttcgaacttgacgctccgaagagtgactactgtacttgttcggcgcggtgtcgcgtttatcttgggcccgggcgccctgagcaacagggcagcgcaatcatagacatcggcataggcgatctcaaggaccgctccaatcgacagcgaaagcttgctttaggagagctcgcgatcatttggttggaccagctcgacgctgcgattcgaattctaaccgatgcacttagcagtgctacaggtgggatggcaatgattgatacagtggaattccacctagaatatctgggcaagcctgacgaaccgagtatgggtctcgctcaccacgtcgacttctctcttctgggagttggaggtcgcgacgctcgagcagtgtcctctaagtttaggccagctgaacccctaacaggcgcagcaaagctggatatcgtcattgatgcagtaagggatatagcaatgaacactgggtttcacgacccagacattgggattggccgcttaaggagcgaactcgatagcctgcctcgacaagcttaattaccgatcccaaacaaatccataacggctcaatgacggcgcctttatatcgctgctgacgcatgtgaccgacccccgaagccgagtcaaggagccgtaacgtggcgacttcgggctcactggcctcccccctccaggttgagacctgctataggaggaagggatgagccagacaccgagcccaccaccgggcgacggaccagctcgacgacgacggggccgttacccgagccagttccgtagggacgccgcagcgttggtcctcgaccagcaccgaaccatcgctgaggtcgctcgcgaactcggcgtgaacgagcagacccctggtaactcacgtgcgcctagaacgcatccaccgaggtgagcgagagggcctaacaagcgcggagcgcgaggagttgacactgctgagtcggcaggtcacacagctcaccatggaatgcgagccggcgaagcgagcgatgtctcactcggtgaatgagggggacagtgggccgttaccactcagatctcccgctaggagaccaatggcttctccgtggcggcgccagcacgagtcatcggggtctcccccctggttgaaccgccccgggtttcgtgcacacttcgttacgtgtgaacggtctcggactcggccgctaggcggccatagtactcctgctcgacctcaatgggtggaccgcgccccagccggtgcatgagcctgcgcgtgttgtaccagttcaccgaggctctggtctcctcctcaaggtccgtgaggctggtaagaggcccgcgcgcaaagggtgggccaggccgcacgcacacggttgtggagagaccgatcgtggtctcggcgagcgcagtgtcgtaggcgtccccgacggagccgatcgaggccaccatgcctgccaacaggagcgattcaccaacatgcacggccgtcgcggcagagcctgcatccgagtgatggatcgtgctcccggtgagggggtgcccctcgcgtgcttgtcggccctcggccatgcgcagggcacgctcgacgagtcgggtgtcgtggcgacaggagcaggcccaccccacgatggtgccggcgaaggcgtcgatcacgaaggccgtggtggcacgccgcccgtgagccggacgtcggtgaagtccgccacgcacagctcgtcgggtcgctcccgtcggaagtcccggttgacgaggtccggggcgatctcggccttggggtctcgcatgtcgtgcgttgccgtgcacctgtcgcaccccgcaccagccatcagcgcgcgcgagccgttgcagcgtgcagcgggcaaccgggatcccctggcggcgcagagaggcccacaccttggtcgcccctaagagcgactccggcggacggcgacctttagcgtcgggctcatagatgccggcaaggatctcgctgatggcgctctctcagaggcaacggcgcgacggggctcggccaaggtgggcgtcgtaggtcctgggagcgatcgcactgtgcgtgcgctctcgagcgctcggacaatcggagcgaccccgtaggcccgtcggtgctgcgtgatgaagtcgcagatcaccgctggtgcggatcctcgcccgcgcgaagaacgttgtcgctgccttcaagatctcgatccgagcgctcgagttcagcgcgttcgtgcgcttcgagcgctcggatctcggctgtggtcggtggtgatgcccggccgctcgcctgcgttgactcggtactggtagagctacgtgcgcagcgtctctggtgccatggggagccgtccggacactgcctcgatcgctgcccattgactcggatactcgctgcggtgctcgagcacgaggcggatcgcctgttccttcgtctgctggtcccatctgctggccatgatctatccttcccttctctccaatggaagtgtgcatcaaagccggggtgattcaggttgtactacccctggcgacaccgtcgggacgaggcgaggatcccgagcacctggtgctcgcgagcgagccccacgccatctggcacgagagcgacggcacctacgccaagtccccgcatcacccacgagctgcgacacgcggttactgcgtcaaccacaagcgggtggagcgcatgatgcgcgagctcgagatagcagcgtgtctactccgccgcttcgtgcgtaccacgacgcggcaagaggacgcacccctcccagacctcgtctgtcaggacttcgctcctggtgagccagcgcgtcgctctgtgagcgacatcacctacgtccgcaccgacgagggcttctgctacctcgccacggaggtggatctcggatcaggcggatcgtgggctggtcactcgagcgtcgcatgcccgatgggctggtgatccaggcgatccgcggagccctcgggactcggggcagcctgaggtgccccagatttcgtagacacccaggttacttcacgcgagcctcctccgcgacgaggtgctcgaagacgactggggcaaggtagccgatcttcgagcagctgcgctggtggttgtagaactggatgtagctctgtatgccgcggcgcagctcggcgaggtcgccaaaggcgtggcggtagaagaactcgtgtttgaagatcgaccagaaggactccgcgctcgcgtggtcgtagcaggtgccggttcgccccatggagcgcgtgatcccgtgtcgggcacagaaggccacaactcgatggtcgctgaactgactccctcggtcggtgtgccagatgaccccctgcgcgtgggacccacgcaccgcgacggcctggccgagggcctcgagcacgagcgtggtctccatgcgctccgcgacgctccatccgagcacccgccgcgagtgctcgtcgcgcaccacacacaggtatgccatcgcgccggcgagagcgaggtaggtgatgtccgaggtccagagggcgtgcaggcgccccgggtcgaacttcctggcaacgaggtctggtgggtagatcgccttcggatcggcgtgggtggtcgctgggcggaacctcctggggctgataccggcgatgccgcgcctggccatcgctgctgccaccgtgttgtggctcgtcaccacgccagcggctcagagtgccgccgtgatccgtcgtgcgccgtaggtgccagaggatgcctggtggaccgcgaccactcggtcctcgaggtcgcgtctcgcacatgcccgacgcgacggtgctacctgggtgcgtcgccatcggtcgtagccagcccgggagacctcgaggaagcgtgccatccgcttgatcttgaagcgagcgtactccgcctccatcagcgcgaatctctcttgcgtggtggcttcgcggcgaagtacgcggctgcttttcccaggaactcgttgtccttgcgcagctcctcgagctccctgcgcaacctgatgagctcggtgcgctcctgcgccgtgaggggcgggctgccagtggcgtttgctgcttcgatccgcctgcgctcctcccgcacccatcgatagaggttgtgctccccgatcgcgagctcacgggccacctctgggacgctccggccgctgtcgatgacccggtgggccgcctcggtccggtactccagggtgaacttccttctcgacgtccccatcgacctccccttccctctgccatggtacgtgtgacttacgacgtgtcaacggaatctggggcggctcagcctggctggggcgatcttccacagcgatcgcgagtggcgtcccaccaagtggtgtaatttctgggcggcctgcactccaggagggcgggccaccgggcgatctctggcgtgtcagtcaacagctcgccagaggaggtatccagtggccctgacccgttccgactttacccacttgctctggcgccatcagagcgggcggtgacatcgacgtcatccgggagggggtggagctcgtgctccaggccctcatcgagcgagaggctgcggcggtcattggcgctggccgctacgaacgaggcgagggacgccagacgcaagcgcaacggctaccgcgaccgtctgctcgtcaccaaggccggcgacgtggagctacacatcccgaagctccgccgggggagcttcttcccgagcatcctcgagcgccgccgtctgagtcgatcgtgccctctacgcggtcgtcatggaggcctacgtctgagggagtcagtacccgcaaggtcgacgacctcgtcacggccctcggtgggacggggatctcgaggagcgaggtctcccggatcgtcgcctccctcgacgaggagctggcagggttccgtacccgcaggctggaccatctcgagttcccctacctcttcgccgatgccacctacgtcaagggccgcctcgagcaccaggtggtctcccgtgccgtcgtgaccatcacgggcgtgaatgccactggggaccgcgaggtccttggcgtcgccgtcggggatgggcagactgagagcttctcgcccgagtgcgcgagggagctcagggatcgtggcctcagtggtgtgcgcctcgtcagctccgatgcccatcgggggctcaccaacgccattgccaggtgcttcatcggggcgagctggcagcggtgccgagtgcagcgtgcgcgatgtgctcagccgcattccgaaggggagctgaggagatggtcctggccccagatccgcacgatcttcgctcagccgtccccgggagcggtacgtacccagtacgaccaggtcattgactcccttgccgcgaagctcccagcggttgctgccatgctcgccgaggccaaggaggaggtctgcaccttcacgcacttcccggaggcccactggcgaaaaatctggtcgacgaacccgctcgagcgggtgaaccatgagatcaagcggcgcaccaacgtcgtcggggtcttcccgaacgacgccgctctcctgcgcctcgtcaccgcggtcgtgctcgagcagcacgaggagtgggccgttgccgagcggcactacctgtcacaggagtccatggccgagctcgggactgccacgagcgacgacgacacggcgggcacctccgagacgcctcggccccctggcgctcctccggtgctgccgtcgcccgccgaggaagagcctgcagtggtaggctgaggccagccagggagtgaatttacaccactcggtgggacgtgatccgatcgcgccatccagtacctctcccggaaggtccggagcctacttgcgaccctcggcattcgccagtcagtgggcagagttgcgacctgctacgacaacgccgtggccgaggcctgctttgggagcttgaagcgcgagcttgtggctcgctaccgcttcgcgaacctggccgaggcccgctcggccatcgcgacctggatccagcgctacaacaccgtccgcttgcactcgacgcttgggtacctaccgcccgtggagtacgagctctcctgggcctgcagggaggtggccgtggcccaaattcagcctgtcaagcaaatgaggggaagcccacacaggtgaaggcggactcgtttgttggggactgtcaacatcgaggaattcgagggtgccttggtcaattccaacacccagcacatcgccagcgcagccccggcaacgccctcagaccatgcggcatcatgcaccgtctcgagaccagaccctctcgccgcgacgatcaagcgcgatccgaagcgtcgggcgacgggtcggcaccggatggagtcccactcgtgtcctcgtcatcgacgacgccgagcccaccccgatcgcgaagcaggtccgccgccaccgaccgcacctggcggtctcgatcggtggcggcagcgcggagcgcgcggtcggcacgtgggtcatcgaaggcgcacagcgcaaccaccgcccgccgtcgaaccgccggcttgtcgttgcgagctgcgtcgatgacgacgtcgagaccctcgggcgcaccgatggatccgagcgcggcgatcgccgcttcgcgaaccctgaggtcctcgtggacacgagcgctggtcacgagcactgcgacgtcgtcccgatcgccgacctcgccgaggatccaacaggccgcctcgacgacgagcgggtcagggtctccgagcaggccccgcgcacgctgatgcccgatcgcagagggacccgccccccacagcgccccgacgcggacgtcggcgtcgtcgtgagcgagcagccaggcgagatcctgctcatcaccgcggcgtgccagcgcgatcgccgccgtccgagcactgcgtcctcctgctgccaccagggcgcgcagcgtcgataccggtgcatcgaggacatccaatgggttcgcgctactcacgtatcgaccctagcgtcagccgcaggaccgcacgagcggatcggctatccctcgggcgctacctcaccgagcgccgtcccagatgacgaaagaccagcagggcctgcgtcggatgcctcgatggtgtcgagccaggcgtcacttgcggcaactcgtgcggcctcgtcggggatcggcaccaaccgcgcgagcacgagataggcgacggccgtcgcaacgaggcccacgatccaagaaatgtcgaccccaccgagtgcgcgcgcgacgggtccggtgtagctcacggggccgagttggcccagcaccatgaacggaacctccgacgcaaagccaatggcgtacgcgatcaagccccgagcactccaggcaccgtagatcccagttggggtaaacagatcacgaatggcgtagtgaccacgtcggacgacgaagaagtcgacgaggttcgtcgccgtccacggcacgagcaggtagagcatcagcgtcagcgcggtcgcgacggtgttgacggcgttctgggtgatgaactctgcgatcgcgaaccagaccaccgtgagcacgaccgtcacgccaaggcgccaacgccgactcggcgtgatgctccgcacgctgtcgatggcggtgagcagcgtgagcgagccaccgtaggcgttcatccccatcgtggccacgagtgccgccgcggagaggatcgccgtcaccgatccgagtcccccgacgacaccgttgccggcggcacggagtgccgtgaggccgtcttgggcgttgagatgcacggccaaccaagcacccagcgcaatgagccacaccgcgctcgcggaggcaccgaagaagaccgaggcgatcacccgacgcgtcggcgtggacaccgggagatagcgcgagtagtcggagacgtagggcgcgtaggtgatgttgtaggccgcggacgcggagaactccgccatgaacccgacggtcgtgaagccgaggtgggaactcgccacgtggctgccgtgcacggagccaagcagcaccgcgacggacacgatggccatgaaggggaacgacgcgatgagcagagcccgaaaggcacggtggacccagtcatggcccaagatggcgagggtggcggcgatcagcgtcgagcccacggcgacgacctcggcattccagccgtacgcgctcgagagtccatcggccaagagcacctggtcggtcacgttgaaggcaacgtaggtgaacagtgccgcaaacagcacgacgatcacgccgcgatagccgaactgtgctcgcgactggatcatctgcggcagacccaagcgcgggccctgggagccgtggaacgccatgaagaacgtccccacgacgatgcccaacgtgccagcgaggatcgtccaaccgaccgacaatccgagtcctggcccgatgaagccgatcgggatcgtgaagtactggaagttaccgaggaaccacagcggcgcctgatgccacagcttgccatggcgctcccgagtcggcacccagtcgatggagcgggcctcgatgatgggctgcgctcgcgaggcgtcggaatccatggatcgatcctatcaagggcagcatccacgtgaaggcaaaccgagcatcattcgttatctctcacgcaacgatggcccgcgcgtcacggcggcgcgggccgtcatcgcccgccgatacagcgcaggccgacgacgacgccaggcaggccgtgcatcgagggcgtcggtgagcgcctggtcgacgacgagggtggcgacgccaccaaggggcgctaccgccaccgtgccgagcccgtctcggccgccaggagcgacgacgccggcgatcgtggggcccgccccaccgggctcgacagcagccaccgcgacgacgagatccgactcgatcgcccgtgcgagcgagagtcgaaacggcgcacgcggatcgccgtcgcgaggcgcgagttcgctcgtggtgagcgggcgaagcactggggcaagctccgggtcgacccggacgatactgacgaggaggagccacgcgcccgcctcggctgcccttcgggcgatgcgccaatcgaggagaccctcggccccggcgacggcaaccccacccggaaggacgacgggagcatcgttcggggcagctcgcaggtcgctcgccgtatcgagcactcgtcgctcaccaccgggcatgtgcacgagcgcaacgacacgacagccagccacgcgcgaccacggctcgagccacccaagctcgtcgtcgtgctcgacggtgagcgccgggagcaccagcagctcggcggcgttcggctggccttcgaggatcgcacggaggtcctcgacagcgacggggcgcgcaagacgcatcgccccgacacgacgaccgaccgggatggccgaccatcgagcaccggctcgctccgccagcgccgctcgcgaccactcgccagcgctcgagaggagctcgcgaggcacgcccagcgacggtgcggcacggggccgcctcgcctccacgtcggccaggaccacccctgggccatcgcgtgaggcgacgatcgtcccgtcgggtgcgatgatgcagccacctccgccgaagcgcacgccgcgttcggtgcccacacgattggcgacgaccatcgtcgcaccgacatcacgagcgcgcacccaccacgccagcgcgggcgtgcgctcctcgggccacgccgtcggcacggcaaccactgccggatcgcgcccgagtaccgcgagtggctcgggaagatcgagatcggcgcagatgacgaggccgacgatggcgtcacccacctccatggtgacgcccggctcgtcgcctggtaccgcccacaccgtgtcgtcaacccacagatgtgcctttcggtaggtcgcctcgagaccctgggccgagacgacgacagcgctgttgtacagggagccatccggagcctgctcgacgatccccgcgaccaccgtggtcgcttcgcccgcgagcgcctcgacgatcgcagcaaccgtggggccgtcggcaacctctgcgaccgcgcgcgcctcctcgcgagtgagcagatagccggtcacggagagttccggcgccacgacgagagatgcgccacgagcaacggcggccgcgacgcgcgcttggagtcgctcccttccgtgcgctgggtcgagcgctcctgcagcctcgatgatcgcagcgacacgcacgcggacctcactcaggcgcgagtgcgcgcgtcgacgatggccgcgagcgcgatcgacgccgcgaccgaggcgttcagcgaggcgacggtcgccgccaacgggatcgccgccgtgacgtccaccccgcggcggaccaacggcgcgagtccgcgcccttcggcgccgacgacgagcgcgaggcgctccgtggcgagggtgagcgagaagacgctcgtcgcggcgtcggcgtcgagcccaacgctccacaccccgcgcgctcggagtcgacgaagcgcggccgggatcgacgacaccagagcgaagcgcagccactcgaccccaccggctgcgaccttggtgacggtcggtgtgagcggaacgctccggtagcgcggcaacaccacgccgtcggcgccgaacgcggcggcactgcggagcaccgccccgaggttgtgcggatcctcgagatgatcgaccacgacgagcagcgaaccgtcggcgagaccgtcgaggcccacatcgaccaccgggtcgcagtcggcgaggaccccctggtgcacctcggtgcgcgcgacgcgctcgaaacgttctggcggcaggagctccacggggacgccagcgcgcgccgcggcctcgatgatcgcctccggctcacgcccggcctcgacgatcacgcgcctgacgcgacggcgcccagcccggaagcactcgaggaccgcgcgcctcccctcgactcgttcaccgccgagcccacggccaccacgagggtgcacatcagtcctcggcatcgaccacgccttcgagcagcacgaccgcgagcgcagcgacgccctcgccacgaccgagcgcaccgatgccttccggatgcttggccttgacgagcgctggcgccgcgacgacaccctcgatcgtgcgggccatccgggcgagatacggcgagagcttcggtgtctcgcacacgatggtcgcgtcgacctgcacgacccgaagacctcgaccccgcacgagccgaacacagcccgcgagcagctccaaggagtcggctccgcgaaaggccgggtcggtgtcggcatagaggtcgccgatgccaccgatcccagcggcgccgagcatcgcatctgccaccgcgtgacagagtgcgtccccgtcggagtgtgcccgcaggccaggcccaggcaccgtcaccccgccgagcaccaacggccgtccgggttcgtcggagcgcggatgctggtcgagccccaacccgacgcgcacaccgatgagatctcgcaggtcgcgtcgcgtcgtgaccttgcgcgcagacggggacccgtcgaccacctccacggtccagcccagctgctcggcgacgaccgcgtcgtcggtgccctccagccctgagccgatcaccccagccagcacgccgtagtggaagccctgcggtgtctggatcgcgcggaggtgggctcgctcgagcgtgcgggtcacccgaccgtcgcgcacctccttgatcgtgtccgcaacgggaagggccgggacgacgaccgctgcaccgttcgcaagacgggcgatgaccctctcgaacagcgacaccggtgccaacgggcgtgccgcgtcgtgcaccaggacgaactccggcgcgccctcgagggccgcaaaggcccggcggaccgactcagacctcgtcctcccgccgacaaccgtcgtcgccccttcgacgacccgatcgacctccggcgggagcgccacgatcacctgcgacgacaccgcgcgcgcggcctcgaccgcatgctcgaccagcgatcgattgccgagcgcctcgaactgcttcgggccaccgaaacgactcccttgccccgccgcgacgacgagggtggcgaccgccaccgcgccctacgcgagggccttgtcgagtcgagcctccgcttcctcgggcgcgacgtcgagggcgaaggtcagctcggagaccaacacctggcgcgccttggcgagcatgcggcgctccccggccgagagccccttgtcgtgatcgcgcagcgtcaggttgcgcaccacctcggcgacctggtagatgtcgccggacttgaccttctcgaggtggttcttgtagcgccgcgaccagttcgcgggcatgcgcacgtccttcttccccagaacggcgaagacctcttcgacctcttcgtcgttgatcacctcgcgcaggccgacctcgtcgacggcgtcgacgggcaagcgtacggtgagatcgccataggccaccgtgacgacgaagtactccttggcctcaccgaaggcctcgacgacctcccgtccggtgatcacagcggcaccatgctgcgggtagacgaccttgtcaccgacgtcgaatggcacagcttcctcactttcccgacgccctcgtgcgcgtcgggctcactcgtagcgcttccagtataccaggtcgatcagggtgaaagtccaggtcacctggctattcgtaggacctgaggtgagccacgaccgccttggcccagtcgggatccacgccagccacggtcgccagctcgtcgggttccatgctcgccaacgcatgcagcgaaccgactcgctcctcgatacgcgcggcgatcgatcgcggcagccgcggcacgtggtgcagcagcctggagcccttcgacggcaggttcacgccgaggagctcaccgtcgtagagatcctcgtgcgcgagcgagacgcagcgcgcgcgctcggcgacgtgacgcgccagctggacgacgttcatgagctcgtcgagatccagcgacgccaagagctccttgatgtcgcgcacctcgccctcgtcgcacacccccagaaagtcccggaggacatcggtgtagtcgcggtcgaagtcgagggtgatctcggccgcctgcagtgcgacgaggcgtccgtccgcaccgagttcgaccagatagccgtcgatctcctcccgaatccgacgcaccatctcggctcgctgcagcacgaagaccacgtcgcgcaagctgacctgctcgcgcaactcgagcccgttcagttgctcgagcacctggtcgaggcgcccccgatagcgctcgagcgtcgagagcgcctggttcgcgcgcgagagcagctgggggatgggctgcagcgtgcgcttctcgcggcgtcgatacacggagatcaccgacagctcctccgagaccgccacgaccgtagcgtccacgctctctgccacacgctcggcggtacggtggcgcgtgcccgtctcactggtcggaaggcgtggatcgggcacgaggtgcacgttcgctcgcacgatctgcgacccgtgcgaggacaggatgatcgcgccatccatcttggcgagctcgaacagccgctgtggggtataggcggcctcgatgaggaagccgccggtacagagctcgaggacctcgggcgaatcgcccagcacgacgagcgctcccatgcgcgccagcaagatgcggtcgagcccttggcgcaggggcgtccctggagcgacgctccgcagtgcctcctcgatgcccgcgccttccacgctgctccctccgtcagacgcaggaaccggcaccccggtcgcgctctcgaagcctcgtggagcgcgccgtgcgacagcgcgctccaccgactactcctgtgggttcgagccggccagctccatcgggggcggctcgagtccctccatcacccggaagacgatctcctcgccctccacatcgacgaccaccatgtcgcccgccttgaactcttggtgcaagaggcgctcggcgaggggatcctcgacgagtcgctggatggtacgccgcagcggtcgagctccgagttctcgatcgtaaccacgatctgccaggaagcccttggcggcttcggtcagctcgatgccgatccccttcgcctggagctgatcttgcacccggcggaacaagaggctcacgatcgccatgacctcgtcgcgacgaagctcgtggaacacgatcacctcgtcgatacggttcaagaactccggcttgaagtgcgtcttcagcgcctcgttcagccgcatcttcatccgctcgtggttgacgtcctccgaggacttcgcgaaaccgacctgggcgcggtgcaggtcctgcgtcccgaggttcgacgtcatgatgaggatggtgttcttgaagtcgaccgtgcgaccctgcgcatccgtcaggcgaccgtcctcgagaatctggagcaaggtgttgaagatgtcgggatgcgccttctcgatctcgtcgaagagcacgacggagaacggccgacgccgaaccgcctcggtcagctgaccaccttcgtcgtagccgacgtagcccggcggcgcaccgacgaggcgagcgaccgtgtgcttctccatgtactcgctcatatcgagctggatcagcgcgtcctggtcgccgaagaggaactcggccagcgtcttggcgagctccgtcttgcccacgcccgtcgggccgaggaagatgaacgagcccgatggacgacgggggtccttcaacccagcgcgcgtacgacggatggctcgagacaaagcgctgatggcttcttcctgccccacgatccgatggtgcagctcgtcctccatgcgcagcagcttggaggtctcttcctcggtcagctggttgaccgggatgcccgtccacatcgcgaggacctcggcgatgacctcctcgtccacgacgccgaaacgctcatcgccctcgcgcttccacgccgcctcgagctcggccttgcgcgagacgagctcgctctcgcgcgccgccagccgcttggcttcgtcgaagttctgacgggcgatcgcgccttccttgtcacgacgcgtgcgggtgaggtcgttctcgacctgtcgcaactcgggcgggctggtgacgcgcttgatgcgcagccggctccccgcctcgtcgatgaggtcgatggccttgtcgggcaagaagcgatccgagatgtagcggtccgccatgttggcggcggccaccagcgcttcgtcggtgatggtgacgttgtggtgggcctcgtagcgctcacggagacccttcaagatctcgaacgtgtcctcgatcgagggctcgccgaccttgatcggttggaagcgccgctcgagcgcagcgtccttctcgagatgcttgcggtactcgtcgatggtggtcgccccgatggtctggagctcaccgcgggcgagcatcggcttcaggatcgacgcggcgtcgatggctccctcggccgcaccggcaccgacgagcgtgtggatctcgtcgatgaagaggatgatgttctccttggtgcggacctccttgaggaccttcttcaggcgttcctcgaagtcgccccggtaacggctgcccgccaccagcgcaccgaggtccaaggtgtagatctgcttgccgcgcaaggtgtcgggcacctcgccagcgacgatgcgctgcgcgaggccctcgacgatcgccgacttgccgaccccaggctccccgatcagcaccgggttgttcttctgacgacgcgagagaacctgcatcatgcgctcgatctcgttgtcgcgaccgaccacggggtcgagcttgcggtccctcgccatctgcgtcaggttccgaccgaactgatcaagaatgggcgaaccaccgggtgcgtcttgcccctgggacggtccggccccttgaccgaccgtggggcgaccctcggtcgacgacaggatctgcatcacctgctggcgcaccctggtgaggtcgacgccaagcgcgagcagcaccttggccccggtcccctcaccttcgcgcacgaggccgagcagcatgtgctcggtgccgatgtagttgtgaccgagctggagcgcctcgcggagcgagtactcgaggaccttcttcgctcgaacggtgaatgcgggggagttcggcgtcggccctggcgacggctcggactggcgcgtcacctcctcgcgcagctggtcgagtgagacacccagcgattcgagcgccttggctgcgatcccttctccctcatgcacgagacccagcaagatgtgctcggtcccgatgtagttgtggtggaggagcttggcctcctcctgcgcgagcacgagcactcgacgtgcccgatcagtgaatcgctcgaacaagtctctcgcctcctcgatcggcacctccgggttgaggacccttcgactccgatctggtacctggttccttcattctacccgcaacgctcaacatcgctcgaacatgccttgacgtcggcatcggcagcgccaggctgaaccaccgagttgctccagtctgccacggacagctgggctgtgtctgtgggcaggctcgacagttcgctcacggagtactcacgagaccgccctcgatgtcgccgagcggcagccatcgccgggcgcgtgcacgaggaccaaccaggtcgcattgaccgcgaacacgtgccagatcgcaccgaggtgcgcctccaaccacccgaccgcggcctgcggctgggcaagcaggctgcgatcgaccacgatggagcacacgtcgtggcgggcaaggtaccccggcagctcgtgggccgcccgcgatgccagcgacgcgtcgggttgggtcggttgggccacgctccagagatagccgaggacggcggagtcgttcaaccgagcgatcgtctgcgcgggcaggcgtgacacatagccctcgggcgtcggggtcccgatcacggcggcctcgtagggatagagcgcgatcccagctgcccaggcactctgggtcgggatgaccaccggcacgtagaacgtggtgccaccgaccgctgcgatcccgcggggacgagggaccagcgggagcgcagtgtcggggaacggcgtcggcgccgaaccgacccagagcgccaccgcaacggccgcgacgagccccgcacgcaacagccggcggtggcgacggcgcccgagcgcaacccagacccactcgagcaccgctgcgccgagcagtgccccgaacagcgccgtgagcaccgcgagacgctccggcagggtgtcggacacgaacgggatcgcatcgaagggcaggtacggaagcgggatcggcgtcagcaccccatcgacgtggaggtaagggcccatggacgccagagcgaagatcagcatggcgagcccgagtggcaggatcaaccgctcgagccgaggcgcgagcggaccgtgacggcgctggcgtacgacgatcgcgacgccaccgacgaggccgatccagggaccagcgccagggaagcccgagccgtccgcgaggttcggggcaaggtgccacacgggggcgaggaagtggaaggcgccccacggatcaggcacaaagaaggacagcgcgtcgaccacccacggggtcgagaagggcgtctgcgccccaccgtgaaccgcgagcggactcagcaggagtgcgtcgaggagcggcgcgacggcgacgacggcgacaacaccgaggacgagccagccccgccaccacgccacgagggtcgcgagacgcctcgacgcgagctgcggatgcacgaaccagagcaccacgatggcagcgatcgcgtagatgccgtagtcgtagacgctccagaccacgagcgccaggagcgcgccgagcacaccgaagcgccagagagcgggatcggcacgatcgaagaggtcgaaggcccaacccaccaccaacgcgagccctgccccgtcgaccaggttgagatgcccgagcatctggcccatgaagaacgggctcgcgaggtagatcgcaccggcgacgagggccgcgccgcggccgagcccgacgcgacgcgcgcaccacgccgcagcaccaccgtcggcgacgagggacccgaggagcgcgaggttgtaggcgaggaccggcgtcgcaccgaggtgctcgagcacgcccgcgacgatggcggcaggcagcgcgagggtggcccacgcgaggtccgcacccctcggatagagcacctggtgcgtgaggaagagcccgtgggcaccgaccagccagcccgcgacccagtggatgtaccacagaaactgcggcgagtcaccaccatcgccgatcaccctcgacgtcaggtgagcgccaccgggccagctgagcaggagcgcctcggcaccatagatcacgacgcacgccgcagcgaaggcgagctgtgcccacgttgagccgcgctcgcgcgcttgccgtgtcccgatccgtgccgccgtcgacgacgcagacacggtgtcgtaggctgacattcgcgagatactaccgaacaccacggccgctggcacgtggcgcggggaccaaggacccggggccacacggacccgacgggctctagggtggacgaggtggagcatccgttgccgctcggtgagccgtgggcgggtccgtacctccaggcggtcgaggaagggctgcgtcgagcagcgaccacgaccgatccggacatcacggcggccgccctgcacctcatcatggccggcggcaagcgcgttcgaccgctgattgcgctggcgacggcccttgcactcggcgaggtcgcaccgtctcccgacgaccctgtcgtccgcggcgccgtcgcggtcgagctcgtgcacctcgcctcgctctatcacgacgacgtcatggacgaggcttcggagcgtcgtggggtctccagtgccaacgcccggttcggcaacctcatcgcggtggtcaccggcgacttcttgttggcccgcgcggcgggcatcgcagctcgcctcggtgaagaggtagccgcggcgctcgcggacacgctggccgccatgtgcgaggggcagatcctcgaggttgccgacgcgcaccaactcacgcgcacgaccgagcgctacctcgcgaccatcgcgggcaagaccgcgtcgttgatggggaccgcggcccgcatcccggccatcgtcctcggacgcgaccaagcgatgctcgatgccctctcggctgctgggaccgcgctcggcatgctgttccagctccgtgacgacgtgctggacctcgtcgcgacccgcgagcaactcggcaaggagccggcacaggatctggtggaggggatctacaccttgccggtgatcctggcgctccacgaccccaccgtgcgcgaggccctgctggacgtgctcccacgagccgcagaccccgaaccacgagccgtcgcactcagcctggtccgtcgcagcgacggcatccctggcacgctcggccagatgcgcaggatcgaggccgatctcgatgccgtgctcgccgacacgctcggcatgtccgattcgtggttcggtcggctcgctcgcgcgctcgtcagctcagccgagcacctcgcagccgcggtaccggcacccagcgcactcgcctgagcacccccggcccagtttccaccggtcccaccaagagcatccgcgcatcagctcgcggcgccagagctccgacgtcgccgaactcacggccgggcatacccccgtcggaacgccccgtcctcgggcgcccagctcagtcgagccgacgagcgagcgagccgaccgacgcccggggtgcgccggcgacgagagcagccccgtcacgcggtccatgcgccgattcgctccgcgaccagcgccgctcgtctcctcacgccgtctcgtcggatgcgccatcctcgtcgacatcgctctccgaggatcccgcctccggtcgcagggtcgggaagagaatgacctccttgatgtggcgctgccctgtgagcagcatggcgagccgatccacaccgaggccgagaccacccgtcggtggcaggccatactcgagtgcccgcacgtagtccgcgtcgtaggccatcgcctcgtcgtcaccggcacggcgctgacgagcctgctcctcgaagcgagcacgctgctcgtccggatcgttgagctcgctgaaggcgttgacgagctcgcggcccccgacgaccagctcgaagcgctcgactcgccccggtcgcgaccggtgacgacgagcgagcggcgagacggactcagggaagtccagtacgaacgtcggttcgatgagtcgcggttccacgagctcctcgtagagcgcgaccaacgcccgccccgcctccggctcgagcacggcaagatcgaaccgtcgagcgaggtcgagcagtcgtgcgggctcgtcgaggctgacccgctcgccgaccgcctccgagacgagatcctccatcgtcgccgcgcgaaacggcggggtcagatcgatcacaccgagctcgttctcgccgcgggtcgacccgaagacagcgcgcgctgcgctcgcgagcagcccttccgtgagctcgcgcatcgcgtcgatgtcgccgtaggcctggtaggcctcgagcatcgtgaactcggggttgtggcgaggcgagataccctcgttccggaagtcccggccgagttcgaacacacgctcgatcccgccgaccacaagtcgcttgaggtagagctcaggggcgatcctgaggtacaggtccatgtcgagcgcgttgtggtgggtcacgaagggtcgagcggccgcgcccgaggcaatgggctgcaagatcggcgtctcgacctcgacgaagccccgtgcgtcgagttcgtcgcgaagggctcgcacgagtcggctgcgggcgaggaagcgctcgcgcaccccggggttggcccacagatccacgtagcgctggcggtaacgcacgtcgggatcgcgcacaccccgccacttgtcgccgaacgatcggcgcgcatgcgcaagaagctggatccgatcaacgaggacggagcgctcgccggtcctcgtggtcgcgatcacaccgtcgacgccgacccagtcgccgagcaccagggaatcggccagcgtcgagaacgcctgggtgcgatcggcgcgcagccagagctggatcgctccgctcgcgtctcgaagctccccgaacgccatcctcccttgccgcctgaggcgcaagatccgtccggccacccggacctgctgatcggtgacggtgtcgggcgcgagaccctcgctccgccgtcgcacgacatcgacgggctccaccccgccaaaggcgtacggaggcacgaagagcgctgcggtctcagcgtcgggcgctcgacgttcatctgcgctcatcgtccgtcctctccaccacgccccagagacgcaaggagtctaggctcgagcccgccgtccctggttgcgcgcccagacgagccgcagcccgtggagcgtcagccacggctcgatatgcccgacgacgggcacctcgcagccgatgacctcgcacagcccgcccgtcgcgacgaccggagcctcggctccgatctcggcacgcatgagctccacgaggtgggtgacctgcccgacgacaccgttgatcaccccggactggatcgactccaccgtcgaacgaccgatcgccgccttcggccgccgtagctcgaccttgcgcagcgccgcagcacgcgccaccaacgcatcgagcgcgacgaccacccccggcgcgatcgcaccgccgaggtaggcaccgctcgcatcgatcgcatcgacggtggtcgcggtgccgaagtcgaccaccagcaccggcgcgccatagagctcgaccgcggccaccgcatcgaccacgcgatcgggaccgacctctcgtggatcgtcgtagcggatcgggatcccgacccgcgtccccggtccgaccacgagcggacgaagcccgagatgcccctcgaccatgtccacgacgcttcgggtcacgttcgccgccgaggatgcaacgatcgcgccgacgagcccaccgacgaggtggtggcgatcgagaaaggtctcgacgaggatggcggtctcgtctgccgtgcgatcggcgcgcgtcgccagccgaaggtgcgcgacgagtccctcctcggccgtcgtcgccgcagcctcggtgtcgtagacgccgatcacggtctcggtgttgccgacgtcgatcgtgaccacgtgctcagccatcggcgcctccgatcgcacggttgtcgatgagccggacaccctcgacgcgccaggcagcgagcacgcgagacgcgggcgtgagggcccgcgtcggctcgagcaggggcggttctgcgacctcgacgtagtcgagatcgacccccccgagatcggcgagcaggcgagtccggaaggcggcggcggcgtctcccacacgagcactcgcgcagtgacgcgcgaggatctgggcgacacgtcgcgcctcgcggagcccgaccggcgagagccgccggttccgcgacgacagcgcgaggccacccggatcgcgaacggtctcgaccgcgacgacctcgacagggaggtggagctcggccaccagccggcggaccacgagcagctgctgaaaatccttctcgccgaagtaggcacgagtgggagccgtcaccgtgaacagcttcgtcacaacggtcgcgacaccgtcgaagtggccaggacgcacggcaccctccagccgctcggtgacgcccccgacgcgcaccgagacgaggatcggactggggtgcaactcctcgacgacgggtgcgaacacccagtccgcaccggcgtccacggcggcacgcacgtccgcctccagggtccgcggataggccgcaaggtcggtggggtcgtcgaactgcagcggattgacgaagacggagacgaccacgacgtcgtcgcgctcccgcgctcgccgaatcagcgcctcgtgcccctcgtggagcgcacccatcgtcggcacgaggccgatggcagccccggcgtcccgggcaggtgcgagcgcctcgcggagcccggcgacggtcctgatcagcgggtccacgcgcaccccgcggcatgagcgacgacgggcggtcgctcgaggtgggccaacgatccccccgccaacgaccgcgcgagggcggcgtcgaggtccgcgagcggccacagcacgaacgaccgaccgaacgcgcgcggatgggggacgacgaggcgcggaggcgagctcacgacgacgccgtccatccacaccacgtcgagatcgagcgtccgaggagcgttcgggacgctgcgttggcgaccgtggcgcgcttcgagcgcgagcaagtcgtcgagcaggcgaaacggcgaacggtccgtgcgcagctcgcacaccgcgttcaggtaccgcggttgcgcccccggcccgccgaccggctcggtctcgtagaggttcgacaccgcgacgacctcgccgatggcgccgagcgccgcatcgagggtccgcgctcggtcgccgaggttggcgccgagggcaacgaaagcgcggcgcctcacgagcgctcaccgccatctcggacccgcgtcacgaccacgtgcaccgtggccccggccagtgccagtgggggggcgagcttggtcgcacgaacggtgacgcgctcgagctgcgcccagccgagcgtcgcaacgatggcgtcggcgagccgcgccgcgaccgtctcgaccaaggcacacggcgtcgcaaggacctcgggcacgaggcgatcgagcacgctgtagtcgacggtggtggcgaggtcgtcgccgatcggctcctcggcgacgacgagttcgaccgcaagctcgaccggctgcggcagggaccgctcggcctcggtcacgccgaggtgcgccggttgcaccatgccctcgaccgcgatggtcaggcccactcgcgcgccgcctcctccatggccgcagcgagacgcaggtactcacggatcggccgtactcggtgcacccgcaccacgtccgcaccgtgctcgatcgcccagatggccgcggcgaggctctgctcctcgcgctcgagcgggggcaacgcgggctcggcacgactgagctcggccagcatgctcttgcgcgagaggccgacgacgaccggtgcgccgagggacgcgatttgacgaaggtgcgcgatcagcgccaggttgtgcgcgaccgtcttgccgaagccgatcccgggatcgaaccagacctccttcacgcccagcgcacgcgcctcgtcacgtcgctccctgagccacgccgacacctcgcccaccacgtcggtataggtcgggttgacctgcatcgtctgcgggtcaccctgggcatgcatcgcgatccacaccgcaccgacctcagccgcgaccggtccgagtcgaccgctcacgtcgttgacgatcgtcgcgcctgcctcgaccgccgcccgagcgacggcgggcttgaccgtgtcgatggagacgaccccgtagggagcgagcgccgccacgaccggcaggacccgacggagctcctcggtctcgggcaccggcaccgcgcccggccgcgtggactcgccacccacgtcgacgatgtcggccccctcggcgaagagttcgagaccgtgctcgatcgctctggccgcatcgaagtagcgaccgccgtcactgaaggagtcgggcgtgacgttgacgatccccatgatccgagcgtcgcgacgctcgctcatcggggcggccgtcctcgctcgagctccgcgagcgcgttggggctgcccacctccctgcccgccagcgcctgggtcgtcacgatcacgccctcgcgtcgcaccccccggatggcgatgcaggcgtgctcggcccgaacggtgacacggacgagacgcgcccgggccgccttggcgatcgcatcggcgatctcctgcgtcagccgttcttggagctggaggcgacgagcgtgccgctcgatctctcgcaccacggccgacaggccgaggaccccagctcccgggagatactccaccgagaccgtgcccgtaaacggcaggaggtgatgctcacacagcgaggcaaacctgatctcgtcgaggacgacgggagcccgctgctcgggcgcgaaccgcaccggatcgtcgggctcggcccgatacccgccgagcagttcggccagtgcctcgaccacccgctccggggtgcgcgtgcgcacgtcgtcggcgagcgtcgcaccgagggtggcctcggcccacgcgagcagcgtgtccacggccgcgcgagcgtcgtcgttcgtcggtgcgctcatacgtcctcccgataggtcgcgatgaacgggaggttccggtagcgctcggcgacgtcgagtccatagccgatgacgaaggcgggcgggatgtcgaagccgacgtaggcgatgggcagatcgcctcgaccgtcgtcaggcttgcgcaacagggcgcacacggcgagcgacgccgggttgcgcgaggcgaggttcgtcaagaggtagcggagcgtgaggccgctctcgacgatgtcttcgaccacgatgacgtcgcgcccttcgagctcgacgtcgaggtccttgatgatccgcacgacacccgaggtccgcgtggcactgccataggaggacaccgccatgaagtccaccgcgaccggcagctcgatcgctcgtgccaggtctcccatgaacacgaacgcacccttgagcacccccacgaggaacggtgcgcggcccgcgtagtccttggtgatcgccgctccgagctcgccgacgcgcgcacggaggtctgcctcactgatcaggacatcgccgatgtgcgggtcatccagcgaccacgtcacgggcgcctcccttcggactcgagcccgagacgggcgatctctcgcccacctgagcttaggacgagcgacgagcccacgcgtcgcacgtcgaggtcgctcgggagtgcatgcgctcggcgagtaccatcggcgacctggacgagcgcacgccgatgcgccgccgacagtcgaaggcctgtctggtgtcggacccacgtcgcgagctgggtcgtcgccggcgcgagctccgggtagcgcgcctgcaggcgcacggcctcgcgggcgtgcgccgccgcgcgcgccagcagcgggacgacgtcacgctctgcgatcgcggcggcgagcgggagcagctcggtacgcacgcgcacgcgccgaaagcgtacgtcctgattcatgggatcgacgagcggcacgagtccggcggcctcgcagacgcgcgcgagctctgagcgccgaaggccgagtgccgggtggagggggccgggctccatggcgccgataccgacgagcccgctcccccgcaggagattcagcagcaccgtctcggcttgatcatccatcgtgtgtgcccgggcggcgtccccgagggcgccgaggcgggccgagcgcgcgcgcgcctcgaggttggggccagggatcacgcgcacacggcgctcgagcaccgagatcccgagcggagcgagctggcgggcgacgtcggctccttctcgggccgagcccgggcgcaggccgtggtcgacgtggatcgcgaggacccgcttgccaccgaacgccagcagcgcagcgagacccagcgagtcggcgccacccgagacgccgacgcggaccgggtcgtcatcgagaggccacagccgctcaccgagcgaggcgagatcgatgccgagctcacgagctcggcgctgggcagcctcgacccacgacgggctaggccgcaccgaccctcgccagccacgtctctggcgcgtcgagctcggcaagcgttgggagcgactcggcgcgttcgaacacgtcgagcgcgctgccaggccgttctgcctcgatgcgctcaaagaaccgacgaccgcgctcgtactggcgagccttcgcgtcgagtccgaggagtcgcgcgacgatgcgcgcgagaccccgcgcactgcgacgctggtcgacgacacgagccagctcgtcgtcacccggcacggtccccgaggggagggtccgcatgacccagtccgcgtggccctcgatgacgctcatgatggcgctgacacgagccaacgaggcagcagcacgttctgggaggaccagctcgagtggcccgagctccccgaggcggcggtcgccacccaaccagctgagcagcgaactcaccgcatcgaccggggtcgccggtcgcgcagcgatgacctcggcgagcgatgcgtagagcgtctcgagcagccaggggcgcgcgaagaactgcgcccgatgggcgagttcgtgcgagagcacccacctcgccaccgtggcgagatccgtcccagcccctgacgcgagatgctgggcgttctggcctaccagcacgagcaggggctcttcgtcgccgccccccggcacgtactgccccagaacgcgaggcgagagggccgcgagcaccgcgccgagcatggctccgctcacctcggccgcaccagcgggtaccccctgcgggtacaagcgaccgatcaaggctgcgtaggaacgcgcattgtggatcgcccacgcgcgccgtgacaggttcgcgaccgcgagggtctccgttccgatctcgagcccacaacgagcctcgacgatgggggcgagctctgccaccaggccaatcagatcgagaggcggcggcgctgtgtccgggacgagcgctcggatcgacagcgtcgccacctggtgcgacacggggctcaccatgagctgagccccgaggaaactacccggccttgcgctgaccgcgggttcgcgacgccccgatgggctgatgcgcgtagcagtacttggacttgttgtaaatggagagcgtcgtcgtacaacccggctccttgcacacgcgtcctcgctggtaggtgcggggtgcgtgcccagtcgccagaggttccgcgacgatcgtctcttcccctcggctcaccatgtccagagcaacccacgatgccccccgccctattcctgtcgcgcgtcggagacgtggcggtccttggccgattcctcaaggaggaccatcgcgagacgctcacgcagcgaggtcggaacccgatcgcgtgctcgctccgcgatgaccatgcgcagctcggcttcgaactcgaacgcctcgagacaggacccacagtggtccagatgggcttggagcttgtgccggcgttcgtcggtcagctcgccatcgaggaagaagtacagctggctgatcgcttcccgacactcgggcgtggacggaccccgagggtcgggctcgatctcatgacccttgtgctccggaccagtctcgctcgtcaccatctacgcctcggtctccgctgcccgctccgcacgagccagtcgcttctcgatcaacgcgcgctggagcgcgcgccttccccgatgcagccgactcatcacggttccgagcgggacgtccatgatgtcggcgatctcacggtagctaaaaccttcgacgtccgccaggatcacggccaagcggaactgctctggcagggcctcgagcgccgccttgacgtcggcatcggtgaaggtgtcgaggacctcctcctcggcgctccggcccgcgagggctgcctcgagaccgcccaggcggcgatagaggtagagctgctcgacctcgtcgaggtccgtctcgtccgggcgacggcgacgagctcggtaggcattgatgtaggtgttggtgaggatgcgatagagccacgccttgaggttggtgccctcctcgaaggtaccgaaggcacgataagccttcaggaacgtctcttgcaccaagtcctcggcgtcggccgcgttgtgggtcatacgcatcgccgcggagtagaggttgtcggcgtacggcagggcaagctcttcgaagcgcgcctgatccgccacgtcgcctcccgtcaccagccgagcccgggaggggactcgaacccctgacctgctcattacgagggagctgctctgccgactgagctacccgggcgccgagcgaccagtgtagccatgtgccggggtgggacgctcgagcacgagctcggcgagcaccagaccgatggagagcctcctcgcgagcgagccgctcgcgcgccgcaccgcctgaccccaggaagcatccatcgggttggctcgaatcgcgaccgcgagtccgagccgtaccaacgcctcttgcgtcggagccggcaacgagctcggcgggcgaagcgacgctgcgatctgggccggatgggcatgggccgcaccggtcgcgagcgcggcccaacgctcgagccacgtccccggctcgggaaccgacccgagcgtgtggacgagctcgagatcacgcggcacgagcgcgaggagacgcggcgagagctcgatgcccgcgtcggcgacggcagcctcgatctcggctgcgctcggaggatcgacctggacgcggacgcagcgcgacgccatcgccgtgagctcgggagggatggcgctcgccgcgagcaaccaccgcgtccgcggccccggctcctcgagcgccttgagcaccactggcgctaccgacgccatgcgttcgataccgacgaggccggcgatgcgccagcgatcggcactctggcgtgcgtgcgcaacgagggcacgaacgtcggcgatcgacggggtgtcactgaggatgcgcacgtcggggtggcgtccctcggcgaccgcactgcacaccgagcactccccacagccgccgcgcggacaggtgaggtactgggcggcgaccaccaccaggtcggcgaggccactcccccgcgcgcccaccagcagcacaccggctcgcgatgcatcgagcgcacgctcgatgcgctccgtggtgtgcggacgccagcgtcgaatgccctcagcgacgcgcgtcgtcatcgagcccgagctccgccatgatcatcgcctgcacccgagccgctaccgcgtctcgcgagccgttcgcgtcgacgagccgccatccccacgatcgcgcacgatcggcgtagcgcgcccggatctgctcccacgcggagcggccacccgcctcgaaccggtcgccggcgtcgaggccgagcggctcggcacgatcgaggacgaggacgagatcggcgaccggatcgccggtcaacgcctcgagggcccagatcgcatcctctcccaccttcgggccctggtagacgatggtcgaagggaagtagcgatcgaggatcacgtgcgtgcccgcctcgacggcggggcgcaccaccgttgcgacgagctgtgcacgggcggcagcgaacgtgagcagctcggcccatggtgcgagcgaccgcgtcttgaccacctcgcggagcgcctcggcagcggggtcgccacctggatctctcgccgtgaccacgtcgacaccgcgggcacgcacggccgcgaccgcgaggtggacctgcgtcgacttgccgaccttgtcgggtccgtcgaggaccacgagtttcccccgcgtcacgagccagatcccaagcgcgcacgccgctcggccaagagctccaccgccgtgtcgagatccaagctggccggatcgacgcctcgcggcaaggaggcgttcacctcgccgtcggagacgtaggggccgtagcgacccgaacggaccacgacgcgcgcgccggtgtccggatgggtgcccaactcgagcacgctggccgagcgaccgcgccgcttgggctcgcgaaagcgcgcgagcgcttcggtgagatcgatggtgaagagctgctcgggcttgtcgagcgagcgggtgtcgcgacccttggcgagatacggaccgaagcggccgttgtgcgcccagatctcctgctgggactcggggtcgaccccgaccaaccgcggcaaggacaagagcgcgaccgcgtcctcgtagctcagggtctcgacccgctgccctggcagcagcgatgcacgccgcagcgagcgatcgtcgccctcgccgagctgcacatagggaccgaaccggccggtacgcaggagcacgggttgcccgtcgagttcgccgagcacacgatcgccgagcctgccccgctcgagcagctcctcggcccgctcgagggtgagctcgtcgggagggaggtcctctgggatggaggcggtctcctcgcctgcctggaggaacggtccgtagcggccgacacgcaccacgaccggcgttccatccgcgcgctggccgatcgggatcgagttcacgtcgcgtgcgtcgatctcccccagtcgctcggtgacgagctgatggagaccgggggcaccgttgccccagtagaaatgcgcgaggtagggcgtgggctcctcctcgccgatcgcgatgcggtcgaggtcgtcctcgagacgcgccgtgaaggagtagtccaccagctcggcgaagtggcgctcgagcagctgcaccaccgcgaagccgagaaaggtcggaatcagcgcttgcgagcgtcgccatgcatacgagcgctcgacgagcgtgctgatgatctgcgcataggtcgacggccgtccgatgccacgctcctcgagcgcgcgcacgagcgatgcctccgtatagcgcgccggaggctgcgtctcgtgcccctggggctgggcacccgtcgtggtgagcgcgacaccagcggccagaggcggcaggtcgacctcgtcgtcctcgctgagttgctccgggtagaccgcgaggaaccctggatcggtgagcgtgcggccacgagcgacgaacgtcgcccgctcgatctcgcgaccgtcgatgcgaacctcgggcccgagcgcgacgtcgatcgtcgcgacggcggacatcccgcgggcgtcggtcatctgggaggccagcgtgcgacgccagatcagctcgtagaggcgcgcctcgtcgccgggagcctcccttgccacctcgtccggcgagcgccaacgggtacccgctgggcggatggcttcgtgggcctcctgcgcgttcttcacacgcgagcgatactgacgcggcgcgtcggggagtgctcccgggaagcgctcggcgatgagtcgacgggcttctgcgagcgcctctccggcaagctggacggagtcggttcgcatgtaggtgatgaagccctgctcataaagccgctgggccacggccatggtgcgctgcgcggagaagcgcagttttcgcgaggcctcctgctgcagcgtcgaggtcatgaacggcgcgtccggtcgtcgcgtgaacggccgctcggtgagctcgcgtaccacgccacctcgaccctcgaccgcttctgcgaccgcgagcgcgtgcgcgccgtcgaggaccacgacgcccgtggcgacgcgaccggtcgcgtcgaagtcgcggccggtggcgatacgcgcctcgtcgagggcgaccaggcgcgcggcgaagggcgcgggggcctcggcacgcgagaactcggcgacgacgtcgaagtagctcgctcgacgaaacgccatccgctcgcgctcgcgctcgacgaggagccgacaggccaccgactggacgcgaccggccgacagtcgcggcatcaccttcttccacagcaccggcgagacctcgtagccgaagagccggtcgagcacgcgccgtgtctcctgggcatcgacgaggccgcggtcgatcccccgtgtcgccccgacggcctcgcggatcgctcgctccgtgatctcgtggaacaccatgcgacgaacaggaacgcgaggggcgagcacctcgagcaggtgccaggcgatggattctccttcgcgatcctcatcggtcgcgaggaagagctcgctggcgtcggcgagcagggccttgaggcgcttgacctgctcgcgcttctccggagggatcacgtagagcggccggaacccgtgctcggtatcgacaccgagacgcgcccacggctccttcttcaccgcttgcgggatctccttcgccgagcgcggcagatctcgcacgtggccgacggacgcctcgacgacccactcgtcgccgaggtagcgccggatcgtccgagccttggtgggcgactccacgatcacgagtggctttggcacgaaccgatttgctcctcgctaggactcctggtgggccggctcgaggaactcgtagctcgggttcatcatcgcgagccgaccctggaactcccctaccgtacccgctgcgcggatcgtcgcaccggcggcgatccccggtacctggcgacggccggggaagacgaggaggataccaccggtggcgtcctcgagccgcgccacgctcatcggcatcccatcgagcgtgcgggtgcgcaccgccgcgatacgccccacgaccgtggcctggcgccgcggcgtgcaggccgagacaggcgtggtgccgtcggtgagctcgggcgccttcgtccccaacgtggtgcggcgggccttcgccgtgaccgtcgtacgggcactgcgcgtgcggactcgatagggtacgaggatggccgtggcgtgtggcagctccccgacgacttgggagatctgcaccgccgactggtcgtggagcagcgggccgaggatccgcccgtagacacggtgcgggatgatcgctgagacctcgacgtcgctgcctgatgcgaccgcatcgagcacgacctcggccgcgcctcgccgaaggcggcgatccgggcactcgacgagctcgagctcgaggttcgccaagcctgcctgctcccactcggctcggagcgtcgtcgcctcctgtgcatcgacgacgaggtgcacggcacgcagcgcgtcgggcaggagcagcttggcgtactggaccgcccgcgccgtggcgagatcgacgcgatcgacgaacagcaacaccacgtgcgtccgagcggccggagcctcacaggccgccgccaccccctcctccagggcggcggcctcgcgctcgaagcgacgacggaaccgcgtgaacatgaagaccagcagtgggacgacgacgacgaccagccaggcgcccgaggtgaacttcgtcacgatgaagacgatgtccacgatcgccgacaagatggccgacgatccgttgacgatcgcccgccggcgccagtggtcctccttgtggatgaggtggtagcgaaccatgccgctaccggcgatggtaaagccggtgaagacaccgatggcatagagggagatcaacgaattgatgttggagttcgttgcgacgaggagcacgatcgcgatcgccgcgacgatcacgatcgcggtcgagtagaccaaccggtggccacgctcacggaagcgccggggcaggaggccgtccgtcgccgcaaacgacgcgagcaacgggaatcccgtgaacgacgtgttcgcagccaaggtcaagatcgccgtcgtcgagatgtcgaggatcaccgtgaggacgtgaccgaccgaactttggccaaaggccgcctgcgccacctgcgagagcacggtcggcgctcccgagagatacggcacggcgtgggtcgtcgcagccaggccagacaccccgagaaagagcgtgccgaggatgacgctcatccagatcagcgtcacgcgagcgttgtgcacctggggatcgcgaaagaccgagaccccgttcgagatggcttccgtgccggtgagggctgtgccgccggaggcgaacgacttgagcacgatgaagacgctggcgccgacgagaaggccaccgcctggcttgccggccgggaacgcaccgggggcgatgatggcgtagtgatggatgtggccaaccagcgcgcgaaccgtgcccaccgcgatcatgagcagcatcgagccgatgaagaggaacgtcggcagcgcgaaggtgcgcccggcttcgcgcagcccacgcagattgccgaaggccatgccgatgacgaagacgacgccgatcggcgtgatgaaggggacgagcgccgggatggcggaggcgatcgcgtcgacaccggccgccacggagaccgcaacggtgagggtgtagtcgatgaagagcgatgcggccgcgatctgcgcgagccacaggccgaaggtctcgcgcgcgacgatgtaggcgcctcccgccttcgggaaggcccggatcacctcgagatacgaagccgccacgaagatcagcaccacgatgacgaggagcgacaccggcacgatgaggtggtaggcggcgatcccgaccgccgggaccaagacaccgaggctcgcctcggtggcataggccgacgaggacatgacgtcggacgagaggatcgcgagcgcggtcggtttgccgaggcgctccgaactcagctcctcgttgatcagtggtcgcccgagcagccagttcttcagccgatagctgagcttctcggggacctcgtagctctcgagggcagcgagcggtgtgggctgcgagggggtgaaggagcgcgcgaagcgctcggacggttcctcggacatggtcacttcctcaggcgacggttcgccgctagagcctaggtgacctgcgcccgcgggcagcttcgaaccacgagggctctggaccgcgagcctgctcggtcgcacgcgcccgcggactgtagacttcggccgagcggcctgggcgccgaacacagcgaggggttggggcagtggagtcggtgcacgtcatcgtcgtcgggtgcggtcgtgtgggtgcagagctcacccgtcgactgagcgctgaaggacactccgtcaccgtgatcgaccgcaacccagacgcctttcgacgcctcgggtcggcacgagcgacgaccatcgtcgggtcagggttcgatcgagacgttctcgaggccgccggcatcggcgaggctgctgccttggcagcggtcacgagcggtgacaactcgaacatcctggcggctcggatcgccagagacgtcttcgaggtgcccaacgtcgtcgcacgcatctacgacccccgtcgagcggtcgtctacgagcgcctcggcatccagaccgtcgcgaccgtgacctggacgacggatcaggccctcgcccgcctcttcccgctgcgcatcgagcgtccgtggatggactcatccggggagctcacggtggcggagatcacactgccccccagccggatcggcaaacccatcggcgcgctcgaacgagagggcgagctccgtgtggtcgccgtcgtccgacccggcggagcccgcctggccacggcagggctcatcggtcaagagggagaccgcatcgtcgtcgccgcgagccaacgcgccctggccgaactcggcgcctggtccaacgaagtggggagctagcaccatgcggatcgcgatcgtcggcggcggcaacgtcgggcgcttcctcgctgcggacctccagcaccaccacgacgtcgtcctgttcgaacgagatcacgagctggcggcacaccttgcttcccagcttcgctgcaccgtcgtcttcggagacggctgcgagctgtccacgctggcggacgcgggcgttggcacctgcgacgtcgtcgtggcctcgaccggcgacgacgaggacaacctcgtcgtctccctgctcgccaagcaggaatttgctgttccgcgggtcatcgcacgcgtgaaccacccgaagaaccattggctgttcaaccgatcctggggcgtcgacgtggccgtctcgaccccgcatctcatcagcgcgctcgtcgaagaagcggtcagcgtcggttcgctcgtccagctgctcgcgttcgacaactcgggcgcgcgcctcgtggaggtcacgctcacggcaacgtctccagcggtccaacggacgatcgcgaccctcgggctccctcgagacgcctcggtggtcgccgtggtgcggggagagaacgtgatcgtccctcggggtgaggtgaccctcaagcccgaggatcacgtgctctgcctcgtcgtcggcgagactgaggcggcggtgcgcagcgttctcatcggcgacgaggacacgatcgccgaggccgacgcggccacgccctgagctcgccctcggctcccctacggcaccggcgacaccggtaggctccacgtcatggaggcagcgttcttcgacctcgacaagacggtcatctctcgcgcctcgctgctggccttcggagctcgcttcttccaggagggcctgatcaatcgacgcaccgtcgcgcggagcgtctgggcacagctcgtctaccgctacctaggggcgaacgaacgtcggctgcgccggttggagcgttcggtcctcgacctcacgcagggatggcaccagagcgtggtgcgacgcgtcgtcgccgaggcgctcaccgagatcgtcacgccgctcgtctaccgcgaggcggtcgagctcatcaagctgcaccagctcgctgggcgcaaggtcttcctcgtctcggcctcgcccgaagagatcgtcgagccgatggcagccttccttggcgtcgatggccagatcgcgaccaagccgagggtcgacgaggagggcacctacacgggagagatggcgttctacaactacggcccctacaaggcagaggcgatggccgaggttgcgcaacgagagggcatcgatctcgctgcctcgtatgcctactccgactcctacaccgacctcccgatgctcgaggccgtcggccacccggtcgcggtgaatccagatcgggtgttggcacgcgtcgcgcgcgagcacggctgggagatcctcgagtttcgccaccacaccaaggtgggacgccaccgagtccttcgaaccgtcggtgcggtgggacttgggatcgccatcaccgcgataccggcgacacccttcctgcgccgagcgacgcggcgtcggcgaggagtcgagcctacggacctactcccgccacccctgaggcaatgaggccgtgcacgagacgcccaccactcatcggcctccacgaattcgtatcgtcgctgacaacccgggctcgacgagcgcgcgcgagctccaggccgtcgatgtgagcgcagtgtttccgcgcctccggagcagcgtcgctgcgcgatccctcggcgcggcatcgtgtttgccccacacacctgccgccaggtcgcaaccacgtcgagattgcgtcatgcgtgctctccccgacgctatccgaacccaccaccccgcgaccgctcgtccgacctcctgagtcgaattcctctgtcgccaccgcgagcatctccgtgctcgcaaggatcggccgttcacgaccgctcacgtcgctccctcagcgcgggtgcgaccacggatgacgaccatgagttgtacatgagagcggcaggcctcgctactagcatcgtcgcgcatgaaagccgaggagcgcgttcccccctcatcgctgcagaaggcgctggcgtggatcctcgagccacggcaattgctggcactgaatctcatcggctctctcgccgctttcgtcctcctcggcacctacgagtacttgagatggcgggacttcgacctcggcattgattatgccatccagaaccagggaacattcctcattgcgcatggacatcttgcccctcgtgacaccatctacggtggcggcttcgacaacaatgcgctgacctatctcttcatcgtcatcggccttgtacggacgctcgtaccgacaggcgtgatgctgctcgtactccaagctctcgctgtcgccgccacgtacctgttcatcatgcagatcgtcatccgagtgactcggagacttccactcggttggcgtggtgctgtcgtcatcggttccgccctgctcaccttcctcaatccctgggcgctcgaggctgtgtcctttgacgtgcatggggagcccttcggagcactcggactcgtcgtgctcctgtacggcatgctccgaagccagcgcacatacttctatgcaggcctcgcactcgcgctcctctcaggggccggcacgctgatcgtccttgctggtttgagcgtgggcttgctggcgacgaagtcgacccgccgatgggggatacgtacgacgatcggcgtggtgatcatcggcatcatcgcgctcctcaccggtgactccggctcctcattctcgtcgctttatggctatctcgcgtcctcttcaggcgccacacctggcgcgacggccatcctcagatcgatcgtcgagcaccccacgcgccccgtctcggtcctggtcagtcgctggcccgagatccgcgaactgatcggctacgcggggatcattggcttggcatggccgccgacgctcgtcgctgcggtggcagcggtcgtagcgaacggactgccacagaactcggcgttcctgtccctgacgcaggggttccagaattggcccgtcgaagcagtgctcgtcgccggtggggcgatcgtggtcagccgactggccggagcgcaccatgccaaccacgatgccctctcggagggcgatcgtgcgaacggccggtctcgatggcggctcctcggcggacgagccattgtggccctctggactgcggtgagcgtcgccatcggcatcggggccctcagcacagacctcgggatcccccgcagctggttcaaccaaccctacgcgagtgtctcggccctccgagtggcgcaacgctccatccctcgagacgccgaggtcgtcgccacgatcaatgcaatcgcgcgagtgtctgctcgcgctcagctctttcagcagatcgcccccactcaggcgcagccggtctgcgcagcggtcgtcgacgtcttgatcgaagtgccagggccctatgcggtgctgacgagccaagaggcgagccacgatgtgcgtaccctccttcgtgctccgggtcacacggtgctccaacaatcgggcgtggtgcttgtccagttcgggggtctgcatcccggtcgagaggcgctgatcgtcccgacggggcaggtggtcaccggaccgcaagcggcgagcctcgacgcgtcacagtgtcagtaggtcggccttccgacccatggagcgtccgactccggcaggagcaactccagccgtttggttcgccgcgactctcgccagcgaccgcaccggcgtcccccatctgctcgacggcaccaacgcgcagcgatccatacgcggtgcaggcacgagggggctcggcgttgccggacgactgctgagcgtgggccgctagggccacgtacggcacgcgatcccagcggcactcgatcccagcgaccttgccatcagtgtccgtcgcgtgctcgattgaccctcgcaggatgtcaacgccgccggcgcgaggcgtcgctcgacctgcgccggcgggttccgtcaaccctgcctcgagccctcaccgagtgaccatcgttcgcgtgcaatcgtcgacgcgcatgcaggttcgaaggggcacccaaggcgcgatacgcgctccggtgtcggggatcgagcctcctgacgcggctcgttggcccaggtctgtctccagagcaagcgtggctcgaccaaggcgctccctgctgatgcagcgacccgtctgttccaacgcactcacgccaactgcagtgcctggctcgattggatcgagggcatccgtgcccgggctccgcagggcatctcagcaggcacctcgcgacctgcgtcagcttgcagtcgatcgagaacgagcgaagccaccggacctccagccagcagcgactgcgtccgcacggctgatcacctctcggtattgctgtggcgtgcggccacggtcgcacacgggcccgaggcgcgaatcatcggcgacgacaacctcgagggagctcgcgctcgtgtcgggaggggctctcccagaccccgacgctcgcctcgcgcgaactcccgagggttgctgaaggacgagctcgccgcccgcgcaaggagtccgagggctgctggctccacgaacacgctccaccaccagtcaacaccaagcgccagctgtcacgcgcgccagcttcagctggacactgtcctgctcgaggtcataggaacgccgcgcgtcgccgcgcactcggtcggccgtggcggaccgcgccagcgggagccgatggtcccgccacaaggccgccggtcaccctcgcgacggtctcgcctcgtgccacgggcttcactaggtcaccgacgggcaggcagatctcctcaggcctgcgacgaccatgcgttgacgtagcgtcagccctcatcaccgttgggtcgcgtcagccccggggtaccgaccggagcgaccccgttgaggagaggcgaggggttcggtgacgccgacgacggacgagagtcgagatcaggcccgtcagcgaggcgccaggacgatcacggcgactcctgccgcgacgatcgctgcggcgacgactcgcgagcgaccgcgagcctcacccatgatcgcaccggccagcgcggcgatgaccacgctggtctcgcgcagtgccgacaccaccgcgagtggagcgcgctgctgcgcccacagcaccgcggcgtaggtggcgtaggagagcacaccagcagctgcccccaggccgagggagcggacctcgggccgagtatgcgcacgtcgcgctgcgagggccgacacggatgcgaccacgctcccttcgagcgcaaagagcagaccggcgtaggcgaagggatcggggctgtggcgcacgccgagtccgtcggtcagcgaatagccagcgatcgtgacgccggtcgcgagcgcgagcagcactgcccgcagaccatggtcgcgctgcggcctcgcaaggagcgcgatcccaccggcgaccacgaccacgcccgccagctcgaaggtggtcagtggctcgtggccgatggcgagggcgccgatggcgaccagcaacggcgcgctgccgcgcgcgagcggatacacctgcccgagctcgccagcggccaacgaggacccgagcaagaggttgtaggcgacgtgaatggccgaggagccaaccgcgaaggcgatcgccgccgctggtggtgggccgacgaccacgagcgaggcgatcccgatcgcggcaaccacggcgttgatggtcgcgacggcatcacgaggtgacggtgcaagcttggccagtgcgttccaggcggcgtgcccaacagcggccccgagcaccaccgcgataacgacgagcatcacaccagccacacggatacgtgcacatgcaaccagtttgccgctacactgagggcgtgaccatgccaacgctgtatctgggacatggagccccaccgctcctcgatgacgcgcgctgggttgccgagctgcgcgagctggcgagccgcatcgatcgtccgcagagcattctcgtggtctcggcccactgggaagctcgaccagtcgcgctgtcgtcggtcgtgggcgccccactcgtgtacgacttctgggggtttccggagcgctactaccgcctcacctatccggcaccggggtcgccagacctggctgcactggtcgaggggcacctcggggctgcgggccactccgtggctcgcgacgaaggtcgaggcctcgatcacggggcatgggtcccgctgctcgccatgtacccggaggccgatatcccggtgctgcagctgtccctcccgagtctcgatccagaggaactctacgccgtcggacaggccctcgcgccgctgcgcgacgctggggtcctcctcatcggcagcggcttcttcacgcacaacctccgtgcgctcggacaggttgggcaccctgacggccccccgcccgcctggtccgtagagttcgacgcctggggcgccgaagcgctcgccgacggcgagatcgatgccttgctcgacttcgaacatcgagcgccggctgctcggctcgcccaccctcgcaccgaacacttcgctccgctgttcgtgaccctcggcgcgggcgaagggacgcccgtcgataccgccatcaccgggttctggttcggcctctcgaagcgcacgatcgtccttgcggaggcaccgatcggcgaggtgacacagcacgtctgagcccacgcgcctcgcgtcgagccccgcgcaacgagcaacctccgccagcaagcccgctcgaaacctcgtgtccaacgggacgtcaccagctggctgatggacctctaaggtacctgtgtgcccggcggattcgtcgctgccctcggtctcgctgcgctcgccgcgagcgcacccacctggatcggctcgatcccagtgggtcgtggcgcggcactgccaccagaaggcatcccgtcaccggtccagccgctcggaggcatgctcgcccatgctcccgcgtgccggtggcgcatcgccgccggagagcaaggcgccacgacagccctcaatgcgctgatcgcacgcgtcgagaaccgactgacccggcctgcagcactctgtgtgtcagggacgttccgccagccgatcgtcgtcgagggcaagtggcgtccggctgcgctctggatcgaacctgcgcccggcaccacagcactggtggcgccgggccgtcttcgcgccgccgacgttgcccacggcgttcccgacggcacggtagcggcggtctcgatcgtcggctcgacgggcgtcgtggtgcgagggctcgtgatcgaccacgtcaccgccgcgagcggcgtgacgccagccggcatcgcggtggaggtcgcaggacccaaggagggggtccgagtctccggctgcctcgagcgggggagccgacgatgcggcgacgttgcgctcgtcgacgacaccgtctcgggagtccgtgcacccggtgacgtctggcccccgacgctggccgcgtgtggctccggatccgtcgatgcctacggcatcgaagtcttcgacgcggcgacgacaccgcgggccgccctgaccaacgtggtcctcgccggcgatcgcgtcgccgacgcgcgcctcggacagagcgaggccatcgcgatctccggtgacgtcgccgacgcactcgtcgagcacacgagcgtcctcggcgtcgacaacatcggcatcgacgtcgagggctactacggcacgacggcccaccccaacgacgtcgcgctcgtcgacgacaccgtcgcagcggtcgactcgtggacgaacgcgggctacggcgttcgcgctcatggccgatgcctccccacgccaccggcggcggccgggatctacgacgacggtgcgacctcgctcgtgatcgcccacgaccgcgtactcgacaccaaccaaggcgtcagcctcgacacggagacgaaggatcacgcgaccagcaggatcgtcgttgccgacacgacggtggtggacgctccgtcgctcgcgctgcccgccggaacgacatccgcagctgaaggggccgacgtggccgggtccatcagcgacgccggtcgggccttcgatgccttctacgtggacgccttcggaccgcggacctcgatcgaggacgtcgtcgccagccacgacacgttcgtcaatctcagcacgttctggatgcgtcgcctcacgagccaggccgcggtcatcgtccttgggggtcgctatcggtcgatcgagcttcgatcgcttcgcgcacgatcaggaactggcccggcggcacccataccgctccagttcgatcgcctgccgatcgagtggtcggggatgcggctctgcgacctcgcgttcacgggtggtcctgccggtaccacggtggagacgccgacgaccgcggcgacgtcgatcgccggagccttcaaggggctccctgtccccatccgatccgcgataacgtgcggcggccaagcgcgcccgtgacgtggcgctcgaggcgcgcgtcaaggcaccgagtgcctcaacgagcaggtgcgacgaccctgagcaccggccctccgtcgcacgcgtcgcacacgccaaggccgcggcccagcggctagtgaatcagcgcgacgatgtcctgcacgactaggtacgtcacgagcgcgatcacggcgaggtagatcgccgtcatcgaccagcgccaacggtgacgcgcgacgtggaagcgccgaatcccccgaacgtcgaagatcaacgccagcaccccgaccgggatcccgatctcggggccgaaccccgccaccgcgccgaggcccagtgcgggcagcacgaaggggatgatgacgtagctcaacgtgcaacggagcccagacaggatcatcgcgaccgaaaagagacgctcagcggcctcctcgcggtccgatgtcgacgtcggctccgggatccgcagcagccggcgcaccactcggtccgcgcgactgtcgctccgcgccccgaccggacacgccgtggcccgaagcgccgcgtgatcaaccgggcacgcacgctgctcggccgacgagagagccccccgagccgaggcggtgtcgatcgccggctctcgagcagtatccatgctcccagtgtacgcgagccgcgcacgtcaccagaaaccggcctcgtcgggctctcagggatcgaccaccgaaccgaggtcgtcgatgccccgatagcccggcagcgctgcgagttcgcgatgcagttcgtcgctcgcaagggcggcatcgagcgctcgacgcacctcctcatcgctcggtgccacctcgcggctcacggcgaggaagaagcgctcgtctgcgagcggcgcaaagtagagtccgaactcccgcgccgcgggctcgaggacgacgcccgtggtcgcgactccggtcgcgaccgcttcggccaccatgaggtgagaatcgacctcggtgtcccaaccagggacgcgctcgggcacgatgccctcggatgcaagccagtcagcgaggagggcgcgcgcctcagaaccaggctggcggttcgcgagccgtccctgcacgagttcgaggggacgagtcgcgtctcgagcgcgcgacaccagcccctcgcgccaggccgcaaacgatcgcacctcgataccgggcggcaggggcggcaaggagacccgacccgatggatcggtcgccacgtggaagcccgctgcgtgcacgagaccgtccgcgagcgctcgcagcgcggcttcggagggcgccggccaccagacgagctcgaccggccgagggcggtgcgcgagaggacctgcgagcagcaacagcgccggatcgcaccccgcaaccacgaccgcaggcgcagggcgcctcgtcaccgtggcccgacgagggccgagcagccgagctccagcgggatgaaatcccggcacgatgccgtgctcacccccgcgcggaaccccgacgagtcgatcggcgacccgcgcgacctcgatccgctctccgaccgcggctgggccgacgagctcgatcgcctcctcgcgcccagcaccgctcgtgtcgaagagttcctccacgctcacgccgaagaagcgtgcgagcgccatcgccaccgggagcgacggttcgaaggctcctgactcgattcccgcgaccgcctggcgggagatgccgagtgcgtcggccacctgctgctgcgaaagcccccgcacgcgacgcagccgccgtgcgatctcgctcacgtccggaccttctgatcgaagaccaccgcgtccgtaagtgccacccatccctgcccgagcggccggtcccatgacgtctcggcgcgcagcgaccccacgccgtcgaccgaaacgagctgctcgaggcgtcctcccaccacccgcgcaggctcgaggacccgcgctggggccccgatcggaccatcaggaccgtcggcgaggtgcagtgctgacggccaggcccacgcctcgccccaccgacccacgaacggccccaccataccgagtaagcgcgcgacacgagcgctcgcaggctgtcgctgcacctgggaggcgggcccgatctggagctgcgccccgtcgtcgagcaccagcagcgtgtcggcaacgcgcgcgatgctcgcgaggtcgtgatcgacgacgacgaccgcacaacgcgtcgcactgtcgcggatcgcctcggcaacgtcgtcgacgagctcgtggtcgagaccggccatgggctcgtcgaagaccagcacgctcggacgcgcggcgagcgcacgcgcgatggcgacccgacgagcctgcccaccggagagggtgccgaccgagcgatctcgaagggtggcgaggccaaagtatcggagcaactcctcgacgtcctcagccgacgcacgacgagagaaggccacgttcccgaccacgtcgaggtgtcgaaacagcgcggtgcgctgggggacgaggccgaccccacgccgctcgagcgcgacgcgcacacccggactcgacacgatcgtctcgccgacacgaatccacccttcggcaagaccgacgagcccggcgatcgcgtcgaggagggtcgtcttccccgcgcccgagggtccgaccaccccgagcaccgacccctgagggacctcgaaacgacagcgcagcgtgaacgagccccgtcggacagtgcagtcagcggcgagcatgtcgccctcgagcgtacgcgaggagcgggaacggcaacgccacgacgagcaggaccacggcgtagggcaacgcggtggggagcccagtctcgttgagtgtggtccagatctgcatgggcaggccgtaggggtgatacgccacgatgatgaccgccccgaacgcaccgatggctcgcgcccaggcgatcgagagggcagtcgcgagctcgcccgcgacctcgggcaccatcgcgcgccagaaggcgcgccacggcgaatcgccgaggagccgggcttgcacgacgacgtcgtggtcggcggccgcgaacgctgcagctgcagcaagcacgaagtacggggcagcctcgtagacctcggcgatgacgagcgcagtgaacgtgttcgtggcatcgagccccactcgcgcgagcagccccccgatcggggtcagcggacccaccatgaacacgaggagcaggccgatgacgagcggcggcatcaagagcacgaccagcaaactcgcctcgaggatacgagcgacggcgccaccgcgctcggcgatgacgagcgcgaccggcgtgcccaccgccacgacgatgacgagcgcgaccgcagaggccaaaagtgacgtcccagccggaccgagggcgtccggtgcactgagggcgaccaccagcgcgtgcgggcccaggtgccacagcagcgtcaggagtggcccgagcagcaccacccatgcgacgagccccccggcgaccgccagggcgctctgggcgatccgaagcggctctctagccgtcggcgcgcgcgacagcggtgcgaacgacatgcggaacaccggtccccgtcacggtgggccgcagcagggtgtagccacccgccgcgagcgcctccctcccagcaccatcgatcacgtagtcgacgaaggccatcgccgcgccctggtcgtggcgcccgagagtcgtcaccgcgagcgtgagcgcgtgaccgtggacgacactgccatcgggaagggtgagcgaggccgtcgcgtacgttgccgcgtccgccggatcaccgaagtcgatggcggcagggagcgcaatgtagggcaggtggagctggatcgcctgggagcggaaggcgctcgctgcatcgagctgaccgctctcgagccgagcctcgagcgacgtctccgaatacacctgcgacgggttctcgaggctaccgagcacggcgctcgtcgtggaagccggaaggtggtaccggacggtggcgagttcgaccatctcgtagaacgcttgtccctgggggtcggtggccgggttcgtccgtccgagcaggaagccaggcgttcgcagcagactgaacagctcagtgaagggagctcggcccgctgcgatcgcagccagacgaggagcaaacgacgtgtgggggttgtacgcgaggacgatcggactggaggccaccgtcacgtaccaacgagtgaagcgcggctcgagttcggcgatgggcgccccgccgatcgactcgaacacgttcgggctgatctcgccggcgatgatgtcatgggcaagaccgaaggatcctccgccgcgtccttcgtagacgtcaccggtcgctcgggcgaagtctggcccaatgacgtgctcgttgaggtactcgagcgagccggcgtaggcaacgctcgcggtttcgtgcgtgtgcgaggcactcgcgtgctgcgtcgagccacaggccccgagggcgacggcggcgagcgccatcacagtggcctgggcggttcgcgtcgttcgcatgccatcaaagctagcacaacgccagtcttactggcaacgcgcgtcacgcccgcgccgtccgcgacgctcggcgcgtagactcccgccgtgcaccccgcaagcgagcgacgacgcatgatgggcgagaccatcttcgcgaccatgtcgcgcctcgctaccgagcacaacgccatcaacctcgggcagggcttccccgatacgcccggccccgcactcgcgatcgaggccggcgtacggagcctccgcgcgggccacaaccagtacgcaccagccggaggcgtgccagagctccgcacgcgggtggcctcgatctggagccagcggctcgggcgaccgatcgacccgctgcgcgacgtcacgatcacggtgggcgcgaccgaagcgatcgctgccgcctgcctcgcctggctcgagccaggcgatgaggccatcgtgctggagcctgcctacgacgcctacctctgggccgtacgcatggcgggagctacgccggtcggggtcgatctcgggtccacgatgcgcctcgacgcggagcggctcgaacaggccatcacgccgaggacccgcatgctcatcgtcaactcgccgcacaacccgagcggtatggtcgtctccgacgaggaactcgcggcgatcagcgccgttgcgacccgacacgacctgcgcgtcctctccgacgaggtctatgagttcctggtctacgaaggcagccaccgctcgatcgcgaccttcgacgcgatggccgatcgcaccgtcgtcgtctcctcggcagcaaagaccttcggcctgacggggtggaaggtcgggtgggcgatcgggcctgccgacctggtgagcgaggtgcgatcgcaggcgcagtatctgacctatgccggcgccaccccactgcagcacgccgtggcggacgcgctcggcaatctcgatctcatcgtccccctggtgcgcgatccactcgcccggcaacgcgacgtgctcgtcgacggcctcgccaagctcggcttcacgccactcgcgacccaagcgggctacttcgtgctcaccgacctcggccccgtcgaggccgagaccgccaccgaagccgccctcatcctcgccgagcgtgccggcatcgtcaccattcccatcgagcccttctacgtcgagccggagcgagcgccactcgtgctccgctggagcttcgcacgccaggcgacgacgctgcgtgacgcactggcccagttgcgtcgagccgccgaccggggtctgctcgcacccaagacgcgctaagggagcacgcgacgcccgatcgagcgcgaggctcggccctcgtggtcgagccggctagcgctcggcgtcgcgtcggaccacggcgaccagcgacggggcgacgtggccatgatcggcacggtctcgaacgacctcgagcagttcgatcgaccgctccggaaactgcgagcggatctcgtcctcgctgaggagccgatccggatccggaggaccagcgatgccgaccccgtcgacgtggtggccgatgatgacgagccgccctccggggctggcgaggccgaaggcgagcgcgtgcagtcggcgtcgctcctcggcaggcggatggatgttcgcgagcagcacgaggtcgaactggaggccgagctgggcaaactcctcgatggtggcgtgttggatcgtgacagccagaccttgctcctcggcagcgcgggcaaggcgctcgagcgcgacgtcagccacgtccaccgcggtcgtctcgatcccacgagacgcgagccacagcgcgttgcgcccttcgcctgcgccgagatccactgccgatcgaggctgcactcgttcgacgatgcccacgatcgcaggatccggctcgccgatccagagtcgatcattctctcggtagcgagcgttccagacctgccgcatcgcttcgtccacggcgcctccttcgtccgagccccgggtcgaggctaccgctccctcgctccgagcacgtgtcgcccccatgacctaccatgagcccgtgctcatcatccacacctccgactggcagatcggcatgccagctcggaccatgaccgaggaggctcgccaccgcttccgccacgatcgtgtcgacgccgccgagcgtctcctcgccgaggcgagctcgcgtggcgcgtgttgcgtcatcgtggcgggcgacctcttcgacgacaacacgctgtcggaggaccagatccaacgcacgctcggcgtgatcgcgcgccagcagctccctatcgttgccctccctgggaaccatgacgccctcgagccgcacgccatcctcgcccgcgacgatctccccgaccagctgatcgtgctcgactcttgggagccgcgcaccgtcgttccaggactcgaggtggtcggcgccccgtggcgctcgcgcatcccggggcgcaaccccgcctgggacacggtccgcgccctcgagtcctacggtccgccacccgccgggacggttcgggtcctcgtcgcgcacggtcagtgggagcgctacgacagcgtgaccacccattcgacgctccccgccgatgagatcgtggccgccctcgacacggggctcatccactacgtcgccctcggcgatcatcactcctaccagatcttcgtcggtggacgcgtcgccttcagcggaacccatgaggtcaccgccgcagatgagcgcgacccaggctgggcacttgcggtgaccctggagccgtcgcacccgccagcgatcgagcgaatccgcgtggggagatggcgcatcctcacgctcgcggagacggtcaccagcgccgacgacgtcgcggcgatcgccggtcggcttcgcacgctggaggatccggcacgctgcgtcgtccgcctccacctcgacggcacgctccctctcgcggcccgtctcaccctggagcagaacctcgaggcagccgctgccgccctggccggcttcgagctcgacgtcgagcgggtcgcgagcctgtcggatgccagcatcccggccgactttcaccttcgaggggccgccgccacggccttcgaacgcctcctcgacgaccccgaccccgtctcacaggcagcgctgcggctgctcgcgcgactcgccctcgaggggaacgaacgatgatgcgtctcgtccgcctccgtatcggcgaggcccgccacctccggggcctcgagctcacgttgcgaagtccggggctcaccatcatccacggccccaacgaggcggggaagtcgaccatcgtcgcgtgcctgcggctgctgctcgcgaccccctccacgtcacgtcaccgcgaggtgcaagcgctggccggcccgtctggcggggtcgaggttggtgccgtctttgcgctcgacgacaccacggtcgagctcacgaagcgctggctcacccgacctctcacacagctcgtcatcgccggcgcaggacagctcgatggacgagaagccgagacgcgcttcgccgaattgctgacgactgcgggacttggcgagggtgctggcgatccgctcgtgagcaccctcatcgacaacggagcgggaactacgcacctcgccgcgagcaggatcgtggccgaagccctggagcgacgaagtggcgaggaggccttggtcgatcccgggctgcttgcccgggctcgcaccgagcttgcccgctacgagacgcccggacgctcccagccaaccggggacctccgccaagcccgcgacgaactcgaccgcaccgaggccgcctacctggttgccaccgcagacgtcaacgccgtggctgaggcgcgccgggacctcgagacgatcgccgagcagctggcgacactccccgacgacgaggctcgcctcaaggccgaacaggacgaacgtctccgacgccgcgcggagctcgagggcctcgacgtcgaggtcgagcgatcgtcgcgccgagtcgccgacctctccgatgcgatcgcgcgagagctcgaggccctcgaacgtcagcgtgaactcgcgagcgcgctcgcacgctcgcgagaacgcatcgaacagctcgatcgcgacctcgaggagcggcgcgagcagctcacgcgggtgcaggcgcaactcggtgcttcgcacgacggcctcgaccaagctcgacgtgagctcggtgagctccgcgagacccaggcgcgcgccagggagcgcgaagcgctggccagcgtcgctgcaggcgccgaacgtctgagcgcccaggttgcgagagcagtggagctccgcaatcgcgtcgccgccctcgagatcgctccaccgcgcaggctcgatgacgcactggtggcgagcctccaggaggccgaggccaggctcttggccacgcgaaccgtcttcgagaccgtcggacccagcctcaccatcaggagcgagcggtcggtcgaggtcgtcgtgaacggggacctccaacggctcgagccggcccacgcgatggtgcgaccgatcgacgagcgtatcatcgtgtcgctcggggacgtcaccatggagatctcgcccggctcggcggtcagcgaactcgaggagctcgccgccgaacgcacccgactcctcgcaagtctcggtgtcgcgagcctcgacgaggcgcgcgccctcctcgagaaggctgcccagtacgaccacgaactggaccagctgcgacgcgagctcgcgaacctcgctcccgacggcatcgagcccctcgacgacgaggcgactcgcgcccgtgctgcagcctcgagactcgacgacgcccccgagctcgcacccagcgacgagctcgagcgacgagtcagggccctgagcgatcacgtcgaggcgctcgaggccgctgcggaggaggcacaagtcgccgaacgccggtaccacgaggacctcgaacagctcgtcggcgcacgcgagcgtgaggccctgcaactcgaacaagcagagcgcgaccttgccgcagagccagccgagagcgatcgcgtcgcgcgcatcgaggacctcgagcgcgaactcgagacggagcgccatcggcaccgcgaactcaccgacgccatcgagacccggaaccatctcgacgaggagctggaagtcctcgccaccgagcttgggggcctctcgaaccgaagagccgagctcaccacccaacgacgcctcctcgaggagcgcctcgagcgcgccacaggactcgccgaccgcgtcgtcaacctcgaggagcgcctcgaagggcttcgtcgacgagtcgccgtgctcgagggccagcgcgcggccgcacgacggcttgtcgaggtcttggaggaagaacagcggcgtgcgcgggagcgaaccgaagctccgtatcgacagctcgtggaacgcatcctcaccgccacgctcggcgagcgcgtggaggtgatcctcgacgaacacctcggcgtcgagagtctgcgacggccgacgagctcgcggacggcgcttgcgacgacgccgatcgccgcgctgtcggcaggaacccgcgagcaagtggagctcgcctgtcggttcgcagcgacccagctcactggcgccgtgcccatcgtgctcgacgacgcgctcggctactcggataccacgaggacgcgcatgctcgtcgcacagctcaccgcactcgcgaccgacgcccaagccatcgtcctcacggcccaccccgaacgctacctcggtgcgagcgatgcggaacgcatcgatctcgcgcgtagcaccgagtcctcttcggacaccgcgcgtggcacgtcgccacctccgaccggagcggcctcagaggcgtcgctcgaggacgcggtgcgctcagttctcggcgacgccggtggaccgctcaaccggaacgacatcgcatcccggctggatgcagacccagatgccgtcgcacgggccatccggacgctccgcgatgccggtgtgatcgagcagatcggacaacggcgaggggcccgttaccgcttgtgcgagcgtgatcggacagacccgcacgccacctgatcctcgcaacgtggagccgcgccggagcgcgaacacgccaatggccctgatcgcatcggcggagctgcaacctcgcccacggtggctgaagcgctccagcgacccagcgcgaggtgagcgcgcttggcatgccaatgctgaagccggcgaggatctctccatgagcgaggcacgacgaccgctcctctccggatgacatgaagagaacggtgcccatcccgcctcgcgcgagcgccgtcgccaagggccgctgcccgtcgctgcggtggcgccagcgagccgaacgcgaacagcatgagtgcacgggagagcccaaagggagccgatcatcagcccggacacgcttctcctgcgagccaccagcctgctggtccgcgccatgcaacctcggcgacacagcccgcaagccgtcggccaacagcgccacgcccacgctcgggcgaatgacgaagcagtgcacggcaacgactcgaggacaggctccgcacgggcactcacgactccagatctactgggtcgccaccagcgagcttggttgagggctgcggggcggggggctcctcgtgtcctcacgacccgcctgcccctacgactcgagcgcctcccgaatggtgttcgtggcctcgcgtgctcggttctcggccgccacggtgaggtccgcgtggcgataccagacctcgttcgcaccctcgcgccaggtcaccgtcggggtctcgaggagctcggggtcgacgttggcggcgttcgcctggacgaagtccacgagggagtcgatgagggtgtcggcgaggtagtggggttgcagaccgaggtcgagcagggccgagtgacgggcgttgtagtagtgctcttccttctcgatgcgtgggttgtcgaggtggacgatggtgggctcgaggcctcggcgtcccaggacgcctgccacggtctcggcgagctcgttcagggtgaactgctcggtgaactggttgaagacacggaactcaccaggggcggccgggtgctcgagggccagggtgatgcaggccatggtgtcgcggatgtcgaggtagccacgggtctggccgccacggccgtagacggtgatggggtagccgagggacccttggatcacgaagcggttgagggcggtgccccagaccgagtcgtagtcgaagcgggtcgcaaggcgcgggtcgagcaccgtctcgtcggtggcgacgccgtagacgacgccctggttcaagtcggtggcgcggaagttccacacccgcgtcgtgaagtggatgttgtaggagtcggccaccttggagaggtggtagaagctgtgcggcagcttcgggtagggcaaggtgtcgctgcggccgttgtgggtgatggtgaggtaaccctcttcgatgtcgatgttcggggttccgtactcacccatggaaccgagcttgacgaggtggatctcggggttgacctcgcgcatggcaaagaggatgttgaggttgcccacgatgttgttgacctgagtgcgcaccgcgtggtcgcgcgagatcatcgagtagggggcgctgcgctgctcgccgaagtgcacgagggcctctgggtcgtgggcgcgcatggtctcgaggacgaagtcgtagtcgcagatgtcgccttcggcgatgcggatgggggcacccttgccgagggcgttccaggtctcgacgcgctcggtgaacgaggcgatctcgttcaggggacgggtaccgccttctgcgtcccaacggcgacgggcaccgttgtcgatggcgagcacgtcgtgaccttgggccgcgaggtgcagcgccatcggccacccgatgtagccgtccgcgccgtagacgatgatgcgcatggtggtggtcctcccttgagcgatcgtcattcgttcgtgtccaaggcccgaacgaatgcggaacatcagtttacgaagccaacgaggccgaggcgccgcgtagatgtgagcggttgatcagggccgcttcctcgtgcgaccgagtcgcacgaggaagcgtgtgagtgtcgacggtgttggtacgccatcatgacttctctcccacatggtgcacttgcgcttcttggatccggcgagctcgctccgtcgatggtcgcggtccatcgccagctcctcgccgagctcgacccaccacggccggtcttcctcgatgcaaccttcggcttccaggagaacgccgacgaactcgtcgccaaggcccaggagtacttcgacgtaagcctgcatctcccactcgaggtcgcgagcgcgcgtcgtgcgagcgcgctgagcgcactcgaacgcgggcggttcctcgagaccctcgcctggggcaactacctcttcgccggacctggcagtccgagctacggcttggctcagcttcgcaccgcgggtgcaggacccgtgctgcgtgagcggcttgtcgacggtgccaccgtcgtgctggcatcggcggccgcactcaccgcaggtcgctacacaatccccgtctacgagatctacaaggtcggcgaggatcctcgatggctcgacggtctcgacctcctcgatgccttcggcgtgacggcagcggtcgtccctcactacgacaacaaggagggggcgacccacgacacgcggttctgctacatcggcgaacgtcgccttcgtctgctcgaggaccagctccccccgggcgtcggcatcctcggcatcgacgagcacaccgctgtcgtcctcgatggctctggcaaagtgcgggtgctcgggaagggacgcctcgtgcttcgcgtgcgcggcaacgagcatgcgatcgcggccccggcaacgctggcgctcgacgaactgcgcgaccggctcggcgccacagatcacccacggccaggtgacaccgcctcggcatcggcggctggcgaccttgcggcactcgacgaggccatcgaccgaggcgagatcaccgacgcccttggccagatcgcagcactcgtcggcgtcgacgacgaccgcgtcgtcaccgggctcgcccggctcgcccgacgcctcaccgacgggctcgtcgaccgcgaagcggccatcgccccggttgtcgaagcgatcatcgcacgacgcgaagcggcgcgagctgcgcgcgacttcgcgctcggcgaccacctccgcgacgcactggccgccggaggtgtcatcgtggaggacacgccagagggtactcggtggcggctcgcagaggtcgtacactgatatagcgacaggcgtgcccccatcgtctagcggccaaggacgccgccctttcaaggcggtagcacgggttcgaatcccgttgggggtgccagttcgcgttccgagccgagacgaggggtgacgcaggcgatcgagcgagccgacaatgcggtgcaacagcagcacgtcccacgtaggtcgaatcgataggttccatcgaggcgatggtggcacgagtccacacggctccgccgacctcaccgcagccgcatacgacaggcccaacgtcgatcggagcagcagccagcacaaacagcttcggcctgccgtcatgcgcacctcgccgccaccctgtcgcagcgagacccagtcgatatcgatccaacgtcgtgtgcatggccaccgtgcattgcgctcggtcacggcttgcagggccaacctcgaagagcccccgcgagcgagcagatcgacggctcgatcagtcacacgagctggagcgaggaatcggcgggctcgcaccacgatcgcaggccgcggtgcacctgccacgccgagagccgcagatcacaacccgatcgccttggaacagaccacgcggcgccgaccacgcgcgtgcgccctcgccgcccgcgatggagcgtgcctcggcgaacgagcgctacagtgaccgcggcacggcatcgtgcgcgccgagttccgtcgcagaggactgggcgcccatgagtgcgaatcgcacgatgaacgaggtagtcgtgacgggatccctgacgaacgacacgcgcagtgatgatgctgtgttcaccccacgtccgtgtgaacacgcacgatgatcgatctccacctccactccaccgcctccgatggctcgaacgaccctgcggaactcgccgggatcgtcgccggtgccgagatcgtcgccctcaccgatcacgacaccgtcgagggcatcgccgcgtttcgcgaggcgctctctggcacgagcgccttcatcgtcggggcggagctctccctcgcgacgaccacgggctcgttgcacctgctgtgctacgggactggactcctcgggcccgctggcacgtcgctcctcggcacgctcgccgacgatcgcacccgtcgcaacgagcagctcctcgcacgtgccgcagcgaacggactcgacgttcctctcgaagcggtgctggctgctgcgggagcgacccggctcgacgagaagagcgtcgggcgcccgcacgtcgcagcggtactcgtcgaacgcggctacgcccgcgacatccctgatgcgttcgatcgctacctcgccaagggtcgccctctgtacgtgccgaaggcacgccttcgcttcgccgacgtgatcgagccgctcgctgcgatcggtgtggcgacggtcgtcgcccacccgctcagcctcgagctcgcgcccgatgcactcgaggaccacctgcgcacgctccgtgacctgggtctcgtcgggctcgaggcgcactacgccgcctacgcgccctcgacccgcaccgccttggccgagctcgccgaccgcctccacctcgtcgcgaccggcggctcggacgcccatggacgcttcaaggccggcctgtccccgctggtgggctacggcgacctcgatgtcccggtcgtaagtggcgaggcactcatcgacgccatcgcgcgcctcggcggccatgccgacctatactgatgacgcccagggcccgagggcccttcgccccaccggggacctgtggtgcagctcggagtgcacgccggcctgtcaagccggaggtcgcgggttcaaatcccgtcaggtccgctgagcacgtctcgcacgtgcatcgggtcggatagctcagttggtagagcgcacgcctgaaaagcgtgaggtcaccggatcgaaaccggttccgaccaccatcgtcagagcgtgcgacgaccccttcgtcgctgcctcgatctcccgctcgacgagtgagcgctcgagcgaaacgtgcggtctcgcggccccagcaacgctcgctcaccgccaagctcgctcactgccaacgtgtcaggtcgcggacacgacggccaccaggtcgcccgcttcgatcgtgcacgatccccgacacctccgcgcgcgcaggctaggctcggggtctgcgatggatgaccaccccacccacggctccgagcaaggctccgaagccgaccacccagaggaagcctgtggcgtcttcggtgtgctcgtcgcgtccgaggacgagcaagcctcgttcgccgtattcgacggcctctatgcgctgcagcaccgtggacaagagtcagcaggcatcgccgccgtcgacgacggtcgtatcacggtcgtgaaggacctcgggctcgtggcgtcggtcttcgacgaggcgaccctgcgtgcgctgcgcggtcggctcgcgatcgggcatacgcgctacgccacggctggcgaccgaggatgggagaacgcccagccgctcctccacgaccacgccggcgcccagatcgccgtcgcccacaacggcaacctcaccgacccgcctcagacgccagcccccaacggccggatcccttcggacaccgaacggatcgccgcggccgtcgccgaggccctcggatcggcgacgacgccagcggccgttgcggaagccgtcgcgcatgccctcgcgccccttcatggggccttctcgctcgtcatgaccgacggccagcacctcatcgccgctcgcgatcgccacggctttcgccccctgtgcgtcggccgcttccccgatggcggttgggtggtggcctccgagacgcccgcactcgacgtcgtgggcgcaagcttcgagcgcgaggtggaccccggtgaggtcctcgtcatcggcgacgacgcccaggcgagctcctcgctccccggaccccacttccagcatctgtgtgtcttcgaattcgtctacttcgcgcgtcccgatgccaagctgctgggccgagaggtgcacggtacgcgccgtcggatgggcgagcatctcgcgcgcgtcgcacccgtcgaggccgacatggtgatgggcgtgcccgactctggcatccctgccgccgagggctacgccctcgcctccggtatcccctatggccagggactcgtgaagaatcgctacatcgggcgcaccttcatcaaccccggggctgcgcagcgccgacaggcgatccgacggaagctgaacgccctcgaggacaacgtccgaggcaagcgcctcgtcgtggtcgacgactccatcgtgcgcggtgcgacgacacgtcagctcgtcgccctgctgcgccaggcgggggcggccgaagtccacctgcgcatctcgtcgcctccgtaccgctggccctgctactacgggatcgacacgccgagtcgccccgagctcatcgcctcccgcctgtccgtcgacgagatcgcccaagaactcggggcggactcgctcgcctatctcccgcttgcgcacctgcgagacgccgttggcgtgacccatggctgctgcgatgcctgcttgaccggggcataccccgagacggtcagcgaagcggcagccgcgggtgcgggctcgcggtgagccgagccgccgtcatcgctccagcgcccacctgacacctcgaacctgcgccacgtggccactagcctcggcgccgaggaggccactgtggagtaccgcgaggcgggagtcgacatcgaggcggcggatagcgcggttgcgcgcatcgctcagatcgtcgcccggacgtttacggaacgggtcgcgagcccgatcgggggcttcggcgcgctctacgagatcggcggcctcggtggtgcacgtccgaccctcgtcgcgacgaccgacggcgtcgggacgaagaccgaggtcgcccgggccggcgcccgctacgaaggactggggcgcgacctcgtcgccatgtgtgtcgacgatctcgtggtcaccggagcaaccccgctcttcttcctcgactacctcgccctcggtcgcgtcgagccctcgctggtggcattgctcgtcgatgccatggcagcggcactcggcgaggtcggggcgtcgctcatcggcggtgagatcgccgagcaccccggcgtgctcgagccgggtcaggtcgatctcgctggcttctgcgtcggcatcgtcgatggcgacgcgacgctcggatccgagcgcgttcgcgctggcgaccgcgtcctcggcctccgctcgccgaacctccgctcgaacggcttctcgctcgtgcgtcgcgtctacgcagacgtcctcgaggcggtggcacgcggtgagaccggaccgctcctcgccgacggccgacccctctacgacgccctcatcgagccatcggtgctctatgcccccctggttctcgagttcgcccgcgccggcttgctgcacgccgccgcgcacgtgacaggcggcggcctcgccggcaacctcgtacgggtgctgcctacgggcctcggcgtcgaggtcaagccctgggcctggcccgagatcttccgtcggctcgccgacgacggcgacgtctccctcgaggcgatgcgggccaccttcaacctcgggatcggcatggtgctgatcgcgccacccgatgcggcgagcgcgctccgcgagcgagtacctgacgccgtggacctcggcgtcgtcgaagcgagtgacgaaggagtgacatggtcgaccaccgtgccgtcctgatcgatgccctcgagacctacgggatcctccgaggtagcttcacgctcaagtccggtgccacctcgacctggttcatcgacaccaagcgtgcgatctgtcgaccgatggcactcgctgcgaccgcggaactcgcactcgaggcactcgatcccaccgtcaccgccatcggcggcctcaccatgggtgccgacccggttgccttcgcgaccgcgacgctcgcgcagctccggggccgcgcgctgaaggccttcagcgtgcgcaaggagcccaaagcctacggccagggaggggccattgcgggagcgctggaccccgacgacgtcgtctgtgtcgtcgaggacacgccgacgcgcggcgtctcgctgctcgcggcgatcgacgcggttcgcgaggtcggggccaccgtgtcccaagccctcgcggtcgtcgatcgcggaggcaccgccgccgacgtcatcgccccgactcccttcgtcgcgctggtccgcgccccggacctcggcctgccctacgaaggcagcgacagagcgtcttgacatctggcggcattgagcctagagtccgcttgggaggtgggtgtcgtgcgagtgagagcgtcgtcacggggaacatgggctgcgcggatcggtgtcgtcggcgccctcgccgtcgccgcagcggcctgcggctcctcgggcggggcaagctcgtcgtcgtcgtcgagcaccccgaccgcttcgttgccaccgtcgcagctgctctcggacgcctccgccaaactcgtctcgatgacctccttccgcttcaccggatcggggaacgtggcgaccccggcctcggcgagtgccccaagcgcgggatcgacgaccgtgaccccagccggctacgcgaccttcaccctgtcgggggcggcctcgatccctgagcacctcttcgaggtgacgacgagcgtccacggccttcgcatcaccgagatcgccacccagtcggatctctacctgcactatccgaccgtcgcgacaccgaacgcgaccgcaacgacctggctcgaaattccgtcgtcggtgctgcctatccccacgaacagctcggccttcgcgagcaaggttgcagcagcgctccgagccgccgtcaagccacagcccgacggcaccgcgacggtcgacggtcaaacgtgcacgctggtgaaggccaccatcagcgggtcggcgatgtcgcagctcctctccgcggccgatccgagcctggcaagtcaagcggcgtcgacgctcgacaccgtcagtgccgtcatcacggcggccatcaacagcgcacacgagctcgtccaggtgcacgaggccgtctcgaccagtgctggcgtccaggtgaacctgaccatcacctatgaagaccagaaccagccggtatcgatcaccatcccaccgtcgaacgaggtcgaactgatcacgagcgcgggcgagctgtcgggtgtcctcgggggctcggcatcgacatcggcgaaccaaggggcgtcacagggctagctctacgagctcctcgcaggcgggtacgtgccgtgcgtccgcacgagtatcggtagcggagcgttgctcctgggctgatggctcgagagacctccagagagcgcgaggagaccgcccggccccatgccagccggcatcaccgaagcatcccctatcgccacgtcccgcacgctctgtcgtccctggcgtcgacgctgcgagctggcagaggcatcctgtcccaccatccgcgccagctcgtgatgtcggcctaccaggggacgagcaccggtgatcaatcgctcgtgcggtcgccgcctgcgctcgcgccgccaacggcgtcgtgcgtgatcggacggtaccacgatggccaagcctcctggggtccctcgagtcgcgtcgtggcttcggggaccgcgacgcgccagtggtccgccgcggcgtggacaatggcacggctcagctcgcctgcgacgctcgccggcagcgcctgcaccatccaggcgacatcccaccacgcaccgagtcgcaaccacggaccgacggcctcgcaccaacggtcgagcgccgcgacgtcgtcgggagagccgagcgcaaaggtcacaggctctgcctgcctctgctccacggccacctcgaccacacgaccacgacgccgaacactgagccgagggtgcaggagttgcgcgctcgcatcgagaccgtcgtcgaggcgtgccgatggcccaagggccgcgcggtcgctcacttggcgcgcgaagacccagcgcgccaccgcggcttcgtcgccaggggagaggtggacgaagcgcaggcgccacacctcatcccccacaccgacgacctccgccaccgcccgcacgagccggccgctgacgtcgaacgacacggcccgcaccgtccccggcgcatcacgcaccccatcaggtgcttcgatcgcgacgcccccgaccgacacatcgacggtgaccatcgggacgccgagcgtgaatccgtggaggtagtacgtaccgcgactacgaaggacggcccgcggcccctcgcgcaggttccaggggcgcgcggcctccacccgaccacgaaggcgcccgtgctcggcgcgcacgagcgaggcgccgagccacgctcgcgcggcgacgcaccgggcagagatcgccatgacgctcgcggggtcgcacccgtccgccccgtcgaactcgaccgtcggtcccgcgagcgccgcgaccgtgacctcgatcccgaccggctcgaggcggacgaccttgccgggccagcagacgaggttcgcggggagcagcgccatggtcctcagtcgtcgatcgcgtggcgcacgacgccctcacggatggcctcgcgcatgaccgcttcggcaaccgcaggcgcgacgctccggttgaacaccgatgggatgatggtgctcggagagagctcgtcgtcggtgacctgtgcggcgatcgcctccgcggcaacgagcttcatgccctcggtgatcaccatggcgtgcgcgtccagtgcgccgcggaagatgcccgggaagcagagcacgttgttgatctgattcgggtaatcgctccggcccgtcgcaacgacggccgcgatgccttcgagcgactccgggctcacctctggatctgggttcgcgagcgcgaagacgatcggattcgtgcccatggtgcgcacgtcttcggcggtgatgacgcccggtcccgacacgccgatgaacacgtcggcgcccgcgagcgcctcgcccaccgaccccatgcgacgctctgggttcgtgtgctcggccaaccacgccttctcgccggtgaactcctcgcgcccgctgaagatggcacctcgacgatcggcgacgatgatgcgtccgacaccggcgtggtcgagaatcttggccgtcgcgacccccgctgcgccagcgccagcgatgacgacggtgagctcctcgagcttcttgtcgacgacccgacaggcgttgcgaagcgccgcgagcaccaccacagcggtgccgtgctggtcgtcgtggaagaccggaatgtcgagccgcgaggtgagcgcagcctcgacctcgaagcaacgcggcgccgcgatgtcctcgaggttgatccctccgaaggcaggctcgagcgccgcgatcgcctcgatcagcgcctcggtggtgggagccgtgatcgggaccgggaacgcatcgatccccgcgaactccttgaacagctgcgccttgccctccatcaccgggagcgacgcgtgcggcccgatcgccccgagaccgagcaccgcggtcccgtcggtgacgacggcgacgctgttcgacttgatcgtgtagcgatgcaccagactggggcgctgggcgatggcgagcgacacccgcgcgaccccgggcgtgtaggccatggagaggtcgtcgcggttctggatcggggtcttgccgcgaacctcgatcttgccgccggcgtgcagacggaacacgcgatcgaccagcgagcgcacgtgcacgcccgggacgccctcggcagcttctcggatgcgctcggcgtgctccggatcgcccgagagcaccgtgatgtcacggacgatggtcgcagcatccacctcgaccaagtcgacgccgagaatgttcccgcctgcctccccgatcgcggtggtcaagcggccgagggttcctggctggttggtgagctcgacgcgtagcgtcaccgaatgggagacattgggtgttgccatggcgataggctagcttgcccctcgtcggctaggttggccacgccatggcgaaccccctgcgcaccctcgatgagcgaacccgcgaggtcgccgagcgagcactcacctcgtggatcgcgaccacccctcgctccggctcgctggcggccctcggccttggcgtcgggctcgctgcgctgggtggcctcgcgaccagtgatcgagcgatcgccatcggtcatgcggcggcctcgggcgcacacggcgcgtcggtgtgggagacctcgacgctcgccgcgctcgccctcgccagcgctgaggtgccggtcgtctgctggctcgatgggaccatcgacgaccaggagttcgccgtcgcacgagagctggttcgtcaccgagctcgcgcgatcgccctcaccgactcgccagcgcgcgcggcgctggtccgtgccgccgggtggcaccgcgacgagctccgcggcgacgacctcgtcgcaggtatctcgctgggtcgagacctcgcccggcgtgaaggaccggccgcggtgatcgtgcacacgcccgagcacacggtcgaggcaccggaggaactcctgcgtcgccgagcgcgccgcgcgctccgagatgcccaaccgctcgaggtcgtcgccttcaaaccacccatcacggccgagacggcgctcgaggcggtcgacgaccgaggtcccgacgcccccgtgcgggcatttctcggcggcgcggggatcgttcgcatcacccgcacggggctcgcccgcgacctcgaggtgcgcctccgggccccggtcatcggggtccccgatcccgaggggctcgcgcgagaggtcgccagcgccggtgcgcgtgcggtgatcctcgacgtcgatggcgacacgctgatcgccgcctcccctgcgccaacgctggaactcgctccgatccgcacggaggacgtggcactcgccctcggtgcgctggtggcaggtgcgggcttgcgcgtcgtcgtatcgaccgtcgggcgggtcgcaggagtaggcgagcgcgtcgtgcaccatctcgctgccgacccgagcttcgtcatggtcacctgggcagcaggcgccctcgcaactgcccaggcgcgtgcactggtcgcaggcgagcgacgcacccccagcgtcgtcgagctcgtccagaccgatcccatcccagccgtgctcgacgagctcctcgctccggccgagcgcatcgtcgtcgtggggcccgcggcctcgggcgtggggcagcggctcgccggctggctctttgcccgcgacctccatcgccgcacccagtggtacgaaccaaccgtacccgcgagcgtgctcggcttcgccgcgcgcaccctcgcgagctcctgagcagccctgtctcaagccgccgtcacggcggccgatgacctggtgatcgctgatcaccgaggagggccagatggagagcccgcggcttcgcgagcgcgcagcttcgccaccgctcggcgccgcgctcgtggccgcgggcctgctcgacgagcacgacctcgccgtggcactcgagcagcagacccggagccgacgacgcctcggtgaggtgctcgtacgccgaggcatcgtcccacgcctcgatctcgcccgtgtgctcgcagaacgcgctcgcgtgcccttcgtgaccctcgtcgatcgcgagccacgacgggagctgctcgaggggctcgacctcgaggcgtgcgtccgcgagcggctggtcccgatcgaccgagacgacgatggcacgctcgtggttgcgagctcggaggtgccgaccgacaccgtgcgcgagagcgccgaacgtctcagcggcgctcctgtccggctcgtgctcaccaccgagtgggacctgctccgctacatcgtgcgcgcaggcgccgatcacatcggccgacgagcggcctacggtctcgcggagacggatctcgacctgtcggcagcccacgtgctcacgagggcccaagccatcggcctcgtcgtcgtcgcggtcgtggtcgtcctcgttggcatcgtcgacacccgagcactcctcggggccgcactcgctggcgctgccaccctcctcgcgctcgtcgtgctctttcgagcggtcgttgccttccggggcgccggcgtgccgtgggtcgtgccagagcgcctcctcgacgacgcagacctgccgacctacaccatcctcgtcccgttgtatcgagaggcggcggtggtcccggcgctcatgacctcgctcgccaacctcgactacccaccagagaagctcgaggcgctcgtactcgtcgaggccgacgacgacgccacccgggacgcgctcgtcgcggcgcgcccgccgagctgggtcaccgtcgtgaccgtgccgcccgaggggcccgcgacgaagccgaaggccttgaacgtcgggctcgcgctcgcctccggtgagctgctcgtgatctacgacgccgaggatcgacccgaacccgaccagctccggatcgtggcctcgatcttcgccgacgccgaccacgaccttgcgtgcgtccaggcagcgctgaactaccacaacgcccgccacaacctgctcacgcgcctgttcaccctcgagtactcccagtggttcgattacctcctccccggcctcgaggcgctcgagctgccgatcccactgggagggacctcgaatcacttccgcacgcagctgctgcgctcgttgggaggctgggatccgttcaacgtcaccgaggatgccgatctcggcattcgggccgcggtgaagggtgcccgggtcgccaccgccgcctccaccacgtgggaggaggcgaccgctcgccccggcgccttcatccgccaacggacgcgctggatcaagggctacgtccagacagccctcgtgcacgcccgccacccgatccggctggtccgagcggtcgggccgatccaggccctcgccttcgccgtcctcatcgccggcacgccgatcgccttctggacgatcgtgcccctcgacctgaccttcgtggcctctctcgtcctctcgccgcacgtcctcgtcgatctcgtaccgcgctgggcgctcgccgtcggattcgtcgacctcgtcatcggcaacgccgtggtgatctacctctccatcgtggccgtcttccgtcggcgtcaatggtcgctcgtgtgggccgccttgctcacgccggtctactggatcttgcactcgctcgcggcctatcgagccctcgcccagctcgtgacccggccgcactactgggacaagaccgaccacggagtcgcgctgtgaggggccggcgcattcgctggtggatcgtggccgcgagtgcactcccgctcgcgatcgccgagatcgtcggactccttcgcctgggcccgggcaccgtcgtcctcgaccacgtcgatcccctcggcatcggctcactccacgcggtcgtcgtcatcgccctcgcgaccatgacgccgctcgccgtaggtctcgccatcgcgagcgcgcatcgctggatcgcgactcggctcgaagcgacgccagcgatggtcacggctgcactggtcgcgttgtggtggctcctcgtgctcgcaggcacgacggcggccggggtgatcgacctcgcgctcctcgcactcctcgtcgtgtccgtcgccgaagccggcgccttcgtgctcggcgacacggtcacggctggggtcggcgcagggcttgccctctgcgcgctcgcgctcagcgacccgccccttgccctctgcgcgctcagcatcggcgcggtggtgctcgtgggactcggggctcgtggtagggacgaggccggcctcgcgttcttcgccgtccttgccttcccgagcgcggcgctcgtggtcggggtgcccttcgtcgactggcgcctcaccggcgacgcggccgcgacccgcgcctacgtcgccgccgtgggcatacaccatccgttcgccgcactcgtcgtcgcgtgcggcgcggttctcgcggccctcgccagaccacgggcactgctcgccgcggccatgctcgctgcagccgtcgcgggggccatcgtcgccggcatggacgcacgcgccatctcggcgctcgtcatcgtcggcctcgcggtcgtcgtggtgccattggtgggggggcgccacggcccgacgctccccatcgccgccgccggaacggtcggcgacgacggggcccagcgtcccaacgctgcctagcggcgccgacgcagctcgtcggtcgtgttcggcacgatcccagcccgctcgagcacctccgcactcacgccggcctcgcgccaggtctcgtagctgatccccttgcgttccccatagcgcgctgcatgctcgatgaacgcctcttcgagctccttgttgtcggcctgatgctccaggcgccacaactcactctcgaggtccttgcgctgctgcaacagctcgatccggtgcaccccggttgcgctctcgaggtctgccgtcacctgatccaagagcatacgaacacgctcgggagtgcggcggcgcccacgcctcggcttgttctcctcgagatagcgcaggtaggcgtccacggcctgggactccctacgcccgcgggcgatcgccgcgcgctgctcgccactcatctgacgaccgtcatcagccattgctgctccttctccttgtctccatcaccgcgagacagctgccacttccgaccgaggtccccggtcggcgacccagcgctccgaacgcgacggcgaggtgccgacaccacaaccaagagagccatcagcgcagctcatccacgctcccctcgacgttgcgtccaccggcccaaccacgccgatcgtcggcgcagtcgcgtcggagccggccagggggagtcacctgagccgtctcccacccacgcaaaaccgccgagacgaacccgccggaatgagcgagccggaacgccgcttcaggctctcgccaggcgaggcgaggcccacactctcctgatcgtcctcctgatcgtcaaacggtgtcgaggtcgccgctcttccctacttcccatgagctcgatgctcaccaacaaccatcatactggccggacgagttcatccaatgtatcgcaccgacacagcgaatcaggtcgtctttgcaatgcaattgcgatcgccaccgtgcgctcataattgctgcctcccagctcgagcgtgggcgtgacctccgatcgcacaatggcggcccggtaggctggcgccatggacgagccgcgccaccgatccctcgggctgaccgacgacgagtacgagagcattcacacgttgctcaggcgcgagccgaacgataccgagctcgcgatgttctccatcatgtggtcggagcacgcgtcctacaagtcctcacgggcactgctcggccgactcccgtcacgtggttcgcgtgtcatcatgggccctggcgagaacgccggcgtcgtcgcgctgacggactcggtggcggtcgcgatccgcatggagagccacaaccatccgagtgcgatcgaaccacaccagggtgctgcaaccggggtcggcggcatcctccgcgacatcttcaccgtcggagcacgacccatcgcgctgctcgattcgctgtggatggggccccaggacgacgcgaggagccgctggatcaccgacggagtcgtcggcggcatctctgcttacggcaacgcggtcggggtgccgacggtcgggggcgagctacgggtcgatgcgtgctacggcgccaatcccctcgtcaacgtcgtcgcggtgggtgtcgcgcccaccgaggcgctcgtgcgtgctcgcgccgagggtatcggcaactacgtcgtcctcctcggcgccccgaccggacgagacggcatcggcggggtctccgtgctggcctctgccggcttcgatgccaccgcggagcagaagcgcccgagcgtgcaggtcggcgatccgttcgaggagaagaagctgatcgaggcgtgcctcgcgctcatgcgcgccggcctcgtcaccggcgtccaggacctcggcggcgcgggactgacgtgcgcgacctcggagacggcggccgcagcgggcgtcgggatggacatcttcctcgacgccgtgccacgtcgtgagcccgggatgacgccgatggaggtcctgtgctcggagtcgcaagagcgcatgctcgccatcgtcgagcccgggctcctcgacgaggtcatcgcgacctgccgacgcttcgaggtgaccgcgtcggtcatcggggtggtgcgcccacccgatgcggagggcccgtacgccggtgaaggagttctgcgagccttcgagagcgacgggggaccgctcgccgccgtcatcccggcgcggctgctcgcccacgacgggccgcgctatcgacgccccatggcgccgccggccgacctcaccgagcgacgcgcacaggtcgtgaccctcgatgcgccgggagcgacgctcctcgccgaggtcgtcaacgacccgatcgaccccgccggggtgtggcgacgctacgaccacatgctgtttcgcacgagcctggtcgaaccaggcgccgacgcggcactcctgcgtgtgcgcacgcccgaggtcggcgacaccggacgcgccatcgccatcaccgtcgatggcaacaaccgctggacccgtgtcgacccgcgtcatggggctacgtggctggtcgccgaaggcgtcgcgaacctcgcgtgcgtgggggcaacgcccctggctctcgtcgactgcttgaacttcggcaaccccgagcaccccacggtgatgtggcagctcgccgagagcatcgacggcatcgccgaggcagcccgagcactgggggtccccgtcgtcggtggcaacgtcagtctctacaacgaggcagacgggatcgacatcgacccgacccccatcgtgtcgctgctcggcgagcgcgccacgccgaccgcgccggtacccgctccggagcgcgcccacggcagcctcgtcgtcctcgcgccacgaggggcagaaccccagctcgcgggctcgcgagcggcggccgtggcgggtgtcgatggcggcaccctggcgccgctcgactgggaagcgcaccgtcgtctgtgcgacgcggtggcggacctcgtcgtcggggacgaggtgagcgcggcaaccaacctgtccgccggcgggctcgcgcgatcagccgccaggttcgcccttcgcagtcggcaggaggctcggctcgagaccacggacacgctcgcgctcgtcggcgagcacccgtcgcgggtcctcgtcgccaccgacgacccggagaggctcgtggcctgggcgtcggcgaaggacctcgacgcgaccgtcgtcggctcgctggctccgtcgggcgagccagccctcgtggtcggcgcgcaccggatcgtgctcggtcgtacccaggacgtgccggcgctcgtgccgaccgacgcctaaccgagcagaccagcgagcaaccggccggcgggctcggcaagaccgtagcctccgccggctcgctccggatgcggcatgagaccgaccacgcgacccgacgcatccgcgatcccggcgatgtcgtgggccgagccgttcggattcgcgacgtagcggagcacgacgcgaccggactcctcgagcctgcgtagcgtgtcgtcgtcggcggtgaagttgccctcgaagtgattgatcggcagcgacagacgctcgtgtgccctcatcttctgggtcaagacgctctcgacgctcgcgacctcgacctcgacgtgctcacacaggaagctgaggcccgcgttcttctggagcgcgcccggcaggagccccgcctcgcacagcacctggaagccgttgcagatcccgaggatcgggaccccacgccgcgctgcatccatcaccgcgcccatggccggcgcaaaccgtgcgatcgctccgggtcgcaggtagtcaccgtaggagaacccaccagggatcacgacggcgtcgaccgctccgagctcgctctcgccatggtggacgaggcgggcggtgacgccgagttcggcgtaggcgccgaccacgtcgtgctcgcagttcgtgcctgggaagacgacgacggcgacactgctcacggggcaacgacctcgagttcggcgatgcgccacgtctggatcaccggattggcgaggaggcgctcggcgagcacgctggcctggtccagcgcatcacgctcgtcgacggcgcgaagctcgaggcgaaaggcgcgtcccgcactcacgttgacacccggcgcgagctcgaggtgccgagccgcgtccgtgatggcccgcccctcggggtccgcgatgcccggtctcggctcgaccacgaccaacgccacccaggtgtgcgcactcatgcccgctctcctccgtagggatcggcgctgcccggccactcgtcgaacgagcgtcccgtcagcgtctcgtagaccgtcacgtagcggccacgcagctcaccgacgagatcgctcggcaggggaggtggcggtccctcgccacggaaaccctcggccacgagccagtcccgaaggagctgcttgtcgagccactgggggttctggccgaggtccccggcgacgatgcgagccgcgtcgggcgtagcgatctcgtcggcgagcaccaacgcacgcccgtcgaggccgaactcgaacttcgcatccaccaaggtgagccccttcgcgtcgaaccaggacgcgagcagggagaacacctcgagggaccggtcggcgagctcgcgagcacgccgctcgccgacgagctcgccgagctcgtctggcccgagcggcaggtcgtggccgacgtgagccttggtcgtcggggtgaacaggggctcggggaatggagcaccgaagtcgaggtcccgtggcagctcgcgaccgaacgcggtgccgtcgcgctggtaggactcccaggcgctgcccaccagccgaccgcgcaccacgcactcgaccggcagcatcgcgagtcgccgcacccgaagcgtacgaccgagccacacatcggggacgtcggtcgcgacctcgaggaggtgggtggccacgtcgctcgcgacgcgctcgaaggccgcggccgcgatggccgtgagcagccgacccttgtcggggacgagctcaggaaggacgacgtcgaaagcgctcacgcggtcggtggcgacgaccagcagcgccgcctcgtccctcggatccacccaggtctcacggaccttgccgacaccaacgcgcgtgaggctcacgatgcctcctcgagacgagcgaacaggggggcaaggttcgcgaccaggcgctccgcggaggcgagctcggcgagctcgcccggggagagcggcacggcggggtcgtcggccagcgcatcgaggaagggcacgtcctcgtccagggtgcgagcggccgctgcctgaacgatgcggtaggcgtcgtcgcgagccatcccgcggcgcacgagtgcgagtagcacctgctgcgagtacacgagaccgcgtgtggcggcgaggttctgcgccatcgcctcggggtgtacggtgaggcccgccacgatccgcgtcgccagcgacgtgccgtagcaggccacgtggaaggcatcgggcagcatgacgcgctcgaccgacgaatgcgagatgtcgcgctcgtgccagagggcgacgtcctcgagcgcgggcacgacggccgagcgcgcgagacgggccatgcccgagaggcgctctgcgagcactgggttgcgcttgtgcggcatggccgatgagcccttctggccgacggcaaagggctcggccacctcgccgacctcgctgcgcgcgaggtgacgaacctcgagggcgatggtctcgagcacggctccgagcgcagcgagcgcccacacgacgtccgcgtggcggtcgcgggggatcacctgcgtcgccgacgtgggacgcaagccgagggcctcgagcgcgtgacgctcgatggccggcgagagcgcggagtaggtcccgaccgcgccggagagcttgccgacgctgatggtctcgcgggcagcgacgagacgagctcgcgcccgttcgagcgcgagccagaacagggcgagcttcgcgccgaacgtggtcggctcggcagccatgccgtgcgtgcgacccaggcagacgaggtcgcgcgtctcgagcgcacggaccctcagcgtgtcggcgagtccgtcgacgagctcgagcacccgatcggtcgcgtgcacgagcgccagtgacagcgcggtgtcgacgacgtcggaggaggtgagaccgaagtggatccaccgcgcagccggatcggcgatgcgggcttggagcacgtcgacgaaggccgcagtgtcatgatgggtgatgcgctcgcggtcgttgacggcctcgacgaaggcttcgtcgggcgtcggggcgagctggcgtaggcgcgcggcatcctcggcagggatctcgccgagggcccccagggcgtccgtcacggcaagctcgaccgcgatccagcgcccgaggcgcgcctcgtcggcgaagagtcgcgcgatcaccggatcctcgtagcgagggatcacgccaactcctttccgaccacgccgccgatgcaccatgccccaccgtccgccgcttcgcgcggcgatgagcgcgcgacgacgtcgtcggaccgtgggctcactcggcgcccaagcctagatcgctgcgccaggtcgcgccctcgatgcgaatcgcctgacgggcccgataggccacctcgcgcgccgtggccaggtcgtcgccccggcccacgacggtcaggatgcgcccaccggtcgtggcgagggcgccgtcggcctcggcacggaccccggcggtgtagacccgcgcgccgaggcgctccgcctcggcgatcccctcgatgcgatcgccaccgatcgacgcctccgggtagccacgggccgccatcacgatcccgagcgccgcgccggcctggacatcgagatcgccgatggtgcccccgcgggcagcggcgaccagggcgtcgacgaacccttcgccgaggagcggggcgatcgcctgtgcctcggggtcgccgaggcgcacgttgatctcgagcagcgacaggccgtcctcggtcgccatcaagccggcgtagagaaaccctcgatagacgatcccgacccgacgaagctcggcgaggagtggctcgagcacccgatcggtggcttcttcgatgagcgagtcgttggcccagggagccggtgcgtaggcacccatgccgcccgtgttcggaccgaggtcgccgtcgaggagccgcttatggtcctgggcgacgggcaacagccgcgcatcgcgctcgttcaccaaccagatcatcgagagttctcggccaccgagaccctcctcgatcacgaggcgccgacccgcatcgccgaacgcctcgcccgagagcttggcccgaacgtctgcctccgcggccaggcggtcgcgggtgacgagcacgcccttgcccgccgccaacccgtcggtcttgatgacgtaggggggcccgaagcgatcgaagagcgcagcggcctcctcgatcgtggtggcgacgccccagcgagccgtcgggaccccggccgcgtcgcagagccgcttcatcgcgatcttcgaaccctcgagcgccgcccctgctgcacctggtccgacgacgaggcgccccgcggcgcgaaggtcgtcggcgagtccggccacgagcggagcctccgggccgatgacgacgaggtctgcctcgatggctctggcctcgtcggcactgacctcgaagcgggtcgcgatcccggcgttgccaggggcgaccaccaccgaggctcccccacgcgagacggcgtcggcgagcgcgtgctcgcgagctccggagccgacgatgagcactcgcatgggctctacgagagctccacgatctggtcgcggctcgggccgaccccgacccagcgcaccggcacctcgatccgcgcctcgatgaactcgaggagccgacgagccgccgcgggaagcgcggatgcagtggtcacctgtccgatcggggtcttccagcccggcagcttctcggtgacgggatgggcgcggtgcagatccgactggtgatacgggagctcgtcgaccctctcaccagcgacctcgtaggcggtgcacacctggatctcgtcgaaggtgtcgaggacgtcgagcttggtgatggcgagttcgctcaccgaattgacgcgcaccgcgtgctggagcagcacgaggtccagccagcccgtgcggcggcgccggcccgtgttcgtcccgtactcgtgaccacgatcaaccagcgcatcggcgagcggcccctcgagctcggtcgggaaggggccggcaccgacgcgcgtggtgtaggccttggcgacgccgatgacctgatcgatctggcgaggcccgaggcccgagccggtgcaggcgccaccggcggtggggttcgacgacgtgacgaacggatacgtgccgtggtcgagatcgaggaaggtggcttgggccccttcgagcaggatcgtgcggccctcgcgccagagtcgctggacgagccccaccgaatcgacgatccgaggcgcgatcaggggtgcgtaggtaccgaggtagtcggcgacgacccgctcggggtcgatgggtagacggttgtagcccttcgcgagcacgaggttcttctcgcgcagcgccacgtcgagcttggcccggaagatcttctcgtcgagcagatcctggactctcaggccgatacgggccgccttgtccgcataggccggaccgataccgcgcttcgtggtgccgagctgtgccttgccgaggtagcgctcggtgagtcgatcgagctcgtggtggtagggcatgatgagatgtgcgttgcccgagacgacgagccggctcgtgtccacgccgcgctcttcgagcatgcggagctcctcgacgagcaccttcgggtcgacgaccacgccgttgccgatgatggggatcacgccgggatagagcacgccgctcgggacgagctggagcgcgaacgcatcgccgtcgacgacgatggtgtggcccgcgttgtgtccaccctggtagcgcacgacggcagcggctcgccctgcgagtaggtcggtgatcttgcccttgccttcgtcgccccactgcaggccaacgaccacgatggcgcccacgccacctccttcgactcgggtgccccgccaggctagggcacgcggaacacgaggggttcgccgttggcgatctcgagcgagaccacctcgtcatcgtcgaggtcgcgcagcaccttcacgaggccccggagcgagttgccgtgcgccgacacgagcacggtgtgcccgtcccacagcagcggcacgatgacgtcgtagtagtacggcagcacccgatcgatcacgtcgcacagcgcctcggtacgaggcacgagtgcgagcgggagcatgcggtagcgctcgtcggcatgcaggagacgctgggcctcgacgtcggtctcgggtgggcgcacgtcgaagctccgacgccacagcttgacctgctcgtcgccgtagcgagctgcggtctcggccttgttgagtccctggagcgccccgtagtggcgctcgttgagccgccagctgcgcagcaccggcagccaggggcgctcgagttcgtggagcatcagctcagcggtcgtgatcgcgcgctcgaggacggaggtcacgaggacgtccggccgaaggccgtcggcctcgatcgccttggcggcctccttcgcctccgcgacaccctggtcggtgagtggcacatccacccacccggtgaagcggttctccgcgttgtacgtactctggccgtgccggacgaggatcagcgtgcccacgtggctcgagcctagcccaccacgccaatggtcaagaaccggctggtcggtgaccgattgaaccgtgtgggaatgtttctgcggcgtgaagcgtcctaaaacttgatattctgtgactcaagcttcgcaggggctctcgcgtcaggagacgccgatccccacagcccagctcacagcagacacggacggacagcaagcacggtcgtaacaggcaagcacaacacaggaggagcagccatgcccaaggcagtcggcatcgatcttggcaccacgaactccgtggtcgccgtcctcgaaggtggcgacccggtcgtcattcccaacgcggagggtggacgcaccaccccgtccgtcgtggccttcgccaagaccggtgaggtgctcgtcggcgaggtcgccaagcgccaagccatcaccaaccccgatcggaccatccgctcggtgaagcggcacatggggaccgattggaccatcgacatcgatgggaagcactacacgccccaggagatctccgcgcggatcctcgccaagctgaagcgagatgccgaggcctacctgggcgacaccatcacccaggcggtgatcaccgtccctgcctacttcgacgacgcgcagcgcacggcaacgaaggaggccggacagatcgccggcctcgaggttctgcggatcatcaacgagccgacggctgcggccctcgcctacggcctcgacaaggaagccgaggaccagacggtgctcgtcttcgacctcggcggtggcaccttcgacgtctcgatcctcgagatcggcgagggcgtcttcgaggtcaagtcgaccgcaggtaacacccacctcggtggcgacgactgggaccagcgcatcatcgactggctggtcgcgagcttcaagaaccaagagggcgtcgacctctcgaccgacaagatggcgatgcagcgtctcaaggaggcggccgagaaggccaagatcgagctctccgcgtcgctggagaccatggtcaacctgccgttcatcacggcgacgaccgaggggccgaagcacctcgagatgaagctcacccgagcaaagttccaagagctcaccgccgatctcgtcgaggcgtgccgcgcaccgttcgagcaggccattcgtgatgcgaacctgtcggtcggcgacatcgaccacgtggtcctcgtcggtggctcgacccggatgcccgccatccaggagctcgtcaccaagctcaccggcaaggagccgcaccgcggcgtcaacccggacgaggtggtggccgtcggtgcggcgatccaggccggcgtgctcaagggcgaggtgaaggacgtcctgttgctcgacgtcaccccgctgtcgctcggcatcgagaccaagggcggcgtgatgaccaagctcatcgagcgcaacacgaccatccccaccaagcgcaccgaggtcttcaccacggccgacgacaaccagccctcggtcgagatccacgtgctccagggcgagcgcgagatggcggcctacaacaagacgctgggccggttccagctcgtcgggatcccgccagcgccgcgtggtgtgccgcagatcgaggtgaccttcgacatcgacgcgaacggcatcgtccacgtgtcggcgaaggaccgcgccaccggcaaggagcagtcgatcacgatctcgggcacgacgtcgctcggcaaggacgagatcgagcgcatggtgcgcgacgccgaggcccacgaggccgaggaccgtcgccggcgcgaggaggccgaggtccgcaacaacgccgacaccctcgtgtaccagaccgagaagctcctcgcggaacagggcgacaagctctcgggccccgagaaggatcgggtcaccgaggccttggggcagctgaagctcgcgctcgacggcacggacatcgccgcgatccgcagcgccaccgacgcggtggtctcggcgtcccagagcttcacccagcggctctacgaggaggcctcgcgcagcgcccagagcgccgatgccagcggccagtcgagcacctcgtcggaggatgaggtggtcgatgccgagatcgtcgacgagtctggagagcagaggtcctgagccatgggcaagccgtacggagacgacgccgacgagccggtgacgccgtccgaggacgccacgcccgtcggggggtccccccccgacgggacgaccggcgacgacgagccgaccgcggaggtgcagccgagccccgacgacgaggggcgagagagcgatccggtcctcgcggcgatcatggaggacctcgcagccgtcacacgggagcgcgacgagttcctcgagaccgcacagcggctccaggcggagttcaagaactaccgcgagcgtgtcgcgcgccaacaggccgaggccggtcaagctgcggtcgcgagcttcgtgacgaagctcctgccggcgctcgacaccttgaacctcgccctcgcccacgcccgtgcggagggctccgaggagacgacgagtgcgctcgcccaggtgcacggcgtcttccacgaggtgctgaccaaggaagggctcgaggtcgtcgagcccatcggcaagcgcttcgacccgaccgaggccgatgcggtggcccacgaggagggcgagggcgagcccacggtcacggaggtgttccgggcggggtaccgctggcgcggacaggtcatccgaccagcgatggtgcgtgtgagcggatcgtgaacgcgacgagcgagacgggctcgtcacgaggggcgagaagggaggtgagctgacgtggccccggcgagagagtggttcgagaaggactactacaagatcctcggcgttcccgagacggcgagcgagaaggacatccagcgtgcgtatcgcaagttggcccgccagtaccaccccgatgcgaaccccgggcacgaggagcgcttcaaggaggtctccgcggcctacgacgtcctcggcgatcccgccaagcgcaaggagtacgacgaggtgcggcgcctcggtccgctcggatccatgggcgcccccaccggcaacggcacccgtggcgccgggacgttccatgctgaggacctcggcgatctgatcggctcgctgttcaatcggggccgtcgcgaggccagcgggcctcgacgcggcgccgaccaagaggccgaggtcaccatctcgttcgaggacgcagctcgtggcgccgaggtgcagatccccgtcaccggtgaggcggcgtgctcggtgtgcaagggtacgggtgcagcccccggcaccgtgccgaagacctgcgcccgctgcaatgggaccgggacggtctcggacaaccaggggttcttctccttctcgcagccctgtcctgcgtgccacggccgcggcctcatcatcgagcagccctgtccctcgtgccacggcaccggcaccgagcaccgaacccgcatcgtgaaggcgaggatccccgcgggtgtcgagcccgactcgaccatccgcctgcgcggccgtggcgcgccggggcgcaacggggctcctgcgggcgacctcttcgtgcgggtgcacgtgctgccgcatccgatgttcggtcgacgcggagcggatctcacgttgcgtcgcacgatcagcttcgccgacgccgccctcggcaccgtcctcaccgtgcccaccctcgacggcacggtctcggtgaaggttccgcctggcacgagcgccggcacggtgctgcgggtccgcggcaaggggctccccaaccccaagcgcaagggagcccgcggcgaccttctggtcacgatcgacatcgacgtgccggacaagctcgatgccaagcagcggcgctacctcgaggacttcgctcgcgtcttcccccacgacgcagcctgaggtgctctgagccacgagaggaggtgagatggctgagcacgaccgatcgcactccccggagcgctcccgcggcctgtacgtgatctccgtcgccgcagagctcacggggctccatccgcagaccctgcgcgtctacgagcgccgtggcctcttggagccgaggcgcaccggcggcggctctcggcgctactccgaggccgacctcgctcgcctgcgccgcatcatcgagctcacggagcagggcctcaacctcgagggcgtgaagcgcgtcatcgagctcgaggaggaggtcgagcggctccgcgccgaactcgacgctgcgcgccagcgcgcccgcgagcgcgagcgcgagctccatcgccactaccggcgcgacctcgtgccgctcagccaggcggtcatcgtctggcagccacaacgccaacgcacgggcgacgcccgctgatccatcgagtccctcctcccccaaccccaacccccaaaccacgaacgaccacgccggcccgaggccggcccggaggcaaccatgagaaccgatcacttcacccacaagctccaagaggcgctgcaggatgcgaagcgcctcgccaccgagcgccagaaccccgaggtcaccccgcagcacctcgcgctcgccctgctcggccaacccgacgggatggcgctcgccgtcctctcgcgagccgggatcgctcccgccagcgtgcgcaaccagctcctcgaggccctcgagcgcctaccacgcgcctacggccaagcggccgaaccggcaggatcggcggcgctcgcacgggtgctcgagcgcgccgagcagctgcgcggtgagtacggcgacgactacctctccgtcgagcacgtcctgctcgccatggcggccgtgctcaaggtcgacgaggcgacgctgcgccaggcgatcgacgccgtgcgtggcggacgccgtgtgacctcggccgaccccgaggacaccctagaagcgctcaccaagtacgggcgcgacctcaccgaggctgcacgcgcaggctccatcgaccccgtgatcggccgtgacgaagagatccgtcgggtcatccagatcctctcgcgtcggcagaagaacaacccggtcctcatcggcgaacccggcgtcggcaagaccgcgatcgtcgaggggctcgcacgccggatcgtcgaaggtgacgtgcccgaaggcctgcgcggcaagcggatcatcgcgctcgatctcggctccatggtcgcaggagcgcagtaccgcggtcagttcgaggaacgcctcaagagcgtgctcgacgccattcgccagagcgaaggcgaggtcatcaccttcatcgacgagctccacaccgtggtcggtgcgggtgcggccgagggatcgctcgacgcctccaacatgctcaagcccatgctcgcgcgcggcgagctgcgcatgatcggcgcgaccaccctcgacgagtatcgcaagcacatcgagtccgacgccgcactcgagcgacgcttcgccaaggtcatggtcgaccagcccagcgtcgaggagacggtcgcgatcctgcgcggcttgaaggagcgctacgaggtgcaccacggcgtgcggatccaagacgccgccctggtcgctgccgcggtcctgtcggatcgctacatcaccgatcgcttcttgcccgacaaggcgatcgacctcgtggacgaggccatggcccgactgcgcatggagatcgactcgcgacccgaggagatcgactccgtcgagcgccgtctgcgccagctcgagatcgagcgcatctcactcgcgaccgagaccgaccgcgcctcacgcgagcgcctcacccgcctcgaccaggacatcgaggccacgaagctcgagctcagtgagctgacccgccagtggcaagccgaacgggaagcgatcgacgtcatccgccagcgcaaggagcacctcgaggagctgcgtgcccagtcggaagcctacgagcgccaaggcatgctggaccgcgccgccgagctgcgctatggcgagatccctcgcctcgagcgcgagatcgaggaggcgaccgaagaactctcgaagcgccagggtggccggcgcatgctcaaggaggaggtcgaccccgaggacatcgccgaggtggtcgcggccgcgaccggcatcccggtgaccaagctcctcgagagcgagaccgagaagctgctccacatcgaagacgcactgcgtgcgcgggtggtgggtcaagacgaggcgatcgacgcggtggcgaacgccatccggcgcagccgtgccggcatcgccgatcggaaccgccccatcggctccttcctcttcctcggcccgacgggcgtcggcaagaccgagaccgccaaggcgctcgcggagtacctcttcgacgacgagcgagccatgatccgcatcgacatgagcgagtaccaggagcgtcacagcgtctcgcgcctcgtcggtgcgccccctggctacgtcggctacgacgagggcggacagctcaccgaggcggtgcggcgccgtccctacgcggtggtcctcttcgacgagatcgagaaggcgcacgccgacgtgttcaacgtgttcctccagatcctcgacgacggccgcctcaccgacggtcaggggcgggtggtgaacttcacgaacaccatcctcatcatgacctcgaacctcgccgacgatccgcggcgcttcttcaagcccgagttcgtgaaccgcatcgacgagatcgtgcgcttccacgagctcacctcggaccagatccgcgccatcgtcgaccgccagatggcccaactcgccggtcggctcgccgagcgctcactcggtctcgaggtcaccgacgccgcggcggccctgctggccgagcgcggctgggatccggccttcggtgctcgacccctgcgtcgagccatccaacgcctcgtcggcgacccgctggccagagcgcttctcgaagggcgctacggcgagggagacacggtcgtggtcgacgcggccgacggcgccatcgtgctgcgctgagcacacggcacgaccgacgacgcacctcgggaagccccggggtgcgtcacgtcgtcgggagcggccacgggagttcgtagagcgcgagggcgttctcgtaggcgacgagcctggcgagtcgaaacgcctctcgttccgcaatccagccctcggcgagcaggggctcgaggtaggcggccatggcgcgccgatggccgagcgcaccgagcgcgtagagctcggggaggccgaacgcgtccgaggagtagcagagcttgccccacggggcgagctcgagcatctcggcgagcaccgccggggctgccgggcccacgaaggactccgcgaggccgagatccacgaagacgtgcggatagtcgtgggcgaggagtgccgcctcgcgatggaagggataggtgtgcagcagcacgaggcgcacgccatggggagcgatggcctcgatgaagggctggagctcaccagggtgaccgcgtgccaggcgaacgtccggatcgccgatgccgacgtggaactggagcggcaggggtgccacctcgagtgcggcccacacgatcgccgcgacgaggtcccggtcgacgacgcgcaccccatgtccacggtcgcgttcgtcgaggatccgtgcgagtgccgtctcgagcgctcgcggcgcgggaggtcgatcgggaagatcgaggccactgcgataggcagccaccgacttgtaggcgaccgcccgccgcgcggcccgggcgacggccgcctcgagcgcagcccggaagtccgccgtcgcaccgaggtcggcgagcacacgttctgcgatcgcctcgagtcggaccacctcgagcgcgggtaccccgctcgccgcctcgagttcggcgggctcgagcacgagttcggaacgaaagccggtgtcgacgagcagcccacggacgccgcccgtggcgagcgagcgtgcaaacaggtcctccggtgcgtacgcggcgcgcgccgtgaggtagtcctcacttcgaaccggggcctcgagcccgagcacgaggccgagcgctgcgcgcacgccgatgccgagcgaggactcgagcggggtggtacgagccgcgaggcgatcgggggcttcggtgaggtggtcgagcaccgtgtcggtatcgggggcttcgcgtacgatcccatgacagtgatggtcgaggagggggacgtctgccaagcgttccgcgagcacactggcgggcgcgagcgggttcctcaccgctccacctcgacgagggctcgggtcagctcctcgtagcgagccagtcgacgacgcgccggctcgccgatgcgctgcaccacggcggcgatgatcgcctcgacgagcgcgagggccggcgtgagcgcatcgaagatcccgggtccgtcgacctgggtggtgagcaccaccgagctgcctggcgcggccgggctgagtccagggtcggtcacgagcacgacggtcgcgcccgcctgactggcggccgtgacgaaccgggcggtctcgagctggtagcggacgaagtcgaaggcgaccaccgtcgtcgaggcatccacgtcgagcagggcattcacacgagcgccggcctcgggcggcacgtggcgcaccgacggtcgcaggacctcgagcgtccaggcgaggtgacgcgcgacgacgtcactcacgcgcccaccggacaccaccaccggacggcggacgtcggcgagcagggtgacgacggtgtcgagcgactggggcgcgagcccgacgaacgagcggcggatctggtcgatgaggtcggcttcggccgagccaacgtcacccggcccggtgacctcgaggcgctcgagcggcgaggcgagccgctcgccgatctcttcgcgcgccgccgaccggaactcctcgaccgagctgaagccgagcttggcgacgaagcgcaggaccgtcgggggcgagacgtcagcgagcgctgcgatgtccgcgagtcgctcgagggcgacgaccgggtactcccgtaacaccgcttcggccacacggcgctgggcggggccgagctcgggtgcgactcgacgcacccgctcggcgagcgacgtcatgaccagctccaacgcatcgccgcgaccagctcctcgggcgtcgcgtcggcaaagcgagcgagctcggcctcacggacagcgccgatggccgtgaggaaggacctgcccaggacatcttggagtagctccgaggagcgcagtgcgccgagggtggcggcgagatcaccaggcagtcgctcgaggcccccgtggtgcgcgggatcgccctcgacgggaggcggcggcgtcctcgggtccgcgagcgcatggcgcgcgatgccgaggagggaggtggcgagcagatacgggttggcaccgagatcggcgcccttgagctcgacgtttgccgcgcggccatcgaccagcgtggccgcaggcacgaggcgtagggccgcctcacgattctcgatcccccagacgcgatacgcacctgcccagtggctgggcacgagccggaggtacgagaccggatggggggctgcgatcgcgaggatcgcggggagctcctcgagcagccacgcgatcaccgactcaccctcgggacgcacgccgccaggcccgtcgccgccggcaaagatcggctcgccgtcacggtagagaccgaggtggatgtgtccgccgttgccgaccccaccgacgtccaccaccggcgcgaacgacgttcgcagcccgtagcgctctccgacggcccggatcacggagcgggcaagcacggaggcatcggcggctcccacgggatcgctcggggcgagcgagagctcgaactgcgccggtgcgtactccggatggagctgtgccaccgcgaggcccgccgtctcgagggcgtcgtacaacgaccggagatagtcggcgagctcgatcacgcgcgacagtccataggccggccccgacgtcgcgggcacgaagtcgtcttgaccggcgaggccgacgacccactcgagttcgatccccatcgtcgcgctggcacccgcatcggcgagcagggcaacctcgcgctggagcgccgagcgagtgcagagctcgtagggagtgccgtcgcggcggaagcggtccaccggcgcaaaggcccatccatcgagcggcgcgagcggcctcaggaaccgggggtcgggacggagccggaggtcgtccatcgggccaccgctcacgctcgaggaggtgatggagtcgtcggtgagaaaggcgtcgaagaccgggctcatgccgacaccggcgtcgcacgccacggcgaagccctcggccggaatcgtcttcacccgtgcgatcccggcaaggtccacgtagaccagcgccacctggcgagcgtcaccgagcgccgaaacgtcgctccccgagcggtcctccagatcgcgctgtgctcgctgctgcgactcgtcgacgaccaccacgcctccttctggccgatgcggctccgaacgtagcgcacacaggtcgcccgggccagcgctgtgacacaatcgtaacaacaatcccttgcgctgaaacttcagtaacagctaccatacgtgcaccgtcgagagggggacgtatggccggtggttccaccaagctcaggggcaatctgtcgctctggcaggtcgtcggggtctccgttgcgctcatggctccgtcgatggccgccaatatcaatcctcaaggtgcgatcggaacggtgggacgcgcgatcccactcaccttcgtcctggcgttcgttgcggtgctcttcatcgcctatgtcttcgcccgactcacccagcgcttcaaccacgcagggagtgtgtacggcttcgtcggcgcgaccctcgggccacgctggggcgtggtggccggctggtcgctgatcggtacgtatgtgtcctacggtctgctcacgatcatggcgtcaggcatcttcctgacagccctcctccaggcgctgtcgatctggcactctcctcctgcctgggccccgttcctgctctcggggatcgaggtcgtcggcgtcgccatcctcgcagcacgaccagctcgcaacgcgacgcacgtgctgctcgtcacggagctcacgaccgtggcgctcatcatcgtgatctcggtggcgaccctgatcgaactcgcggtgggacatggcccgagcgggcagcacttcacctggagcgtcttcagcgttccccatggcatcagcgtctcggcactgttcctcggggtcgtcttcgggttcttgtcgttcgcaggcttcgaggcatcggcaacgctcggcgaggagtcgaagcgaccacggcgtgacatcccacgggccatcgtgggaacagcggtcttcggcggcgtgtacttcatcgtcgtgaccgcggccgaggtgatgggatttggcaccaccccacacgacctcgcccgcttcgccgcgacgggatcgctgctcggcgcgctcgggacgacgtatctcgcggcctggctcggcaacgtcgtgacgctcggcaccgtgatctcggcctttggctgctcgctcgcctcgacggtcggggccagccggctcaccttctccctctggcgcgacgctcgcggtgcgagtgggctcggggtggcctcggagcgctccggtgcgcccgttcgtgcaaccctggccgtcgtcgtcgcgatgctcggcatcacctggctgagcgcgatcgcgttcggcgcgaccgccttcgatgtcttcgcctggttcggcaccatcggcaccctcatcatcctcgtcgtctacctcctcgccaccgtcggtgcgatccggttgctgttcttcaaggagcacaccgtggcggcgtgggagatcgtcgtcccggtactcgcgggcgtcgtcatcgcctacacgctctatcgcaacatcctgcccttgccgacaggtgccgcgctttggttcccgatcgtggcagccgcctggatcgtggtcggtgcgatcggcgtcatcaccgcacggcgaagcgcggagcgcatcggagcggccatcgcgcgcgacgaaggcctcaccctcccgagcgcgccgacgcccagcagccaggggcagccggcgccggccgactaggcatctctcgaccaccatccagatggggccgttccccacggccccatcccccacgtcacgtcgtctgaacctgccaccacgaaggagttctctgtgtccacgtcctccgagcaccgcctctccgccaacgccatcggacggcgcgaggtcctcttccagagcgtcaccgcgatggcacccggcgccgccatcgcggcttcgatcccggccggtgcaggcttcgctgggggagcgcttgccctcgcggtcgtcgtggcgctgatcggaagcctgctcactgccctctcgatcggtgagctcgcctctcggttcccgtcagctgggtcgttcgccacctacgcatcgaaggcactccaccccatcgtcggcttcttcgttggctggtcctacgtgttcgtctacgccctggtgcccgcactcctgtttctgcagctcggcttcacggtcgcggggaccctccacagcgagttcggctacccggcatcgctctggtggccatggtcgctcgcgggtatcgcgctcgtgggaaccttggcgttgctcggtatctcgacatcggccaaggccgggaccatcctcggcgcgatcgagatctccgtgttcgtcgtcgcagcgatcctgttcatcatccacgccggctcgcacaactcgttgacgccgttcacgacccgagacaccccccatgcgttccccggcctgaccggcgtgttcgccggctccgtctacagcctcctcgccttcgcgggcttcgaggcagccgctccgctcgccgaggaggcgcgcgatccgaagcgcaccgtccgcttcgccattctcggctcgacccttatcatcggcctcatctacgtcttcaccacctacgccgccgaggtcgccgccggacccagccacttcgcgtcctttgccggggctggcgccgagtcgtggattggtctctcgaggagcttcttcggtatcttctgggtgctcgtgttcctcgccatcttgaactcgacgatcggcaacgccaatgcgggtacgtcggtgtcgacgaggatggcctttgcgctcggacgcattggggtgttccccaccctgctcggacgggttcacgagaagacgaaggttccccacgtcgccgtctactcccaaatcatcgtctccgccgtcgcaacactcatcctggggctcgccttcggaccggagaacggcttcgctctcgacggcacgatcatcaccatcgtcgtcgtcgcggtctacatcgtcatgaacctcgctgcactcgtctacttcgcacgtcgcgcaaatggagagcgcttcaacccactcctccacggcctcgcgccgatcgtcgccatcgccttcctcctccccgcgctcctcgccggggccggcatcgctgtcttctcgttcatctcaccgctgaccccaccggcgtcctacgctggtcccatcgtcgccgtgtggctggtcgtggggatcgtcgtgttcttgaacctgcgtgcacgtgcgccacaggccgtcggacggattgccgaggtctacctcgacgacgtcctcgatgtcgaggaggcatgagatggcagtaccggtcgtttccttcacgccaacccctgaccagctgtgttggaccttcgggggagcagaccccgtcgcagagatcgaacccggcaccattctcgaagtgttcaccgaggactgctttgctggacgggtacgccgcacgacggacctcgtctcggaggtctgcgagttccccttcctcaatccccagaccggcccgttcgcgatcaagggcgccgagcccggcgacaccctcatcgtgcacttcatctcgatcgagccggcacgagactgggcggtctcgacgaccgtgccgctcttcggcgcgctcacctcgacccacctcaccgcaacgttgcagccacctttaccggagatcgtgtggatctgggaactcgatcgcgagcgccgcacgtgccgcttccgagcgtcgaagggcgacaccacgatcgagctccccatggacccgatgcacggaacagtcggggttgctcccgcgaatctcgaagtacgctcggccctcgtgcctgatgcccacggcggcaacatggacacgcccgagatgcgcgcgggcgtgacggcgtactttggcgtgaacgtggagggagcgatgttctccctcggtgacggccacgcgcgccagggcgagggcgagagctgcggggttgccgtcgagtgtgcgatgaacacggtggtctacgtcgatctcctcaagcagaccgcaaccccgtggccgcggctcgagtccgatcagttcctcatgacgaccggctcggctcgaccactcgaagatgccttccgcatcgcccacaaggacatggtggagtgggtagcggatctgtgcgaactcgacatcatggacgcctaccagctcgtctcacaagccgcgacctcaccgctggccaacgtctgcgacacgaactacaccgcggtcgcgaaggtcgatcgaacattggtgccgctccgacacgacccctatgcgagcgcccatcgccgagcgcgcgctgtcgcggcagaccacgcatccagtggatcgctcgactgaaatctcggatcctacgactccggggcctagcacgataggtagctccgctcccgctcgacggcgaggagactctgagggttcgatcgagccaggaccgtacgcaccgctgctggaccctgggcttcccttcgacaagttcacgcgctgggtttggtcctgtcctatcggcgagacgagaacgaccctatgcagcacacttcgaccccacagcacgagcgacggtgcccgatggccacgggcgcctggatcagcgttccatccttcggacgctgctaaggtaccgaccaatgcctagtctcctgcgcttccccgtcggtcaggcggtttttcagcttccagaacggcttaccgaggtcaactcatggcacgggcacatccccttcgccttctggatcgtcgaagcactcgagccgtcggtcttcgtcgagctcggtgtccaccgcggggactcctacttcgccttctgccaggccgtcaagtctctcggacttgacaccaggtgctacggcgtggacacctggaagggcgacgctcacgccgggttctatggggaagagatctacgaagacttctctgcgtacaaccgcgagcactatcaagacttctcaaagccattacgcaccacatttgccgaggctatcgagcagttcgaggacggcagcatcgaccttctccacgtggacggctaccacacctacgaggctgtcaggtcggactttggatgctggctccccaaactgagtgagcgggccgtcgtgctcttccatgacatcgcagtcaccgaccgggggtttggcgtctggcgcttctgggaggagatcgctgcgcagtacccttccttcggcttcatgcattcctttggtctcggagtgctcggcgtcggcaaggagctgccagacagcctagctagcttcttcgaagacgccaaagcgaaccctgagatcctgcactccttctatgaggcgcttggaacgagatgccaactcttcggcgatctccagcgcgctcgagatgagcttgcgaataccactgcagccccagctatttccgaggaagtagccaccttgcgccaacaagtactcgacctcacctaccgctacgaacgagcgctcgagcgtaaggaggcggaggccgaacagttagaagccaaggtggtagacctcgaggcacgccttggccagtcgtcgcactcggccgcagccctcgcagaacaccttgcgtcagtcacggctcaacgcgacgagatcctccaatcggagacctggaaactcaccgctcccgctcgcggcttcctctggtggatgcgtcgagtggcgaactggagacgcttcacacagacgttccgtgtcacactgcagccccttcagggtgttggcgagtcactcttcgagaccgacagcttcgtggctctcggtggcagaatgcgctttgcaatcgaaggcgcacctcggcctcccgggtggtacgagctgacttgcacggtcaccaccacctccgacctctcgaaaatgcgcccctacatcatcaccgagacacaagaccaccaacgctacagccaacagattccaggcaaggtcgacccagagggccagatccgagtcctgttccacgtcaacaagcaagctgctcgccacgagctgctgctcgtgggcctcaacgggatcacctccatttccgcaccacgcgtcaagccagcgctgcaccttggcgagccgatggctcgcatacttgccgccgcgattgttcccacaatcgcgtacgcagacctgccacccatcgcagctcatcaagagctcctcccgcaggaggacgagttctcccgctggatcgaacgcaacgagcggatcaatcaagacgaccgagagcgcgtcgcccgagagctcgccacctgggaacacccaccactgatctccgtactcatgcccgtctacaacacgccaatacggcacctcgtaaccgcgatcgagtcggtacgggcgcagtggtatccccactgggaactgtgcatcgccgacgatgcttcaaccgatccagagattcggccgatccttacccgctatcaggaggcggatccccgcatcaaggtcgccttccgagacgagaatggcggtatctcggcaaactcgaatactgcactcacgctcgcgaacggcaagtttgttgcatatctggatgccgacgacgaaatctccgaagtcgcactcctccactacgctcgagagattcatgagtatcctggagtcgagttgctcttctgcgacgaagacaagatcactgaagatggtgatcgctccgacccctacttcaagccgagcctctcccccgcgctccttctcgggaagaactgcgtcactcacctcggcgtctatcggaccgacaccgtccgccgcctcggcggaatgcgctcagagtttgacggatcccaggactgggacctagcactacgctttcttccgatcgtcggtatagacttcacgcgcgcacgtcgcatcccgcggctgctctatcattggcggcggatccatggctcgacggcaaccacactccgatcgaagagctgggccgttctggcggggcggcatgccgtgcaagactacttggatacagcagtgccaggtgcgaaggctgagcccattccgcgcgcctccaatctcaaccgactcgttctcccgactccggatccagctccattagtttcgattcttctgcctaccgcgggaaactatcagctacttcgcggctgcctcagctcgctcctcgaacgcaccgactacccccgcttcgaagtgcttatcacgatcgactccgacaaccccgacgcggactcgctcgcataccttgacacccttgagcacaccggaaaggtccgggtgatccggcgtcggcgcccgcctggcgaaacctttaactactcccggatagtcaacaacctcgctcgctacgcagcagctgacctcctcctgctcctcaacgacgacaccgaggtcatcaacgctggttggctcaccgagatggtcgcggtactatcgctgcccgacgtgggcgtcgttggcgcgcacctctactacgccgacggcagtatccagcacgcgggggtgatgactggacaccacagggcgctacatctttacagcgggctgccgggcgcaagctggggatactatgcagacttactactcgcgcgcaacgtgagtgcggtcactggtgcttgtctcctgacctcgcgtcgagtctgggacgaggtcggtgggttggacgagcagcttgcggtcagtttcaacgacgtcgcctactgccgcgcagcgggcgcactgggatatcagatcatcgtcaccccgcatgccaggctcaagcatttcgagtcagtgacccgaggcttcgacgacttgacgttgccccgcaggtcacggctcgcatcagaatttcagcgactcgccacactgttccccgacattgccgcagctgacccgttctacaaccccaacctcgtccccgaagggcaatttcggcttcagtatgaatcgccgataccggtggtctaaactccttcccccgcttgttgtctctgccgactaagcaacgtggcacccaaagacgcaatcaatgtcacaaccatggtacctctaagctggaagcacggctgctttccgagaacaccacgaagcccaatgaagatatcccagccgagaccatccggtcagcgctaacttattgagcccgacattgaatgacacgccctcttgtgaaggataagcacactcttgttcgcttgatagtgtggatacaggccctgagcgtctctgaacagcaatagcatgcgggcttcgccgacattggagatgcgagagcaagcgccacaatcgcgcttcaccctcgccacgaaggctgggcttcgccgatttgcttggcagtcggattgaggccaacaccacctcctgaccggcccaagagagctcgtactcgccggccgttaatatccaagcgtcgagtggaggcggaccgtcttgtagcggtggatccgcgtagcgtgggcttccccccatgtgcttgacagtctgaattgaggccacggccgcctcctcccgggcccaggagagctcgtactcgatcggcggtcggtacccgaggctcgagtgcagccggaccgtgttgtagcgctgaatccagctagcgatggcagagcgggcctcgtcgaggttcgcgaagcggtagcgagccaccagctcccgctcgcaagctcccgaagaaggcctcggccacggcgttgtcgtagcaggttgcgaccccgcccaccgactggcgaagcccgagcgtcgcgcagagctggcaaaccttccgggagaggtactggttggcgcgatcgctgtgaaagatcgccccagcgaggctgccccgggtccgaagagctccgcagatcgcctcgaccaccaggtcatcgggaatgcgacgctggagcgaccagcccacgatccgcctcgagccacgatctgccaccgtggcgaggtagcagaacccttcgtcgtttcggccgtcggtgatgtcgctcgcgtagtgactcctggctcgccaggggcggagtcctggcagacgagatccgggaggggtgcgtcttctccccgcctcgtcgtgactacgaagcgccagcgtgggcagctgccatctcgagctcgcgcattaggcgttccactcgcttgtggttcacgcagtaacccacgtcgtcgcagctcgtgggtaactcaggggctcgacgtaggtgccgtcgttcgcctcccagacggcccggacttcgctgacgagccaggtgtgctggggtcctcggctcggtcccgacggtgtcgccaggcgtagtaggcctggcgggagaccctggctgctcggcatggcaccgctaccgggacgccattggcctcctggttggcaaccggagtggtagcgggtcactggttgccccccgcaggatccgcaaagaccaggcaacgtttcgccaggtctcgttccatagtgagctgcttgacctggcggcgcaggcgggtcatctcctcgcgctccgcgctggtcagcccctctcgcttacctcgatcgatgcgttcctggcgcacccagttgccaagggtctgctcgttgatgccgagctcacgggcgacgtcggcgatggtgcggtgctggtcgaggacgagagcggctgcgtccttgcggaactggctggggtaacggccgcgtcgtcgtcgagcggggccgtcgcccggtggtggtggcggtgtctggtgcatcccttcctcctgtagcaggtgtcaacctggaggggtaaggccaggggtgttgcaagaccgattgaaccgaaccaccaatcgtttggacgtgaccgctcgctggacctgtcgtggcgggtctggccgccccgagggggcactagcgtgtcgacctcggatccaccgtgaagttggtcccggctctgaggtctgctcagaccgaccttggctccccactcaacccgaggtgctcgtgtttcgaccaaatgcatggatgcgccgcagtcacctcatccttgaaacgaccaagacccgctctcgcacgagttggctcccgaccgttcacctcactctcacgctctccgccgccgaggtctcggggccactcgtcctgaagaacccctcccgctccgtgcttgccctccgcgccgttgcgcagagcgctggccagacccttcgcgtgagcgcgacgggccccgagagcgcaagccttccggagcccgatggccgttcgctgctgctcgttggcccaggcaagaccacgctcaccatcgaagacccgctcgacgccccagcgaccctcttgatagcaccatcccgggaactcggcgagtctgcgcgcgatcttctcgacgaccgatgcgccgcagcagagcgagctcgcaccctcgcgcggcgattgctcgccctcaacggtgagagcgagcgactccaggcagcccagcgacacacgaacgacccgtcgtccaccctgccagatccacttcgacccctccgcgaggtacgactcgacggccggcccctcagaccgaccgagctgcacaccttgcttgcacgggcgacagtcgaaccctctcctccgtacacgtcgatcgccgtcgttaccctcggtcaggcgcaaactgcagcagccacggtcgactcgctgcgcgtcaccgaccccggcccatggcgcctgctcgcgtcagaacacgaacccaccctcgtcgcaaccgataccggagtcccctcgcgtatgctcgcggacaccgcagccgacgacgccctctccgacatcgatcacgttctcttcctgcccgctggggcaacactcctgcctggatggcgagaagagctcgccagagcgagcgccgacctcacgcttctgggtgggatcgaggtgcgtcaggacgtgggagacgttgtcctgtacggagagctcgatcccgtcctcctattctcgacgccagcgttcggcctcggcgtcgctgtgagacgcgatgcactgcctgcagaggtaccgctgccacatggcatcgaggggatctgggggcttgttgccgagctcgtccagcagggctgcaccgctgcaggcaccgacgcactcgtgctcgtcacgccgccttggcccaggaatgcggacgaggcgactgcgctgcccgaccgcctcgctggactggtgaacgcagagctcgtcggcacctcgcagactgagcacagccagtggcccccgattgtgctccaccaccgccttcggccgccctcgtgggcgagtgtctccgtgatcatcccgacgcacgacgcgccccagcaccttgaagcggccctgcgatccgtacgcgaggcggactaccctggcccggtcgagctcattctggtcgcccatcgggttcgcaacccagacgtagagcatctcctcgccgacgcgatgacctggggggcgagcgtcgtccgcgacgacggagccttcaatttctcccgcctgatcaacaggggtgctgagcatgcgaccggagaactcctgttgttcatgaacgacgacatcgcgccgacgggcaccgactggctgcgcgagctcgtgagcgcccacgttgcccacggtgcacgcgtcacgggggcacgcctgctcagcgccgacggtacgcgcatccagcacctcggccaggttcgctctgcactgggcacgctccagcacctgcacgtgggtcgacctgcggaggatctcggctactgcggccgcggtgctgcgaccgcctccgtcacctcggtgaccggcgccctgatgctggtggacgcggctcgattccgcgccgtcggtggcttcgacgagcgctacgacgtcgccttcggcgacaccgatctcgtcctccgactgcgtgcaaacgggggcagagcgatcgtctgcaccagcgcgacggctctccatccagagctcacgacgcgcggctcggacgcacggccagcacggcacctcgggttcgcctccgagtcgatggcgtttcgccgcgagcacgggtggcagctcgccaccgatcgatgcctcgccccgcgtctccgagcacgcgacgacacccttgaggtcgtgcccgcaacggggcgccacgagtgcaatctcgtcgccgtgcagctcggcccagaggacgctgggggtggtttcgacgtcgtcctgctcgactccgagaccgcgcagatcaccctcgagatgccgagcgacctaccgaccaccgagatcgtcgggatcgaactgcgcctcacgctcctcgggggtgacccgcaggcactgaccgccacgctcgacgggaccccactctcgtggcacccaagggccggtcatctcgccgacctccggtgcgacgagggcgtaccaacggccggtcgacaggtccaccacctcgacctcgtccccggggcagagctcgcgagcctgcgcgtcgtacccgcgccgacggcccaggtgaccgctccaacgacccgaggactcgagctcgcctgcgccgcgaccgcctgggtacgcctgcctcgccaacaggtcccgatgagccagccgcacgtctgagccactacctgggctcgtcatgcgtggggcgccgaggagtacacagcactcaacggactcctcgcccactgggcggcagcgtcgccgcctcgcgccgcaagtccgacgatcgccgacccgagaacgtcgctcgctccccaggtcggtggagacctcggtcaaccttggcgcactccgatgcgactcgcaccagagcgaccgaacgtctgtgcaccctcgcgaggagccacggccttccggcagcccatagacgctcaacccggacgatgcccccgagtcgctccacgaacgcaacacgatgtctggcgcaagagcgggagggtctgatgcgaacgccgggccctcagggctccccgcagccgcgacaagacgggcatggcacagctcacgaggagccgaccgatgccctggccgccagtcgctcgtaggtcgcaagcagggtactccaccgcgcacgcacggcgtcgtagcgctcgtggacttgggaagcatcactcgccgcatgaggggcgtcgccgacgtcgcggggtgtgcggatggctgcgcacagcgcatcgacgagttcgccaacgagcaggggctgatcgctccggacgacgacacaacgacgatcgaggtctgcgtcgtcaacgaactcgacggtcggcccctcatcgtcgacgaccaccacgcacagcgatcgctgcgcaagctctctgaggacgcgggcatcgggcaggggccgcacccacaccctgcgaccagcgagggtcgtgacagcgcccggtgcccgaccacctcccaccagtcggagaaccccgtcgatgtccgtacacgcctgcgcggcaaggcgcgccacgagcgggccgcggtcagggcgagggttgggctcaacgagcaccacgagccgatcgagacgaggcgccggaccatcatcgaggtagagccacgccggatacggctcgctcaccacctcctgatcgcgaaggacggcccccgatgcagcgacccacctcgcaagagcaccatcgtgcacgagcacgtcgtcactcccagcgacgaccgtgagcagatccgtcgtcaggggcctcaagcgtgtcccgagccggagcacggcatcctggtccactggcccagcaacggcagccgccacctcggcgagtaaccgcgcgacgtcgacgtcctgagcgtggagctcgacgacccgtcggcctgaactcgtgagcaccgccgggacctcaccgtgcaaggcatcgggtgcgagcaccagctcgtggagcgtacagacaggatcggggtgacctgctcccagttcagtccgcagcagcgtcccgacgatgccgtccgactcccagcctggcgcctggagctcgaggtcaaagcgagcatccagcacgcacgcgagctcgccgaggtacgaccgcaacccatgggctcgatcggcaccccagcgtccgtcgggctcgagtcggggcaagcgcagtgccagcgtcggtcgtccggactcggtcacgctcggcgtcccgagcgccgcaccgatcgcgtccgcgctgcgtcgccccacctggtcccacgactgacgctgcacgtgctggcgctggcgctcgaagagctgctcgcgccaccccgacactgcggtcaattgtcgcagcagaccgaccaggtctccgacgtcacctggccgaaagagcgcctcgggagttcccagcgcctccgggagtccaccgacgtcgctcgcgagcaccggcgcaccacacatgacggattcaaccgccgggagcccatacccctcgtcgagcgaggggatgacggtgcaccaggcagacgcataggcgcgcaccagctcctggtcgctcaacccatgctcgacccgcaagcgatccgacgggatccccgccctttcgccataccggcggatgcgcggtgcttcctcctcgttggtcacaaggtgcactcggagccggtcgtcctcgcgcatcgcgatggcggcggcgtccaccaggacctcgggccgcttgcggtagtcctgatggtagacgtagagcagcgtcctcgacgcatcgtcaggggctcggtctccacgcacctcacccgtctcaacgccgccgaacggcgccgagccgacgacgtgcacgcgttcgggctccacaccgaggagggtcgtgacgtcgagcgccacggcgtgggagatgcacagcagggcgtcgctcgcccgcaggacgtcgagctggcgccgataccaggcatagaaagcagggtgcggcgcgagatacagcgccgggtgacgaagcgggatcaggtcgtagacgacgctgaccagcctgcgtgcccagtgaggacgctcgctcggggccatcgtcatcgaggtctggaagccctcgaacggactcgcgaccaccagcacatccacctcgccgggcgaggtacgcgtccacccgctcgcgtcgatcggcatcccctcgtggccacggcgcggctcgtgcgaaatcggcgtccaccgctgacgagctgcgcctgcttcctcgacgcttgcgcgcaacgaaagtggcaccggcacgttggggctcaccagccacacccactcggtgtcggggtcgaacgaacgaacgagcgctcgcgtgaactcacgcacccagcgtccaatccctcgattggcactccccccttgcgcgccctgaaggtcgacggcgacgcgcacgtcagcccctctctcgaagctcgggagccagggtacgacgttctggtgcctcgacggctccgagccgatgcttgacatcggcgacctcacgcacgagctgctcagacagcgcttcgagcgaggccaatgcctcgaggcgcccgtaggtgtcctcaagaagacgtccctgggccttcgtgctctccctcaccgcagactccaggtcgccgaggaggcgctcaagcctgtcgacgcgctgggcgacctcgaacacggctcgccgcgtcgcgggggcccgcacctgcgccgcaacggcccgagcaagggaaccggtgagtccgccccgcacgaggaccctcgcccgtgccacaagctgggtcacgagtgggggtgtgacatggcgagcggggccggggtggccatctgctcccggagcggtccgctcacgccacctcgcgcggatcgccgcgtccatcggcagtgcatcgaggatctccaggagctcacgcgcaccgtcatgccacgtgcgatcgacgatgagcgggtgtgtcggcggattggtgatcccgacctcctggatctctccgaggagcgcagcgagcgcggaggcgtcgcccggcccgacgaatctggcatagccgtcgaagagttcgcgatggaccggaatatcgctcaagatcagcggtacgccattgaccgccgcctccacgctcgggagatcgaaaccttcctcgaccgagagcgagaggagggcgcggcttcccatgatggtacgccacaacttctcgtcagaggcgtctgcaagccaggtcaacggccgcccggcctggacgagctcctcgatgcgagcgccgatatggttcgcacgccatcccaaccgaccgacgatgaccagggggaccgatccacctgcctgccagtgagcctcgaagccgtcgaggacggtcgtgtagttcttccggggctcaagggtcccgaccgcgacgaccggaccgctctgtacgtcgacgatccgctgtgcagagggctgccgagcatgcatgcccgagagccagcagacgcgcacacgctcagcggccagctcacgccacggcaccgtccgcgccagcatcgctctcgtcgcctctgccgtcgatcgcgagaccgcgacgaccccgtctgcgaacgtccctacctcgagcatccacagaccgaactggcgcacgagaccttcgtcggcggtccaggagtgggtgagagggacgacgtcgtgctgcaggaccgcgagtcgcatcccctcgagccaccacggggccaagcgatagctcaggcccaggtgccagctgctgtcggcgacgaagacgaggtcgtcacggctcagctcgagcggccgcctgggcacgccgagcggcttgtcctgcgggcgagggatgcgggcaagctcccagaccgtcgggccaacggcctcgccccccaagctgcccaccaccacgtctcggccacgacgacgaccctcgacgacgagcgcctctccgagttcgcggacgaccctctggatccctgtcgctcgccacggttcgcgatcgatgtaggagcagtcccagatgatccgacctcgagcttgcgcggacccctgcgacgcgttcgaccggcgagaggggctctgcatgctcccgcatgctagcgctcgcccacccgcgcgactagccagcctccgagagacgccgacacctgcggagacgagcagcgcgagggccgaagccagtgcgccagagggcgaggcccgacgacccagcgcgacgaccgacgacgacccaccggccccgggaagccgacaacgggcacggggacggcatctgcgccaccagagacgagcaacggggcgggggcaatccgtgcccccgccccgtcctgatgcctcatcgcatcgtgcgcacatgcaccgacctatgcgctgatcgaacccccggctgtgaacgggcccgtgtcgccaaacgccggacccgatcccatgtactcggcattaccgaaggcgaacacgccgccgtcagccgcgaggagccagtagcccatgccgtcgggggtgggcacgaggccgatcaccggttgggcgagcgggtgagctccgtgcaagccggtgagcccgtccgtgtaggtgttccccatgtagtgcgcatcaccgaaggcgaacacgccgccgtcagcgcccaccagccagtagcccatgccgtcgggggtggaggcgatgccgacgatgggggcggcgagcgggtgagctccaccgagccccgtcaggccgtccgtgtaggtgttccccatgtactcggcatcaccgaaggcgaacacgccgccgtcagcgcccaccagccagtagcccatgccgtcgggggtggaggcgatgccgacgatgggggcggcgagcgggtgagctccaccgagccccgtcaggccgtccgtgtaggtgttccccatgtagtgcgcatcaccgaaggcgaacacgccgccgtcagcgcccaccagccagtagcccatgccgtcgggggtggaggcgatgccgacgatgggggcggcgagatgcgtcacgccagccgtttgcaccgatccgtagctgggcgcgccacccaccgacatcaccatgccgctcgccgtaacctcccagcccgcaccggccatggcggggtcaggcgcatagcccacgacaccgctcgcgggtgccgccggctggccagtacccagcggaccgaagctcgacacgtgcccattgccccgcacgaacgcgtacgaaccgtacgcggtgttcggcgccatcagggcgttcagcgtcgaggagttcgagtcgtcgtagtagacctgcagctgacccatcgcgttcgtcgcggtggcgaggccgaagaggccgccggcagcgccggtgtcgagcactcgggtcgcgacgaccatcccgttcatcgggttgatctcgagcaggtcgttgttcgtcgcaccgttcacgacgagaagatcgccgttctgcggattgatcgcgatgttctgcggcgactgcaggagtgggctctgcgacacgaccatgggggtctgcggcgtcgtcgcggtcagcgcgttcggaatcgcatagatggtgttgttcacgtcgtcggcgacgtagagcatcccgttcgccgggtcatacaccatgccctgaggcccaccggcattggacgcggtttcaccaccggagacgttggagttggtcgggagccctgtcgcgagcgccgtgtaggtggcgttcagcggctggccgttggacgtgccggtcgggttggggttgagccgccacacctgtccgtcagcgccggtgttcgacacggcgacgttcgaccagaagaaggcacccggtgcgaccgcggccccccaaacgcccgcgaaggtcgagtttgtgctcgtgtagttcgcaatcagcgtgcccgaggagttgatcaccgcatacccagaacctgaaccgttcgctgtgctcccccagtagccgacccagacgatgtcgttcgaggggttgatggcgatccccaccggtccggtgatgtcggcgttctggtagaaggtggtcgattgaccggtcgtggggttgacctcgacgatgctcgtcccagcaccgaacgtgccggccgacgagttgaaatctgccacgagcacgtcgcctgcgacgagattgcccatcgtcttcggtacgacggcgacgccgtagggattcgtatcgttgttcgacgctgtcgcggacccgaccttcacgttggcgagctgggggaacagattgcccatcggactcgtctgcgcaacgagcgctgaactcgagacgcccgcgagggcgagcagcgcagaagcggcgaccacgccgccactcgcaacgccccagcggcgcttccacggactccttggcatgagggacctccttggcaccactcgtcagcggccgccagcagcacacgccccatggggtgtgtggtctgcggccacggcacgcttctacgtgccgagaggaggtacgtacgaggaccccagaacgttcacggatccacgccgacgggcctcatcaacccttcagcattggccttcagcattggaacgtgccggggcctcgtcgcgccggagtggctcacgccgccttgacggccgcgacgagggcggcgagcgacgccttcgcgtcgccgaagagcatcaccgtcttcgggttgtagaacaagggattgtcgaccccagcgaagccaggccgcatggagcgcttcaagaacaccaccgtcttcgcctcgtcgacgttgaggatcggcataccgtagatcggactcgacgactgcgtcctcgcggcagggttgacgacgtcgttcgcgcccacgacgaggaccacgtcggtggtccggaactcgtcgttcgcctgctcgagatcgtggagctgctcataggggatgtccgcctccgcgagcagcacgttcatgtgacctggcatgcggcccgccacgggatggatcccgaagctcacctcgaccccgcgcccctcgagagcgcgcacgagatctcgcaccgtgtgctgcgcctgggccaccgcgagaccgtagcccggaacgatgacgaccttcgacgcataggccagcatggttccgatgtcgtcggcggtccccgatcgaacggtcgcaccctcggggatgccctcggcgccgcccgcgcccttaggcgccgagcccaccgccgcgaagaggacgttggcgagggagcgacccatcgcgtccgacatgagcttcgtgagcagtgtcccggacgcaccgacgagggtgccgccgatgatcacgacggtcgagtggacgacgaaaccggtcgcggcgacggcgagaccggtgaaggcgttcaggagcgagatcacgaccggcatgtccgcgccaccgatcggcagcacgaacgccacgccgaggacgacggctgcggcgaccagcacaccaagggccacccgatcggtgggccccaccgcgaccgcgaccatccctccgatcaccgcgagcagcaagagcgcgttcacgacctgctgggcggtgtaggtgatggggcgcccggtcatgagttcttggagcttggcgaaggcgatcgccgaccccgcgaacgagatcgcgccgatcgcgaccgagagcaccgaggccaccgacgcgagcgtcgcacccccacctcgcgtggcgagcacgctcacgatcgcgacggtggaggccgcgccgccacccacgccgttgaacgccgccaccatctggggcatcgccgtcatgcgcacgcgacgcgccgagaccgcgccgatcaccgcacccacgacgacggccgcgaccgcgagctcgacgaccccggccgagggatgctcaccgacgaggctcgcggcgatggcgatcaccatgccgaccgcggccgtgaggttgccgcgtcgagcggagcggggtgaggcgaggccccgcagaccgaggatgaagagcgacgctgcgacgaggtaggcgatgtcgacggcgacctggcgagcggcgagggccgcgaggatcactgctggctccttcgccccttgaacatctcgagcatgcggtcggtgacgacgaagcccccgaccacgttgatggtggcgagcaccaccgcgaggacaccgagtgtgacctcgagcgccccgtgcgcaccgaagagaatgccgagcgctccggccaggatgatgccgtggatcgcgttcgatcccgacatcagcggggtgtgcaggatcgtcggcacgcgcgagatgacctcgaacccgatgaaggcaccgagcacgagcaccgtcaggtcgttcagctcaccagcggtcatcaaccccccgatcgtcgatcccactcagcctaggcggggcgcgaccagcggatctcgccgccgtcgacgaccagcgtcgcgcgaaccagctcgtcgtcgaggtggagctcgccgtccgtcaccatgagctcgacgaggttcgcgaggttgcgggcaaaggtctggctcgcgtgcgtcgggagctcggcggcgaggttcgacgcgccgacgatgcgtaccccgttcgtctcgacgatctcgccgggacgcgacccctcgacgttgccaccggtgtcggcggcgagatccacgacgaccgcgccgggccgcatcgcctcgaccatcgcgccgctcacgagcctcggcgcctggcggaacgggatctgggcggtcgtcacgacgaggtcggcctcggcgacgcgctcggcgagcagcgcccgctgtcgctcgaggtactcctcgctctgggcggctgcgtacccgccttcgccctcggccgcatcgagcggcacctcgaggaagcgagcgccgaggctctccacctcctctctcgccgcccgacggacgtcgaaggcctcgacgcgcgcaccgagccgccgcgccgtggcgatggcctgcagaccggccaccccggcgccgagcacgagcacctgcgcgggcgtgagcgtgcctgcggcggtcatctggagcggcatgatgcgcccgaggaggttcgcacccaccagcaccgccttgtaacccgcgagcgaggcctgcgaggagagcacgtccatcgactgcgcgcgactcgtgcgtgggaggagctcgagcgcgatggcgccgagtccgcgcttggcgacggcctcgaggatcgcatcgtctgtcgcgagcccgagcagtccgacgacgagacccccggggcgtacggtgtcgagcacctcgccgggcggcggcccgatggcgagcagcaggtcgggtgcgagcgccgcaaggtcggtgagcgtggccccctgttcggcataggccgcatcggaaaagcctgccgcagcgccggcaccgtgctcgagcactacctcgacaccgagccggctgaggcgtcccaccgtgtccggcacgatcgccaccctgcgctcgtcgtgcttgcgctctctcgccgctgcgatgcgcatcgccagccccctgcctccacccgtcccacgaccaaccccagtcccaccaggctaggggccacccgagccaaccgcgccgcgccccttggtgaagtactcgaggctgcgcgcgatcagaccgagttccatcgcgcgcagcaccgcagacgtgcgattggtcgcaccgaccttgtcgaagacgtgggcaaggtgcgtcttgaccgtcgcttccgagatggcgagcgcctctgcgatctcgacgttcgtgcggcctcgtgccacgagctcgagcacttgacgttcgcgatcggagagcacgacgtccgaaccgaggacgcccgccacatccccgacgccgacgaaggcgatgcctcctcgcgccacccggcgcaccgcgtcgtgcaggacggcctcggtggcgtccttgagcacgtagccacgcgctcccgcctcgaccgccgatcgcacgaggtacggatcctcgtaggcggtcacgaccagcggcgcgcccgtcccccgcaccgagagccacgcgatgagccgcaccccgtcaccgtcggcgagacgcaggtcgcacagcaccacgtcgggtgcgacccgatcgatgacggcgcgtgcctcgctcacgctcgctgcctccccgacgaccgcaacgtcaccggcacgctcgagggatgcggtgaggccacggcgcacgatcgggtggtcgtcgaccagcacgacccggatcacgcggtccacgcaggctcctcgatggctcgggccatccgatacggcagacgggcggcgagctcgaaaccaccgtgctctctcgggtgggcctcgaacagacccccgagacgctcgacacgttcggcgagcagcgcgaggccgaggtgcccctcgagctggcgcgggtcggccggagctgcgccgtcgtcgaccaccccgagcacgagctgcgctccctcgagtcgggcctcgaggcggacgcgggtcgcaccgatcgcgtggcgaaggacgttggtcgagccctccgcgagcaaccgtgcggcgaggtccagtaccatcggcggcaactcgagcccctcgaggtcccccaccacctcgacctcgagacccgccgcgcgaaggcgcgccgcctccaccaagaccacgtcggcaagcgcttcgggcgactcctcgcgccgtcgcagctcgcggatcaacgatcgagtcgcctcgagacccgcgagcgaggcctcctcgatgagccgtgccccttcggtgggcgcctcaccacgcaccaagaggaggatgcccacgaggtgttgggccacggtctcgtggatgcgcgcggcgagtcgctcgcgttcgtgcagctctcccatgcgataggcgagctcgcgcatggtggtctgggcagcgcgcagctcgtcgatggtgtggcgcaggagttcctcgtggcgcctcgtgcgctcgaggaacaccgcgagcatggtgcccgcggcgatgtcggggacgtaccaggacacgatggtggcccagggaacaggggggcgagggagcaggtgcgtctcgaggccgacgagagcggcgacccccatgacgaccgggaccgacaccgaggccgccagcagcacgtaggcgaggaagctccaagcgagcaagaggtaggccgcgttcgcatcgagggccaccgccaccagcagcaaggtgccctcgagtcccacgagcagccagcgggcgagcccaggccgctcgaagccgaccctgccgagcgcgagccacaccgccaccatgagtgcgaggacgaagccgaccgacacggcacgcacggccgagccgatcggatcgagcacgatcacgaagagcgttcccgccatcgtgacggtgccgagcgcctcccacccgagtcgcaccctgcgtccggtgcctccggcacggccgcccagctcgctggccatggacgcatcgtagcatccgacggcgaccccgatcgggatgcgatcggccgtggtatcgaccctcgacgacgatttgcgtcgcatccttgtcaacaggcgatgtaatccttagactcagagccagaacacacacgaatccgatccaacggaaggatcccctatgacactcgtcgaccgtgatcgtctcggcgcgctcctcgccgacgaggccgagcgcttccgtgccagtcaccccgtgagcgcccagctcgccagccgacggggcgagcatctcgtcggcggtgtgcccatgacctggatgcgccggtgggctacgccgttcgcgatcaccgtcgagcgcgccaagggctcagaactcgtcgacgtcgacggccaccgctacctcgacgtgtgcctcggcgacaccggtgccatggcgggccacagccctgagccaaccgcgcgagccatccgtgctcgcctggagtcgggtggtctcaccacgatgctcccgaccgacgacgccgaggtggtcgcggacgaactcacgcgacgcttcggagtcgagcgctggcagttcaccctctcggcgaccgacgccaaccgcttcatgctccgcacggcgcgccagctcaccaagcggccgctggttgtcgtcatggactggtgctaccacggcacggtggatgagtccttcgtcgtgctcgacggtgcgctgacccgctcgcgcccggggaacgtcggccccgccgtcgatccagcgacgacgacccgtgccgtgcccttcaacgacctcggggccctcgaggccgcgctcgccgaccgccaagtcgccgccgtcctcaccgaacccgcgctcaccaacatcgggatcgtcctccccgatgagggctacctcgaaggcctcgtcgagctcgcgcaccactacggctcgctcgtcgtgctcgacgagacccacacgatctcggctggcccgggaggcctcaccggcaagctcgggctccgtccggacggcgtcaccatcggcaaggcgatcggtggcggcgtcccgatcggtgcctggggacttcgtgccgaactcgccgacgccatcgtcgccgaccgagacgccgacctcgaggacaccggcggcatcggcggcacgctcgcgggcaacgcgctctccctcgcggccgcgcgcgcgaccctcaccgaggtgctcaccgaacgcgccttcgacgagatgggtgcggtctcccacgaactcgtgcgacgcgagcgagcgctgctggccgaccatgggttcgactggagcgtcgtcgagctcggtgcccggagcgaggtgcgcttcgtgtccccgcctccacgcaccggggccgactcggctcgcgcggccgacgtcgacctcgaccgctacctccatctcgcgctcgccaatcgcgaggtgctgctcacgcccttccacgcgatgacgctcgtggcgccgacgacgacgctcgcccacgtcgagacctacctcgacgcgctcgccgatgcgctcgcgccgctggcgcgctgacctactggccctggcccatcgagaagccgggtacgccgtcgaaggtgaagagcccttcgaccttgacgaacgcgaggccggcttcggcgagcgcgccgaggagcgcgacgccctcggcgggcgccatcgcaccggcgtcggtcacgaaccggcaccgccaatggtcgacgcagaaggtctccggcaacccgtcgggccagaccttctggccgcggttcgtgatcatgtcgaggcgaatcccgaccggcgcggccgccgacaaccgctcggcgagctcgtcgacggtgccggtccactccacgaagacatcgagaccgacctgcaccttcaccgacgcatgccgtgggctgggttcgacgcggatggcctcggcgctcgcggggtagtgcaccacgggcagcgtcgcaggcgaggccccgagccgctcgatgaccgccgccgcgaacccctccgtcgagaccttggcccgagagcgctcggggtggtagacgtcggcggtgtggatgccgtcctcgatggtggcgagccatgcgttgtggacgcgctcggcgacgtccccctgaccgacgtgcacgagcatgagcaccgcagccaacaggagtcccgaggggttggcgatcccccggccggcgatctcgggcgccgagccgtggatggcttcgaacatggcgacctcggcaccgacgttggcgctcgcaccgagccccacggagcccgcgacctcggcgacgacgtcggagacgatgtcgccgtagaggttcggcgtgacgacgacgtcgaagtcctcggggcgtgccgcgaggcgggcggtgccgatgtcgacgatcaaggtctccgtctcgaggttcggatactccctcgccacctcctcgaacacctgacggaacaggccgtcggtgagcttcatgatgttgtccttgacgaggcaggtcaccttgtgacgaccgtggcgctcggcataggcgaaggcgtagcgcacgagtcgctcggtacccggtcggctgatgagcttcaggcactgcaccacgtcctcggtctggcgatgctcgatgccgccgtagagatcttcctcgttctcgcggatgacgaccacatccatgcccgggtgcgcagtctggatgaacggggcgtacgtcgggcaggggcggacgttggcgaacaggccgagtgccttgcgaatcgtgacgttcaggctcttcatgccgccgccgcgcggggtggtgatcggggccttcaggaacaccttggtacgccgcagcgactcccaggccgacggctcgatccccgacgtgatcccccgacgccagagcgcctcgccgacctcgatggtctcgatcgcgagccgggcgccggccttctcgagcacctccagcaccgcgctcatgatctcaggtccgataccgtcgccgtaggcgacggtgatgggggtcggctggtcgcttcctcgtgccatcggcgacggcctccttcgcggttcgcacgcgctggccgaccacggccccccacgccgatgaccggccaggcgttctcatcgtgagggcgctcccccagcgcgcctcggccctcacgctagcggcacatcctcgccggctccaatcgacactcacgccgatcacgcccgcgttcccccgaccggtggcgagcacccgcgcacgagctcacctgactaggatcgccgccgtggtcgccgaggatgccgagcacgccgctctcgacacgggcatcgagtcgcgcacgtcccggcagccctccgcacccacctggaccttcctgacgaaccacggtcatgtgctcgtgtgcatcgcgcgcgatcccggcatcagaatccgcgacatcgccgagcgggtcggcatcaccgaacgagcagcccagggcatcgtcgcggacctcattcgagcgggctacgtcgttcgcacccgcatcggccgtcgcaaccactacgagatcgaccccacgcgcccggtgaggcacccggtcgagcagccgcacctggtcggtgacctcctcggcgccctcgctgcgctcagcgaccacgacaccctgggcagccgccccggcaccgagaccctcacggggtcgtcgacgtctggacgctgaaggtggtcccgcccgacgacgaaccgagcgggctcgtgatgtcgccctgggtagcgatcgagctcgccgtggggaactgacagaccgggttgatcgacgacgccgtcgagtcgctgaaggcgagtggcgcgagcgtgaaggtggtcccgggggttgcgaccgcgagcggatcgaggaacgacgtcaccgacggctccgccggcaactcacacgtccccgtcgacgtggcgaccgtcggggcctcggcgatccactccgccgagttcgcgggccccccgtagctgatcggcgtcgcggcaccgatcgtgacctgctgcgccgtcgtgagatcggcgatcgtgatcgtccactgatcggccccgacctcggtgatcgtcacctccatggtgtcgccgggactcaccgacagggccgagggcgagatgggcacggccggttgttcgttcgacggcgtgatctcctcccaccacgcacactccgccgcggccccagagccacagaatccctcgcccgcgaacgcctggttcccgacggcgacgcccgcttggagcaggtacgaattcgtcgcaccgtccaccccgatccacacactggtatcacagggcacgctgctctcgcaggtcgtcgacgttgtctgcggcgtcggcacgacgaagcgcgtcgacacgctcgtcaccgaaccccgggccgcgccctcgagcgcataccccgaccaattctgcgagacctgctgcgacgtctgcgagccgatcgccacggtccaggcctgactgagggtcgcggtctcgcccgccgagtccgtgacgctgaaggtggccgtcccggaccctgcagcgaggggcacaccgacaagctcgccagcgctcgtcagcgagagcccagctggcaaaccgctcgccgaccaccggtagccgggcacaccaccggtcggactgagggtcgccgagacggcgctcgcgacggcgagctgcgagagtgcctggctcgcactctgggcatcgatcgcgagcggtggcggtggcgcgagatcggggacgatcccgaccacgggggcggcgagggggcgggagccggacaggcccgtcagtcccagggtgtaggtgttgccgtagaagccggcgtcaccgaaactgaacaccccaccgtcggctgccaccagccagtagcccttgccgtcgggggtcggggccatggcgacgatcggggcggcgagggggcgcgatcctccaaggcctgtgagtcccagggtgtaggtgttgccgtagaagccggcgtcaccgaagctgaacaccccaccatcggccgccaccagccagtagccgttgccgtcgggggtcggggccatggcgacgatcggggcggcgagggggcgggagccggacaggcccgtgagtcccagggtgtaggtgttgccgtagaagccggcgtcaccgaaactgaacaccccaccgtcggctgccaccagccagtagcccttgccgtcgggggtcggggccatggcgacgatcggggcggcgagggggcgcgatcctccaaggcctgtgagtcccagggtgtaggtgttgccgtagaagccggcgtcaccgaaactgaacaccccaccatcggccgccaccaagtcatacccggggctgatcgtcgccgaggcgagcgcgctccggcccggggccaacgcgtcggaggacgacgagcccgggcgaagggtaatgaaggcgcttgcgaaggcggcagcgagcacgacgaggagcagcgtccgcagcagcggacgagccccccatgccagcgtgcgaccgcccacaccgcctcccgtcatcagggtatcgactcgatctcggaccggctcaagccagaaccgaccataccgaggcaggaaggctcagctcactgtcaacttagacggcgagcgcgcgcgtcgagggctcgatcggccgtggcaagtcgcttgcgcccatcagccacgcatcgacgtcgtgcgcgaccgaacgtccctcggcgatggcccacaccacgagcgactgcccgcgcctcgcatcgccagctgcgaacacccccggaatcgaggtcgcgaagcggtcgtcggtcgcgatggtcccctgaggcgtccgagcgagcgcgcgctcggggtcgatgcggtcgagttccggaccgacgaagcccatggcgagcagcacgaggtcggcctcgatgagctcgtcggtcccggggaccgccaccaggttgccgtcgacgagctggacggcttcggtcgtgagcccgaggactcgtccgtcctcgccgcgctcgatgcgcaccgtgcgacgcgcccagcggcgatcgccgccctcctcgtgcgcgctcgaggtccgcagcagcaccgggtacgtcggccaggggtgtcgagacgaacgctctcgcggcggcgctggcaggatctcgagctgcaggacgtgcgctgccccttggcggtgcgccgtgcccaaacaatccgccccggtatcgccgccgccgacgatcaccacacgcgcgtcacgcgcgctcggtgcgccgacgatcggggtcccgagcgcctcgaggttggccgcgcgcaggtagtccatcgcgaagtgcaccccggctcccgcgcgtccctcgaccacgagatcgcgaggacgggtggagccgagcgcgagcacgacagcgtcggcctcggcgacgagctcgctcaaggtgacgtcggtaccgacgcccacgccggtgcgtaccgtgacgccttcggtgacgagctgctcgagacgccgatcgacgaggtgcttctcgagcttgaactctgggatgccatagcgcagcagaccgcctgcacgatcgtggcgctcgagcagctcgacctcgtgcccggcgcgcgcgagctgctgcgcggctgcgagaccagcagggcccgaacccaccacgaccacccgacgaccgctgcgacgctgggccacgatcggtcgatcgacgccgcgctctgcggcctcgtcggccagggttcgctcgatggcctcgatcgagaccggatcccgattgatcccgagcacacacgccgcctcgcacggcgccgggcagagccgaccagtgaactcggggaagttgttcgtcgcgagcagtcgctctgccgcgcgctcgagctgcccgcggccggcgagctcgttgaactcggggatcacgttcccgagtgggcacccatggtgacagaacgggatgccacagtccatgcatcggcgcgcctggcgctcgagggttgcggggtcgaaccggtcggtcacctcgtgccagtcgcggatccgaagcgctacgggtcgcttgggcggaccctctcgctcgaaggtgagaaatccctgcggatcagcggccatggcgtcgcctccttggctggctcgcgcctcgtcgggtcgtggtgcgcctcgtcatgcgggcatcctcatgacgcggtcggggtgcgctgacgcagggcggcgcgtcccatctcgctccgaacgcgcttgaagtcgcgcgggtagacgcagaggaagcgatcgagagcacccggaccctcggccacgatctggcgcgctcggtgcgatccggtcagctctgcgtgccgagcgacgaggttccagagtcgatcacgctcctcatcgggaacgggatcgaggtcgacgagactctggttcacgcgcgccagcaaccgctcgtcgggatcccacaagaacgcgagcccgcccgacatgcccgccgcaaagttgcgtccgaaccgccccagcaccaccacgagaccaccggtcatgtactcgcacccgtgatcaccgacgccctcgaccaccgcgacggcgcccgagttgcgaacggcaaagcgctccccagccacaccgcgaacgaagcactccccgctcgtcgcgccgaagagggcgacgttgccgacgatgatggtgtcgtccgtcgaccaggcggcctgggccggaggacgaacgatgagccgcccaccggagagccccttgccgacgtagtcgttggcctcgccgacgagctccaccgtgaccccgcgcggcacgaacgccccgagcgattggccggcggctccgctgaggcgcagcacgatggtgtcgtcggcgagccccgcctccccccaccgtcgggtgagttcgtagccgagggtggtcccgaccgcccgatcggtgttggtgacctcggcggcgatggtcaccccctcgccgcgctcgagcgccgcctcggcttgggcgatgatgtcctcgtcgagccgcccggccagcacgtcgggttgggagcgaacccgccggcgcgcctgccccggccacggctccggcgcccacgtcagccgttcgagtccgagctggcgtgcctccggtgcatccacgacctcgagcaggtccgcacgaccgatgatctcgtccaacgaccgggcgccgagcttggccagccacgcgcgcacctcgtcggcgaggaaccagaagaactgctcgacgaactccggccgaccgctgtagcgctcgcgaaggaccggattctgcgtggcgatcccgaccgggcaggtgtcctggtggcacacccgcatcatgatgcaccccgacaccacgagcgcggtggtcgcaaaaccgaactcctcggcaccgaggagcgcggcgacgatcacgtcgcgtgcggtcttgagctggccgtccacctggagggtcacccgatcgcgcagcccgttggcgagcagagtctggtgcgcctcggcgaggccgagctcccagggactccctgcgtgggcgagcgacgtgagtggagccgctcccgtcccgccgtcgccaccggagatcaagatcacatcggcgtgcgccttggcgaccccagcggccaccgtgccgacgccggcctcggcgaccagcttgacgtgcacccgtgcccgcggattggccgccttgaggtcgtagatcagctgggcgaggtcttcgatggagtagatgtcatggtgggggggcggggagatgagccccacaccgggggtcgccatgcgcgtcttcgcgatccaggggtagaccttctggcccgggagctggccaccctcgcctggcttggcgccttgggcgatcttgatctggagatcgtccgccgatgcgaggtagaaactcgtcacgccgaagcggccggaggcgacctgcttgatccgcgatcgacgatcgagaccatccgcgtcagggaacgcacgttcggcgtcctcgccaccctcgcccgagttcgagcgcgctccgatccggttcatcgcgatcgcgagggtctcgtgcgcctccttcgagatcgagccatacgacatcgcaccggtagcaaagcgcgtgacgatggcctcggcgggctcgacctcctcgatcgggaggggatcggccgcctcgcggatcgcgagcaggccccgcagcgtcgcgaaccgccgagcaccctcgtcgacgagctgctcgtagcgacggaacacctcgatgcgcccctcacgcgtggcgtgctgcagcaagaacaccgtctcggggttgaacaggtggtattccccctcacgacgccactggtagaggccgccgacctcgagctcgcgatgggcctctgcctcgggtcgcacctcgaaggcacgccgatggtggtaggcgaccgtctcgtggatctctcggaggccgatgccctcgatcggcgccggtgtcccggggaagtactcgtcgacgaggtctcgcgccagtccgatcgcctcgaagacctgtgcgccggtgtaggaggcgatggtggagatgcccatcttcgacatcaccttcacgacgcccttcgtcgcggccttgacgtagttgcgcatcgcctggcggggcgtcggtccgacgatgagaccggcccgcatgcggtcgacgatggtgtcgaacacgaggtagggattgaccgccgccgcgccgaaaccgatgagggcggcgaagtggtgcacctcgcgcgcgtcaccgcactcgacgacgagccccgcacgggtccgcaagcggtgccgcacgaggtggtggtggaccgccgaggtcgcgagcagggacgggatcggcgcgagctccgcactcgcgtgccgatcggagagcacgatgaccgcggctccgcgctcgatggcctgcaccgcttcgtcccggatccggccgatcgccgcctcgagcccactcggcccctccgccaccgggtagagcatgtcgatggcgtgcgcccgaaggtcggcgtgctcaccgtcctcgtcgatgtagagcagcttggcgagttcgtcgttgtcgaggaccgggtgcgggagaaagatctgtcgcgccgccgtcggctcgggcacgagcaggttctgctcggggccgatggtgcctgcggcgctcgtgacgagctcctcacggatcgcgtcgaggggagggttcgtcacctgtgcgaactgctcgacgaagaagtcccacagtggccgatgggcctccgagcgcaccgccggcgggatgtcggcccccatggatccgatgggctcctccccgcgctcagccatgggggtgacgatgcgacgcacctcttcctcggtgtagccgaagagctgctggcgcgtcacgatcgatccgtgctgtgggatgagcatggtacgtggcgcgaggtcgtccaacgtgacgaggttcgcggcgagccaggctccccacggggccgcgccggccagttcgcgcttcacggcaaggtcgtcgagcacctcgccgcgctcggtgtcgacgaggaacacgcgaccgggctcgagtcgacccttcgcgacgatatggtcgggcgccacgtcgacgatccccgcctcggagccgagcaccaccaggccgtcgtcggtgcgccaccacctggccgggcgcaaaccgttgcggtcgagcaccgcgccgacctcacgaccgttcgtgaaaaccacggcagcagggccgtcccacggctccatgagcgaggaatggaagcggtagaagtcgcgcacgcgcggctccatctcctcgttgtgctcccacgcctcggggatcatcatcaagatggcgtgcgcgaggctcctcccgccccgcacgaggagttcgaagaccgcgtcgaaggaggccgaatcactctcgtccgtgcgcgtgatcggcagcgcctcggcgagccgaggaccgagttccgggtgagcgagcagcgactcgcgagctcgcatccaggcgcggttgccacggatcgtattgatctcaccgttgtgggccaccatccggaagggatgcgcgagacgccacgacggcatggtgttcgtcgagaatcgcgagtgcacgagcgcgagcgcgctggtgagctcctcggcctcgaggtcgcggtagtaggcggccacctgcggcgccgagagcatccccttccagaccatggtccggcccgacagcgatgggaagtacagccacggatgggcatgctcgagccgtcggcgagccaaccacgcatcgatctcgagcgcctcgtcgcgccgtccctgcgtcgacgcgaggaacacctggaccatggtgggctcgctgcgccgcgcggtcgctcccagcacgctcgagtcacgcggcaccgcacgctcggcgatgaggcggagctccggaccgagcccgctcgcgagcgcgtcacgcagctcctcgacgctgcgctcggcgaacgcgatgcccgtcacgtaggcaccctcgtcgggtaggtcgatcccgagggatcgccagtaggcatccgggttctgggtcaagatgccggcgccgtcgccggtgtcgggctcggcgcccttcgccccgcggtgctcgaggttgacgagcgcgccgagggcttgctcgacgagcgcatgcgatcggacgccgtcgagccgagcgagggctgcgataccgcaggcgtcgtgctcggcatcgggtcgatacagcggcggtagcgagcggcctagccggtcgtccatggcgtgggctcctcgtacgtaacgagtcgatgacgatgggacgacgttggcccgtgggcccacgatgctagtggctagccggcgagccacacccccatcacgagagccgcaattgccgagagcgaactcagcgcaccccagagcgcgaggccagctcgcgagctggctcgctggtggagccaggccgcgatgcccgagaacaccgcgacggcgatcttggccaccagcacggcggcgtacgcgccccttggtgcacccaccgcgacgacgttccagaccccggtcgcgagcaacaccacatacgctggccaggcaaggcgaccgaatgccctcgccaccgcgggaatcgcgcccggcgactccttgcgcacggtcgggacgagaccccccagcacgagctgtccaccgacccagatgctcgccgagaggacgtgcagcgagagccgaaccacggtcgaagcactcgcaagcgtgggcgtggcgtgcatacagtctccttcgggcacgtgctgacccaacgttaaccgaggcgccgaggctgcggcatcgtcccctggctgagtccgcgctgtggcactctgccgaggtgacgatcccactcctacactgaactcgtgccccctggtcgcaccaggccacgactggctcaggttcgagcggtggccatccgatgatcgcgagcgtgctcgggttcaacctcgtcgacctcgtgatcttggtcgtggtggggttctcggccgtgcgtgggctccgggtgggtgcaaccatccagctctcctcgtacatcggtttctggctcgggctgctcgcaggcgctgcgatcgcaccgtacctggccgatctcgccccacagggagtcctgcggacgttcatcgccctcgtggcgctcttcggcgtcgcatccatcacctcggcggccgctcgcgccctcggaacgcgcatcgtcggacacgtgcgtcgagcccatctcgccagggtggacgctggagccggatcgatcgtctcggtgatcgcgaccttgctcatcatctgggtcgtggccgcactcgccttgaacgcgccgatcccggcgctcgcctccgaagtctcgagctccgagatcgtgcgcgccctcgacgccacgctccctcctgcgcccagcgtcttcgctcgggtggacgccctcttctccaccgagggcttcccgaccgtcttcgcgtcgatcccgccagcgctcgcgggcccggtcagcctcccgagccaggccgaggtcaaccacgtcgaagcagaggtcgctccgtcgatggtcaaggtggagggactcgcctgcggtgagatccaagagggcagcgccttctcggtgggtccgggctacttcgtcaccaacgcccacgtcgtcgccggcgagcagagcacgttcctcgtgctgccctctggatcacagatcgcggccaccgtcatcctctacgatcctcacctcgacatcgccgtcttgaagacgaccggctacgacgtgcccgccctccacttcgacacgcaggtccaagcgcgcggtacccagggcgtcgtgctcggctaccccgagggcggaccgctgacctacggatccgccggggtgatggcgagcttcaacgcagtcgggcgggacatctacaaccagggactcacgagccgcctcgtgtacgaactcgatgcgatcgtacggccaggcaactccggaggaccactggtgggcctgaacggacaggtcctcggcgtggtcttctcccgatcgaccacgaacccctacgtcggcttcgcactggctgctccggccgtcgcggcagaggtgcacagcgccctctcgggcccgcagaacccggtgtccaccgagggctgcgtcccctagcgcagacggagcccacgacgggggatgtccagcgccgtggtgagcgacgacgaagcccgcgccatcgtcgagccgcggggctcgatacactcgggctatggcaaccccacttgcgccaggcctgctcgagatcgatacccgcctcgggggctggacgcacatcaccgctgggttcgtcgtcgaaggcgcgagccccgtcctcatcgagaccggttcgcagtcgagcgcgcccacgctcatcgccgagctcgccgaactcggcatcagtccaagcgagctcgccgcgatcgtcgtgacccacatccacctcgaccacgccggcggtgtcggcgatctcgcacgagccttcccgaacgccacggtctacgtccatcctgcgggcgcacggcacctcgccgacccgactcggctcgtcgcctcggcccagcaggtctacgggccgctcctcgacgagctctacggccgactggatccgaccccggccgagcggatcgtggcgctcgacgacggccagcgcatcacggtcacggagggactcgagctcgaggtcctccagacgccgggccacgccaagcaccacgtctcgatcttccacgaacccagcggcaccatgttctgcggggacgccgtcggcgtacgcctcccggaggtcggggtgctctggccagccacgcctccgcccgacttcgacctcgacaaggcgctcgcgagcctggaggccatgcgctcgcgacgaccgtcgcacctcgcctttgcgcactatggccgcttcgagcacgctgacgacctgctcaccgaggcggccgaccagctccgagcctggtgcgacgtgggcgagcgcgcacttcgagaggggcgcgacctcgagcaggccctcgccgacgctttcctgccctcgctcgaggtcgtggcacccgaggctcgcgaccgactcctcaccctgagcggtatccacgccaacgcgacggggatcgagcgctggctccgactccgcgacgagggccgcgccggcgacgaggtgcgtcgatgagcgtgcccgagggcctcgtcgaggaggctcgccagctcgcaccggaggtcatcgccctccgacgcgagctccacgccgagcccgaggtcgggctcgccctccccgacacccaggcacgcctcgtcacacggctgcgcgcgctcgggctcgagccggagctcggggcgagcctcggatcgatcgtggcgcgcatcgacggcgcgcggccggggccggtgcggctgctgcgcgccgacatggacgcgctcccgatgacggaggagaccgacctgcccttcgcttcgcgtcggcccggcgcgatgcacgcctgcggccacgatgcgcacatggcgatggcgctcggtgctgccgagctcatcgtgcgccaccgcgacgatctcgccggcgccgtggtgctcatgttccagcccggcgaggagggccacgacggcgcgcgtcggatgctcgccgaggggttcctcgagcgccacggcgtcgacgctgccttcgccatccatatcttctcgaacctcccctcaggcgtgatcgcgacgcgcgggggcgccctgatggcgagcgccgacgagttcgagatccgtctcgtcggcaagggcggtcacgcctccgcgccacaccaggcacgcgacccgatcccagcggccgcagagctcgtgctcgcgctccagagcgcgctcggccgccggatcgatccggtcgagccggcggtgctcacggtcggtcacctggcggctgggaccaccttcaacgtcatcccggaacacgccctcgtgcgcgggacctggcgtgcggtcaccgacgagacgcgcagcgcgatccgatcgctcatcgagcgcgtcgccagcggtgtcgccacggcccacggcctcgaggtcgagctcagctggcccatgaacggctacccggtgacgcgcaacgacccgcgcgaagcagcgcacgtcctcgagctcacccgctcggtcctcggcgccgatcacgcgctcgagctcgagaacccgatcctcggtgccgaggacttctcctacgtgctccagcgcgtgcccggcgccatggcgttcctgggagcagccccacccggggtcgccgagccccatgcgaaccactccaaccgcatggtgctcgacgaggacgccttcgcgatcggcgtagcgatcgaggcagcctgggcgctcgacgaccgatgatcgctgtcctcgccttctgcgtggggctcctcctcggcgcactcaccacggcactcgtgctgcttcgtcgcctcggtgaccaacgagccgcagccgcggatgcgacccgaaccctcgagacccagctcgtcgaagcgaggacgaagctcgcgcagctcgagccgcaacgccttgccgagcagacgaacctcggtccgctcctcgaccaggcccagcgaagcgtcgaggagacggtcaagcgcgtcgtcgccgagcacctcgaccacggctccgagcaagcgatccagaaggccacggcgctcctcgacaaggagttccagccgcggctcgcgtcgctcgaggacggccgcaagctgctcctcgagagcgccgatacgctccgcaagctcgtcgacgagcagcttcgctccgctcgcgagcagatcaccacgacgctgcgtgccagcgggagcgaagccgcgacccagctcagcacgaccctcacggagcggatggaccagctcaagcagctcgcagcctcgatcagcgagcagctcgccaacgaccagcgcctcaccgggaccgtcgaggagagcctgcgcagcttcgtcgccgagaaccaggagctgcgcacgcgggtccacgagctcacccaagccctccagcgaagccccaagcagcgcggcaactggggtgagctcgtgctcgagaacctcctggtcggcgccggcctcacccagcatcgcgacttcgacctccaggtcgcctttcgtgacgacgacgggcgcacggtgatcgccgacgccatcatcaacctgcccggcgaacgccatctcgtcatcgacgccaaggtccagctcgtcgactacctccgcgcggtcgaggacccggcgaacgacaccgccgcacgcgcacacgccgaggcgctgcgccgtcagatcaacgagctcgccgaccatcgctacgaccgcctcgtcgacggcgccctggacgggaccttcctcttcgtgccgatcgagtcggcgctcgcactcgcactcgagaccgacccggcgctcatggagctggccatcggcaaggggatcttcctcgcgaccccgaccaccctcatcccagtcctgaagctggtcggattcctctggcgcggcgccgagcgcgacagccgtgccgaggaggccgagcgcctcgcgagacgcctcgccgacaagatcgcgagcttcgccgagagcttcctccagatcgacaaggggctccaggtcgcacggaacgcctacgaacgggccgagggtcaactgcggagcggccgaggcaacgcgatggcgctcgctcgtcgcctcggcgaagtctccggtcgtagcggcaaggcgctcccggcccccctcgaaccgttcgacgacgctggcgacgacgccagtgacgacgatctcgcgagctctctcgaagagggaggctcgtgagccgcgatcccatcctcgccccgacggacctcagcgccgagctgcagatcctcgacgtgcgctggcgtctcgggaccccggtgagcgagcatcgagcgcgctacgacgcgggacacgtgccaggcgcgatcttcgtcgacctcgaggccgtcggcaccggagcgcatcgccccggagccggccgacacccgctgcccgaacctggccaggtggctcgcgatctcgccgccctcggcgtcgacctcggcgcgccctgcgtggtcgtcgacgacgcccgcggcgcttcggcagcccgtctgtggtggctcctcgacgccctcggagtggaggcctacctcctcgatggcgggctggaggcgctcgagggtccgaggtgccaggatccctgcgatcgccgtgccgccgccaccccacgcgcggtccctgcgacgtggcccggcgagctggtcctcgacgtcgacacactcgcagatcagctcaacgatccgtcgctgtgcgtgctggatgcacgagcgcgcgagcgctacctcggccagagcgagcccatcgacccccgagccggccacatccctggagctcgctcgctcccgatcgacgaggtgctcgcgaccggtcgcttcccagatcccgcgacggcacgccggatcctcggccccgtgggcgatcgcgagatcgtcgcctcctgtggatcgggcatcacggcgtgcgtcctcatcgcactcgcgcgacgcgcgggacgtgacgcccggctgctcgagggttcgtggtcagggtggtgcgaggatcccgcacgcccggtctgccgctcggtctgcggcgatgagctcacgcggggctcgacgcgcacgaactcctgacggactccgccacgatccgtctcgctcgaacgctcctccgtgctcacagtaccggcaatgtccggtcccatcagcgccgcaatgacgtgaaagcatcactcacatgtacggacaagtcacgcagaggtacggacaactctcccacgccaaagccactccctgaggctcacgagtgcgcaaggaactcttccacagcacgccattccctgacgactccttcagcacacgcggccctctcgatcgccttgtcgcgagtttgtaacaatcatcattgcagaacgaccgatgcagctcataccatgtcgcgcatcctttgggctttggaagggggagtgagtgatagcagcgttacttccgtacgcgagttggctgcatcccggcgataattcttggcagttgactgcggccactcttgttgggctgatgtccattcctgggctcgcagtactctatgcgggtcttgcgccgaagaagtgggctgtcaatatcatgaccatggcgttcgtcggtttctctgcagtactcgttgtgtgggtgctctggggattcgacatggccttcgggtctcccattcaccttggcagcggtctctggggttccttcctcggacatcccggcctctcgacgagtgcacacgccgagcagagtcaggcatcgataccactcgtcgacggactcatgccgagctttcggttcccacaatcggccttggtctatttccagttcgtcttcgcagcgatcacaccgctcctctttctcggttcggtctggggccgcatgaacctgaaagcctggctgatcttcgtgccgctgtggtcgaccgtggtctacagcctcgacgccttcctgctctggggcggtgggttctgggctcagaagggagcggtcgacttctctggcggatacgtcatccacctctctgctggcatctcgggctttgtcgccgcggcggtcatcggacctcggctgcaccgtgaccgcgagcatgagcggccccacaaccttgtctatatggccatcggtgccggcatcttgtggcttggttggaatggcttcaacggcggtgatccttactttgctggggctgatgccgcgactgcagttttgaacacgaacatcgccacggcagcggcactattgacgtggctcttcatggatatgtcgtccaagcgcctcaatcgcaagccaacattcggcggagcgatcaatgggatgatcgtcggacttgtggcgattacccctgccgcaggatacgtgaacgggctcggggcgctcgcgcttggcatcatcgcctcattcatcgtgtggtggtcgttcaacgtttggtcgcaaaagggtttgttcaggaaggtagacgatgcattcggcgtcattcacacacatggggtggccgggctcgccggcggtctgctgaccggcatcctcgcagatccacacgtcatcgagtacgtcggcaccggtaagacatcgtcgtcttccgtgaccggcttgctctacggacacccgggccagttgctcttgcagctcggtgctggcctcacggtgatagccatatctgccgtcgggacgttcgtcatcttgaagctcgtgggtctggtggtgccactgcgctacccggatgaggtgctcgctgtcggagacctcgctatccacggcgaggtcgtcaaccctgaggatgctggtgtcgaggtgctcgatgagccaacactcatcgatccagcactccgcgaccatgatccccacggcgagagcgaggagctgcgggacctcgagttggagtagaccagcggactgtcatggcgacagggccggtgagacagtgtggtctcaccggcccatctcctgttcgacgttcaatcgacggcggcttgtccctgcctcctgggcgtcctcacagagtgtcctcggtgagccgatgacggttctcgtcgatgcgtgggcctccgaagccaccgacatcggccgaagtccttgccgcacgagctccgcatgtcccgaggatgcactggtctcggatcgaaccattgtgtggtttgccgtccgtaccgcgcttccaagcttggtcgacaccacatccccgacccgcatgcggtggttggtgccctcgccaccttcggcgttgcccccagcgcgaccgtgcgggcaacaatccccgaccggctcggcagcttgccggtggcgacccctcgacgcacgagcgctacctcggccagagcgagcccatcgacccccgagccggccacatccctggagctcgctcgctcccgatcgacgaggtggccgcgaccggtcgcttcccagatcccgcgacggcacgcaggatcctcggccccgtgggcgatcgcgagatcgtcgcctcctgtggatcgggcatcacggcgtgcgtcctcatcgcactcgcacgacgcgcgggacgtgacgcccggctgctcgagggttcgtggtcagggtggtgcgaggatcccgcacgcccggtctgccgctcggtctgcggcgatgagctcacatcgagccagaggcgcacgacactgagacagcgcggctcgagacaccggaccggtcgctcacggcaccgatcgacgcctggcccgaaggtggcatcgcaatcggcgcatcgagatcgccggccgccacctgcgggggcaaccccgtgagcagtgcctgcacgctgacgtccagccgtaccggcggagcgagtcgtgacgaaggcaggcgagcgccggccgtggcgagcccagcgccatagaccatggtgaggagagcggctgcgaggccgacacccagcgtgcgtcggtgcgcgatcacgacagcacctctcacgccaccacaactcggtccgtgtcgccgctgtcgccgagggcctgctccacgttcgtgggtctagcaccgtggcacgagcaccgcacgagccgtcgctcacgaggtcctcagacgacgaacgacccggtcgtcgcatccccgccttcgccaaccgcacgctcgcagcgccagcgggaggttccggggatcggccggctcgagttcaccgatacgacggccacgagccgacgaccacctggcagggtgtgcgcgaccgggcggctggccgagaacgggggctctgaggcgtggcatcgcgctctgcgaacctctgatgacctcggtatcgtaccgggacgaatccctcgtcgctgggcccaacgggccgagtcacacggtcgacggtccgccctgcaggtgaggtcctgccggactcgtccgcgatcacctcgtacactgcgagggggatggagcgactcacccggctcatgcgccgcctcgaccacctccaacagcgccacaagctcctcgcgatcgcgtttgcgatcgtgcgcaagttcggcgaggacaacgcctccacctgggcgcttctcgtggcctactacggctttgcctcgctggtccccctcctgctcgtggcggtgacggttgcgagcatcgtcttcgcccaccatccgaacctcgtccacgacgtcgcccacagtgccatcgcgtcgattccggtgctcggcgcgcagttcgcaagccgagttcgcgtgcatgcgctcgcgtcgcactcgatcatcggcctcgtcgtcgggatcgccggcctcatctggggagcccagggcgttgcgtccgccgcccagaacgccatggccaacgtgtggaacgttccgctcgtcgatcggcctggctttcttccgaggacgctgcgcaacctcggcatcctcgccgtgctcggcctcggggcgctcgcaacctcggtgatcgccgccctcgcaaccggtctcggccacaccgctgtcatcaccgtcgtcatcgtcgtggccacggtcgctgccaatgctgggctctacgtgctcgggttccgcctgctcacaccggcggcgatcgcgactggcgacctcgtcacgggcgccatcgtggcgagcgtcgtctggagcatcctccaacagatcggcggggtcctcgtcacccacgacctcgcacacgcatcggcgacctacggcgtcttcggcatcgtcctcgggctcatcgcatggttctcgatcgcgaccgaggcgacgctctacgcggccgaactgaacgtggtcctcgtgcgtcgcctctggccgcgctcactggctcctcccccgctcacgacggccgaccagagcgcccttgccgccctcgtccaccagcagcgtgcgcgtcgcgaggagcgcgtcgaggttcacttcgtcgcgggcaacgacgccgtcatcgactcgcaacacgcgccgagcgctgcgcccagcacggccgacgagactggtaccaccgcgacggataccccctgacgcgatgcggggcgccaccacggcgccccgctctccctcatcgagccttgcccgacccatcggcccgagtgctcggatcgatcgacagaagcccggaggcgagggccgcgccattccggcgggtgagggcgagctaccatgaccacgtggcgggtggggcccatcgacgatgaggactcgtcgaccgagcgcaacacgcgtccttagcacgggggcaaggacacgactcctcgccgtggcgaccgcatgcgtgagccttgctcgctgtgcgtcgacggccgatgcccaccacgcgagcgacgccggtcctccgaccgttgcggtgagctcggtcgcgagtccgacccgctcgcgttcgcagcgctcgccagcgcccacagcacctgtccgcctcaccgcctccgataccacgtggctccaagagcccggctcgggcatcggtccctggatgcaagccatcgacggtgctcgccacgtcatcgagttgaacgagtacctgctgacgagccccgaggtgctgggcgcactccgcgacgccgctgctcgaggcgtggccgtctacgtgatcatcgacggtcatccctacgacgacgcagcagcaccgaggatcgccaccaccgccctcgctggcagcggtgtgctcgtgcgcgaggcgcctcgacgcttcgagggcgcctacgcgttcgaccacgccaagtacctcgtcgtcgacccaggcagcgcgcgcgagcgcgcgatcctcggctctcagaacgccaccaccgcagctttcggcaacgaccaggccgaggatgcgatcgagacctcgagcccgagcatcgtcacggccctcgcagcgatctttcgcgccgactggcgtggcgtacccgtcgggcccggtccgcgggcggtgctcgtggtctcgccaggatcgcagccggcgatcgcgtcgttgctctccacaccgggcccatcgccgtcaccgcagaagagctcggcgacgctcctgtgctctctggcgccctcgaacgtgacggccccgaggcacgtctcctcgtcgcgggtcccctcggcgcggcggccgcacggcgagcggccgcgctcgcggcttccggcgtccaagtgcgcacgctcacgcatccctacgtccacgccaagctcatcgtgaccgccgacgcgaccttcgtcggatcgcagaacttctccgtcgtgtcgatgaacgacaaccgcgaggtcggcgtcatcaccgccaacccgacggtgcatgcgctggcgctcgcgtggttcgacgacctctggagccacgcgagcgtggtcgcccccacgtcgactccggcagcccgatctgctccgtcccagtcggctccacccccgcctgctgcgaccacacccgcgccgtcgacaccggccgcaacgagccaagctcccgcacctacgagcgatggcggcgacgctccctggatcccctacggcgcgaccgagtcgcaggtcgaggcgctgtggggcgccccgggctccatcacgaccacggtcgacgacggtgagccagaggtggtgtggaactacgcggccggttcggtcgacttcgagaacggcacggtggttgacgtcgaccgagcgcccgacgacgactgaggcgacgacgtcgtccgcgcccacgatcggacggcggccatcgactgctcgggacaggtggtcggcacctgtcgacgtcgaaagacgagcgggctgtccgcgaccgtcaccgcgagcatccggccccgttccagcgccgctgtcagcgcgagcggctccgaccccgcctcgacacgctgagtcgatcgtatggctcccaccgtcacggcaagcatcccggtccccgtcacacgcccgggtcgcacgctcggcgagcccggacccgacgacggtgcgcgaggtagcgccgtcatcgctggcgaactccgacaccgcgagcacacgcgcgccccgctacgacccttcgacgagccccaccaccgcatcctcgaggacactgcggatcacgtctgggtcctggtgctcacgcagcgccatccaatgactgccgtgggtgccgtcgtcgcacacggactcgatgcggatggccgccgagcgcccccgcctcgaatgctccagccaggcctcgacagtacccatcgtcgtctcgatcgccacgtggccggcctccttcagctcgacggccgcgcgcccgacgaggtcgacgacccacggctcgacccggacgaccggatcggtcggaacagcagggagcgcctcgagatggacctccgcgagcagggcatcgatgagtgcagcgctccctgcgacgtaggtccaaggcagatcgatctccgatgcgacgaaccacgcccgatcgcggggccacgccaggttggcggtctggtatcggccgaggccacgggtggcactgatcgcctcgacaggacccacgtagcagaggtaatcgcgctcgggaaggtgcaggcgaggtccctcgcgcacggctgccgggatcggatcgggcagcggttctggcaccgcgccgggtgctgcaagcagcatgccgccaaagccgtagccgtcccagaggccgaagcagcagtcctccggcgtcgacgtgtgctcgcgcaggagtctggcgagcgcgtccgcgtcgggacgagcgagcctgcctcgcgctggcccctggctgcgccacggtgccggcgcctcaggacgtacccgtgggaacgcgatggagtggaactgggcgtcgggacggagcgtcgtaccggcccaccgagcgacgtccgaccagcgaaccaaccggccatccgcctctggctcctcgacgggatgaaggatccgggcataggccccaaagccagccgggaccaccgaggtgatcgaaccaccgccgaacggcccgagccgacccgcgatccagtcccagtctccgttcggactgacccatctcgctggtgctgtgagctgcctcgccatgagcacatggtagctcgccccgagctgcggcgacggctcatgggcgccccccgtcgccgcgacggtgcccgcggtacagactgaagctcgccttcgcaccttcccacacgtgtgagggcacccggtctcgtgccgggtgccctcgaggtccgcgctacgactgctcgacgggggtggcagcgccgtccgtctggtcgagctcacggctcgccgtggcggccgcgatagagatgtgcggccgggcgatagcaaagtacaccgccccgatcaccacgatgacgaagacgacgagcagcgtgagccagtcgaagttgaacagtgcgccgcgaggtgagttgagcccggtgggggcgacgatgttcacgatcatcgccacgccgtagatcagccccagcaccgccaccgggacggcccagcggccgagctggaacggaccttctggacgccaccctcgcaaccgtgcgatgaggtaagcgagcaccaccatctggaacgagatgtagatgccggacacaccgaagctcacgagcgcagagagggcgttcacgtgtgctggataggtgatgaagccgatgtggatcggcttcgacggggtgaagtgcacgaggaacgacagcagttccgggatgatggccgcgatcaagatggcgcccaccggggtgcgacggcgtggcgagatgcggcggatgaagtgccaccccgggacggcgtggtctcgggcgtaggagaacgcgagacgagctcctgcgccttgcaccgccgtgccgcacgagaagaacgcgaaggtgatcacgagcaagatgagatcctggaagagcttggacgagatcgccgcactcaagatcgcagggacgccccccgtcgccgcgagcgcgaggcccttcggccctgacgggatcgccaggtcgagtgctgcgacgaggatcatcgacacgagccctccgacgacgagcgcgctcaccatcgcgcgcggcacgcgacgctgcgcgtcgacgacctcttcggcgacgtcgcccgcactctcgaacccatagaagatgtagaccggaccgaggatcgcgatcaacgccgcaccggtccaccagtgcccgatgaagttgaccccgagcggattcgttgcgacgtgcgtcgtcccagcgctcgagaacagatacgagaacgagtggtgcgtcgccacggagaacaagatcaccgcgacgcccagggtaccgagcacttcgaaccacgtgccgatccgcgagatcgaaccgaggaagcgaacgccgaagatgttgaaggcggtctggacgacgaggaacccggtcgagatgagcaggatgtcattcggagccgcgccatcccagtgggtgccgaacacgttgttgacgagcgaggcgaagtacccaggcacgccggtgtccacgctcgctaccgtgatgatgagcgcccagccgtacatccatccgacccaccagccgtagccgttgccgagcaggcgcttcgaccactggaacagtgccccggcaatgggataactcgagccgagctcgccgaagacgagcgcgacgaacagctggccgatcaccacgacggggatgagccacaggtaggcaggccctgccgaccccacgctgagcgcgtacaacgagtagaccccgacgaccggtgagaggtagcagaacgcgaccgagaagttctcgaacagcgtcatcacgcggtcgagctcttggcgataaccaagctctgcgagcctcgcggcgtcaggatcgtggtggtgatggtgggaggcgagttcgtcctcccatggtccttcaggcatgctccccccttggcttcgtagtcatcatccgacggatgcgccgccatctgcgcggcgcggattcaagcgacggcgacctctccgtcgcaactcggtgcgtgggcacgatcgcgcacccggctcctcgacatcgtcctggcaatccccctccttcgctccacgctcaccccctgtctgagcgttggcccgatcctactcctccgttgcacctggtgacacggacgtttcgccgagctccgatccgttgacgaccgttcgggcgaagtggcgatgcatccaggccaggtactcgccccgggccgtcacgatacgggtgaggtcccagcgcgggatggcttgttgggggaccgacggggccatgagtcgcggatcgacctcgaacacgtgctcgaagcgttggacgaccacatcggtgatccgccgtggcgtggggaggtcgaactcgtcgcgagagcgaaagctcacagctggcccccttggaacacgttccccttgcggaaatggtacttgccgggattcaagatgccgtgcggatcgagtgcctcctcgatcgcgtccatgatggccaggcttccctcgagctcctcgggaacgacgtcgacatcgccggcgcggcaggcgccgtggcaggcagagatcgaccccccggcgccgacggcaacccgagcgatggctcgcttggcctcgacccacgcgtcccacatcccgtcgtcgagcacctgctcccagataccgacgtcgatctcgacgaggtagtcgacgccggtatcggcgctggtgtaggcgaacgtaccccagtcgtcgaaggcgtcgtagcgacgtcgcagctcctccacgatcgcatgccattgcctggtgacggagacaatctccgggtgattgagggcagcgtcctcgcaatgccaccccatcggcacgacggtgccgtcgagtcggcgcccatggagcggtgttgcgtagcgatcgtggcgtgaggcccagtcgccttgggagatctcgtcgccgaggtagcgtccgccgaggtcggcggcgatgcgccagagccgtcgcccacccgcgcgcacctcgtcctcccagccatacaaggccgtacagaccaccgagcgcaccgaggcgggctgggggatgtaggcctcgtcgtcgcggcgcaggtaggcgaccttggcctcgtcgaagaggacggcgcccgcgaacgttgcgaccccggcgccagcgagggcgtcgacgcactggtgggcatcctcgtagcgtgcaaagccccagaagagggagagctcggcctctggcttcgggtagagcttcagcgtgacctcggtggcgatcccgagcgtgccctgatggcccatgaacagctgcttgagcgagagacccgtggaactcttcgagatcttcggtccgccaccgtcaccgatgcgcaccacgcgcccgtctgccaggacacacaggaaactgaggaccagatcgcgggtgtggccgaagcgggcgccgatcagcgaccagccgctcgtgccgatcctgccgcccaccaggctggtcgggtacgacgccggatcgtcgggatagaacaagccgaacggggcgagcgcctcgttgagcttgagcatgttgacccccaccccgaccgtggcggtgcgacgcaggggatcgatctcgtagatctggccgaagcccttcatgtcgagcaggatgccgccgtgttcggggaccgcaccatcggtgagtccggtgccgccagcgcgcgcgacgaccggcacgcgccgctcgttcgcgagcgcgaggatcgcagatacctcctcggtggtgtgcggcagcacgacgacctgcggaaggtgctcccgccaccgatggaccggaaacggcgccgggacgcgcgtgcgcgcgaggcgcgcccccgcatcggtacgaacgcggtcgggacccacgatcgcgctgagctcggcgacgagcccctcgtcgagacccacggcgaggctcatcggacccaccccggcacctcgatgggcgcaccacacgagatcgcgaccagctcgagcaggtcgatgaccgccatgccccgctcggcgcccgcgttcgagagcggccgctccgcccaggggcaggcggtcacgacggcgttgacctcgaggtccgccgcgcgcgccacccgccgacgcgagagctcggccgtcacctcggggcgtgcgatcgcgagccccccgccgcctcccgagcagtagctccactgggtcacccgatcctcgtcgacgaactcgagacccgggatcgacgcgagcagcgcacggggctcaacccagatccccttgcgcttgttcagtcgacagggatcgtggtaggtcacgcgggtgttgatggggagcgtcggagtgaggcgcccctcgcgcacccaacccgcgacgagatccaacgcgaggaccacctcgacgtcgtagtcgtcgccgaagtaacgggggtagtcctccgtgaaggagatgtagtcgtgtggatcgagcaccacgatgcgtcgcgcacccgctcgccgccaatcggccacgttgtgctcggcgaaccgccgcgcctgatccgcatagcccatctcagctgcgggtccgccgcagcaccagggctctggctggagcccgatcggctccccggcggccttgaagagccacgcgacggcctgtgggaggctcgtgcggtagaaggcggcctcgcagtcgacgaagagcaccgtgtcacctccgaacggaaggtcgaacgaactcgcccacgccctggagagctccacgccgacctcggcaaccacgggctcgtggcgatcgcgatcggttgccgcgttccacgccgaccacgcaggttcctcgacacctcgatcgacggcgagcgtgcgcgctgcacgaacgacgtcgaccgtgcgcgtgcggaagcggtagaagtcgccgacgaacagcgtgttcggacaccggagctcgcaggcaccgcacatggtgcagttgacgtagtcgcgagcgacgtcctcgaactcgaccaggccctgctccatcgcgacgatgttcgcgtggaacgccgtgggaaggtacgtctcgtcgcgcgtgacctggtagacggggcacacctcccgacagaacttgtgcccggacgagtagcagttgtaggccgcattgcgccacgactcgacgaaggcttcgtccgtggctggcctcgcggcgtcgtcgctgcgatgctggatgtccatcggttccctccctaaaacacctgaaatcagatgttagatcctttccagtgtgctgtcaagcactctcgaggtgcactcacacgacgatttggtagggtcatctcgatgcctcgagccgccgagcacgtgctcacgcacgtgccgttctcatcgctgcacgagaccgacaaggtcgaccaggtggtccagcggctcgaccacgccatcgcggccggactccttccgacgggctcacgcctgccacccgaagcgctccttgcccgcatgctcggcatctcgctcaccacgctgcgggctgcgctcggcatcctccggctccgcggcacgatcacgacgcgccgaggccgccaaggcggatcggtcgtcaccgccgacccagaggccgtgcgcgccgccgcgatcgcacggcttcgcacactcggtccctccgaggttcgcgacgagggcgacctccatgcagcgatcctcacgaggagcgcaaccctcgcggccgagcgcgccaccgacggcgaacgcttggcgctctcgctggctgcgaccatgctcgacgaactctctctgatgcatgagctccaactccatctcgaactggttgcactggcacagtcgacgaagctcctcgaggtcgaactcgactgtctcctctggttcggaggcttccttcagctccgctccgacaccgagaggagcgccatgctggcgtcactcggcagcctcgtggcggcggtcgccgagggaaccagcgaggaagccggtcgacgcgcgcagcgacacgcagagcgcatgacgcgatgggtgcatgccaccctcatcgccacgacgcatgaggacggccagcgatgagcccaccagacgtgctcgacgagctcatcggcacgctcgcgactgcgatgagcgacgttcgagcgctgctcgacgatctcgctcacgaggcagcgacccacgacgccgtcgaagtgctcgtgcgccgcgagctatcgcgaccgggctccatcgtgctcggggcaggcgtcattcgagcgggcggacgcgccgacagcctctggtggtggtggcgacgtggaaccgtcacgagcgagctactcgtcgccctcgagccgacgtcgctcacgttctacgacgtcgagcaccagccatggttcctcgagcccctccaatcaggcacactgaacctggtcgggccctacctcgatcgctcggggacgaacctgatggtcgtgaccgtctcgaggccagcccccggcgcgccggccggcatcgtcggcgccgacctcagcctcgacgccatcttccgactcctcgtggcgacaccggcaggacgccagctcccctgggttctcgagaatctcgagggccgggtgatcgcctcggccgaccccgcgatcaccgtcggtgagcgcgacgtcggaccgtggcgaatccaacgcgcctgtccgatgctgccgtggcgcgtcgtcgtgcgagcgtccgcggcagcatcggattccttcgcgtcgggctaggcgctgacgctgaccgtcgtcggcagcgtcgcagacttcgccgatgactggatggtgaagcccacctggatgctcgcgcccggctcgatggtgccgttccagctcgccggcgtcacggtgacggtgccggtcgaaccggagaccgtgccgttccagaggctcccgatgctctcacccgagggcaccgtgaacccgagggtccatcccgacaccggcgccgtgccggtgttcttgatggtcacgtccacctgaccaccaccccaccaggtcgaggtcaccgtcgcggtggcggtgagctggccggacgaggtcggcgtcggtgtcggcgtcgtcggcgcagggtcactcgcggtcgacgacccactgagttcatagctcgaggggaacacgccgttctcgggcccaccgttgagcgtgaagcccacctggatgctcgcgcccggctcgatggtgccgttccagctcgccggcgtcacggtgacggtgccggtcgaaccggagaccgtgccgttccagaggctcccgatgctctcacccgagggcaccgtgaacccgagggtccatcccgagaccggagccgtgccggtgttcttgatggtcacgtccacctgaccaccaccccaccacgtggaggtcaccgtcgcggtgcccgccaaggagcccgaggagaacgagatcgggccaggcgtcgtcgggctggtgggagcgggcgtcgggttagacggcggtggcgtgggatccgacggcggtggcgtgggatccgacggagcgggcagtgacccaccggcggcctgctcgaagatctgcgagaactgccacggggtctcggtcgtgccggagcagtagttcgagtcctcgtcggcgttgttcgcgcactcgacgtcgcggtggatctcccacatcgagagcctgccgaggccaacctgctcggcgaaggccccgagctgctgggcgtcttgggtggtgaagatctcacccgagaggtcgttctgccctatcatcggggtcacgccgaccatctgccagagctgggcggtggacaggttcgaccagatcgaggcgagctgttgctcggtggcctgggcggcctcgatcgccatcgtgcccatcgcaccttgggcctgggggatgccgtagtccatcgccatgacgttgacgttggacacgtcgacaccgtaggtcttcgccgagttcagcagatacagcgagttcgcgagcagaccccacggcataaccggcagcgtgtaggagacgctcactgggtggccttgcgctgcttcttgttgctggaccagggcgagggcctggttgcgcaggttcacagcggcctggtcgttcaggtccgaaccctcgatatcgaagtcgaggttgtagacgtggtaggtgttgatgacggtctcgtaggcttgggcgagcgcctggggcgaggagcacacctgggcgagctcctggttgatctcaccgccgaaggagacgatgggcgtgccaccctcggcttggtaggcagcgatctcgttgcggaagaggccgttgttctggcccaccgggaagtagttgccccagctcggatagcaggtgcccttcgagctcacaatgaacgccagcgtgagcgccttggcgccggactcggagccgagctgggcgagggtgccggtcggcggcagggtcatgtccacgtagggcgcgaaggccgtcgaggtcgacgaagtcgtcgaggtggacgaggagaccgtgcttgcctgcatcgtcgaggctgccacggtggtcgtcggggcccaaccggtcaggttcgagatcacgatggtctcgggactggtagccgcatcgagctggagaccgaggacgggcgaggttccgacccccggaccgagcgcgagggtcgtggcctgctggcccacggttgcgtcaggcaggaacgaggcgtggtacgaggaggacagtgcgaacggcgtcacctgcgcatccccggtgggtgagctcaccgacacggtgtagccgtcggcaccgctcagcgcacagctcggccccacgagctcgacagccggatagccgctcgttgcggtgacgctgataccggcactcgtctgcgtgatcgtggcgttcccccatcgcacctggggcgtgcaggccgcagcacccgacgtgcccgccatggcgatgggcgtcgcgacgccgctgatcgaaggctcgtcgatcacacccgtgagggttgcaccctgaggcacggtgagcgccacgggggtgctcgtctcgacggccgagcccggttggacgagcggcacgaggttctgccccgtactcagtgcgatcgtctccggggacgcggcccccacgggcgtgagagcgagcgacccggagcccgccgtctcgtcgacgaccgcataggcctgaccgagcgctccgagcgcgggcaccgagaccgtcgagcccgacgccgtcgtcaccgagggcgcggcgggctcgttcgcctgcaccgcaccactggcaaggcccaggctctgctgctggaccacgacccctccgtcgaagggggttccctgctcgttggcgatcagcgacggaaaactgcagctgccgccgttgggtccggcgaaccagccccacgcggtccaaccgatgccgtgctgctcgaggtagtcgacgatcgactgctcggtggaggtcggatacggggtcgcacaccccagcacgccgaactccgtcgcgacgaccggggcgagcgacggcacggttccgagcgatgcgctccattgcgacggggtggtgggcgtgctctcgtgcacgtagagatggaagccataggcgacattcgcaccagcgaggccccactcggcgatcggcgcgaggttgcctgcccagtgattgccgtcgacgatcaccacgttctcggcgccggtcgcgcgcacgatatcgaggagctgctgctcgccaacggccgtgtaggactggccggtatcggcacaggtgatggccccgccgttgcgccacacggaccatgggatgtcgtggggctcgttgtagagctcgaacatgacgttcggatcacccttgaagatcgaggcggcctgctgccagaaggtctcactgggcacgtccggggcgcacgcggggttggccgagggtgtcgcggtcaccgagtcggccccgatcacccggtgaagatcgatgatcgggatcatgccgttgtgctcgacgagcgacacgaccgactcgacggttgcgatgtagccaggggcgtactccggcgaacccttcagccagaaggcttcgttaaccgggatacggacggcgttcgcaccccactgcttggccatcgcgacgaactcattcggattgacccccgactggctcgcgttggcccactggccatccggattccacacgaggctcggccagtccacgccgtggagatacacgggcgctccggctgcgtcgacgatgacgttgccacggacctggaacggaccgctcaccgcgccaggaggtgtcgccgggaacgcggtcgcggctgccgtcagcgctgtctgtgctcccaacacgctcgcgatgccaccggcaacgaggccaagagcaagagccacgcgcgttgccctcgacaacctcgctgcatgacgtgcaaatgaaaccatgccgtggccatcggcatcgcaaacctcgaacctgaaccggccgcgacgatctcgccgaacgggcagttcagcgtgtcaacggtcgttgagcaccgcagcagctgggctcggcctacgcccgacgcgacgcacgatctccggatcgacctggcgggcatcgatgctgatccggtagcggcgaggcgacctccctgccgagaagaggctgatggggatcacaccgtgacgcgcgtgctcgttcaactccgaattcaacctcgacaaacgggggcgcagccacgcggtatcgacgcccgacctcgtggcccgaatggtccgacggtcgatccgaacatcgatggctcgagcaagctcgatgagctccgcaccgagcgcctggtcgcgctggcgctcgcggggagcggcgagccagccatcgccctcgacgacgcgacgaaccagcaagctcaggagcagggtcgacgacggacggaggtcgaggggaacgcctccccagacgaatcgcgacatcgacccgacggtctcgagcgtgaggatcggattgagcgcatcgttgaccgcgcgaacactcagggcaagctcggcgccgacgccgaggagttggcgaaacgcgctcaggcgaacataggggacgtcgatgagcgtgaccacgcgcgcggcagcatcgaggcgcacgccgtcgaggttcacgatcgtgccctgctcgcgactcgggtagtagaacgagggagcccgctcgtaggcgggagggacgatgacgtgcaggagtcgatcgcccgcccgcgcatacagcgagaacgccaaccccacgtgataggccatggtcttacgaccgccagagagcagggcgaggatcccttggctgtcgtccttggccagttcggcgagctgcgcgaacaccgcctcacccgaggcgagggccgcctcgttggagtcgacgtcctcggcgggaatcgcgacggacgacgcctcgatggtcgacagcgacacacgcggtggtttcacgccgggggcccattcctggtagaggcgagccagccgcccggattcgccgaggagccgctgcgccagatcggcaccgacacgcgtggcgagtaggacgatctcgtccggaacgatcggctccggctgtgtcgccagcagcgcccagcaggcctcagtcacgacctgcggtgcaagtcctatcgttgcgaacagcgaccaggaacgttgtccttcgccgttgttcacacaacgaaatgtagcgccaccaccaccccctgatgacccaggaccagcgtttgcaatgttgcaacttggccgacggacatcaccaaatgatgaacattgcaatcttggttaattggtacggggagtcagggcactgcatcgtgcatgctggagggcatcatgcacgttggacgtcgcgagtcgccctgagcgcctcacggaagcagcaacgctcatgcgccgaccgacctcgcccgaacggctaggcccggctcgcaacccagacgtcagcgctccgtggtcacgcaccgcccagtggtctttgtcacgaccgactaggacgtcgtcgcgctctgtgcggtgtctacctcggtcgtcggaacggcgcgcgcgaccacgaggtgacacacctcgcgttcggggcagtcttccggtcgcagggacgcagctcgcccgaggaccatctccagctcgtcacggagcatcacgagaccggcgatctgttgctcgacccgcgcacggtgacgctcgagcagcgtcgccacatgacggcacggaacctcgccatggtcccgcaccgccaggatctcgcggatctcccctagcgaaagacccagcgtctgcgccgcacgaacgaactcgatgcggccgatcgcgagatcgtcgtacacgcggtagcccgacgcatcgcgaggaggctcggccaagaccccgatcgactcccagaatcgcagcgtcttcgagggcacgccggttcgttctgcgagctcgccgatcctcatggctgaagcatagctgaatccgcgggtacaagattccagctagctggaaggcgcagactgatgtccagacacaccgagtgtaggaggaggacatggtcatgagcacccttcacgcatccgctccctgggatctcggcatcatcggctctggctcagccgcctttgccgccgcgctcgaggctcgcgcacgcggcgcctcggtcgtcctgatcgaacgcgatgcgctgggcggcacctgcgtgaacgtgggttgcgtgccctcgaaggcactgctcgtcgcggcacaccgccgaagcctcgccgcatcggcgtacccgggcctcggagccgagacactccccatcgaccacgacgaactcgctgccggggttcgcggcgtggtttcgagcctcgtcaagcggaagtaccgcgatctcgctgagcggatggggatcgacgtacgctacggtactgcgcgcttcgtgtccgacgagacggtgagcgtcggcggtgacgagctcaccgcgcgccgctggatcatcgcaaccggtgcccatgcggtactgccatcggtcgacggtctcgacccagcggagctctggacctccaccgacgctctcacggcgctcgagattcccgctcgcgtcgcgatcatcggcgccggctcgatcggtctcgaactcgcgaccgcctacagcgggctcggagcccgggtccacctgatcgagagcactccccaggctgtcgcgagtgcgccgctcgaactgacaggagccctggtcgagcacctccgcgcatccggtgtcgccgtggcgctcacgaccacggtcggttctgcacaggcgacgacctcagggtggctcctccagctgcaaggaccagaaggtgcgacgcaggtggaggtcgatcgggtgatcgcggccgtgggtcggcgccccaccaccgagaatctggggctggagacggtcggcgtcgaactcggggcccgcggggaagtcgtcgtcgacgccaccatgcgtacgtcgaatcgaggcatctgggcggccggcgacgtgaccggcggaccccagtacgtctacgtcgctgccgcccagggcgcgctcgcagcccgcaacgccctctccgacggtgacgagcacttcgacgaccgcgcgattcccgccgtcgtcttcaccgatccgcccctggcccaggtcggtctgacgctcgacgaggcacaacaccagggctacgacgccgagtcgaccaccttctcgttcgccgatctcccacgtgcaatcgtcgagcacgcgaccgagggcctggccgtcatggtcgcagaacgcacgagtgggcgcctcctcggcgtgcacctctggggcgtgaacgcagccgaagtcatccagagcgccgtgctcgcactccgcaccaatctcacgatcagcgacctcgcgacaacgtgggcaccctacctcacggcctccgaggcgcttcggctcgcagcacagagcttcacaacggacgtcgcgaacctgtcctgctgcgcctaggtcgcctcacgagcgacgatggactgcggaccgcggacgtcgctccgccgatggtcagggcctgagctgccccgacgagcacgcgggacgctcgcgtcgcggaggcgaccgctcggccgcatccacggacgggtgtcgggcccgatcagctgagccttcgcgaaaccgacggaaacctggtcgcctggagccgtaccgcgaggcaggtgcgttcctgcggtgggcgctcaaggccttgagcgatcacgcctccggaggtggggcctgctgggtgctcaaccggatcctgatcggaccacgcgccgtcgcggggtcgaccggccgaccgtgctgcgtgatctcgacgacgttgcgagtcgccagacgtcgagccgctgcacgggccggctccacgagttcgcgccaccggtcgcctccgactgcccgagcggcctcggaagggcagatggagccacctggacgccgcccgacaagcaggtcgcagatcgcaccctcgagcgcgacgtcgatggcacgggattttgctcgccgacacgcatcggagcagtagcggacctcatcccaggtccgctcccaccggcgtcgccaagtcatgactcgaccacacgtcgcgcagaccttggcgggtacggcacctttggttgggctgcgacgtgaacgagccacgacgaccgatccccgagggatcgatccggatcgagaccgcgccacgttgcacagcctacgaacctctcacacgactgtcgcgctcacgacgcacgaccgtcgcaacgccacgatcggcgtaacggcgcgggccgcccgacacgagtccctggatgcagcggtgaggatggcgttcgtgcgacgctcttgcggcgtcgcctggcccactcccacgggtcggtagaccctccgcagcgaaacgaatcgcgctggtcctcggcggttcacaccggttcgcaccacaggtccctccttccctctactggccctcgggaacgagggcagccgcaccactgcagagctgcgatgccagcgacgatgtccatggacgacccgccgacgggttcggccgggaccttgctcgacgttctcgcgctgcgccgtgctcggtcggcgcgcacccccacaccaccacgcgcgctgatgccggattttcaccagctgcgggcccctcgatgccccacgaccatcggcctagtctgcctcatcggcgcaccagaacgcggggtggcggcctctggacaaccagcgcttcttcgagccacggagatcgcaccaccaagcaccgaggccgccatcgttgcggccgcgcatggctcgtagtcggcgtgcggcgcatgtgacgctcgaggcggcggggccgccgccggccaccagactgaggacgtgggaacacggccaaccaccgtctggatcctcggcgaccaactcaaccgatcgatctcgtcactcgagggggcagacccgtcgtcgacggtcgtgctgttcgtcgtcagccgagccaagctggccgcccgcccatggcatcgccagcgtctgcacgccatcctcgcggggatggcgcggttcgcagccgagctgagagccgagggattccgtgtcgacgagcgagaggccgacacgttcaccgagggtctcgcggcccaccgcgcctcctatcgacctgagaccgtgcgcatgatggcgccggagtcgttcgctggcgaggcgctggctcgccggcttggggtcgaactcgttgcatccaacctcttcctgacgacgcgcgaggagttcggcgagtggatcgctcagacccttgagcgtgggcgtcgcccacgcatggaggagttctaccgctggcagcgtcggcgcctcggcatcctcatggacgaagacggacccgccggaggccgctggaacttcgactcggagaaccgactgcctccgccacgagccccggttgcatggcccacggtgatcgtcgatcagctcgatcagctcgatgtgcgtatcgtggcctcactgccggatcaagctgtcggagacccaccccagggttggtggccgaccaatcgggtcggagcactgcgacgcctgcgcgccttcatcgacgagggacttagtcgcttcggaccgtacgaggacgccatgttggctgacgaaccgcgcctcgcgcactccatgctctccgtcgccctgaatctcggcctcctccacccgcacgaggttgtcgaggctgtcgaacgcgcctttcgggacggtcgcgtcggactctcgtccgccgagggcttcctgcgccaggtgatcgggtggcgtgagtacgtgcgtgggttctattggtggcagggccccacgtatcggagtcagaacgcactcggtgctgagcgaccattgccgccagcgctggccaccggacgaaccaggatgcgctgcgtgcgaacgacgctcgaaggggtcgagcgccatggctgggtccaccacatccaacgactcatggtgctggcgaacctcggcaccctcaccggcgtccagccggccgcgatgctcgactggatgtgggagcgcttcgtcgacggagcggagtgggtcatggtgccgaacgtgatcggaatgggcctctgggccgacggcggcgtcatggcaacgaagccctacgtcgcgggaggtgcgtacctgcgacgtatgagcgactactgccgatcctgtgagtacgaccctcgtcagcgcacgggagatcgcgcatgccccttcacgacgctgtattggtggtttctcgaccgacaccgtgaacgctttgctcaccatccgcgcatggccccgctcctgcacaacctcgatcgactcggtgacctcactgcgatccgagagcgtgcccggcagatcctcgaactcctcgacgcgggcctcgcctgatgtgcccgagcccgactggttcttcgagtcgatcgtcaacgtacgaccgtcacgggcgatgtgactccggacattggatgagaacaccgatgccggagacgtgtcgccaccctcgatggcatcctcgccgagcgaggagccccaggcttccgccgagtcggcaacggcccggagtccgtggcagcttccgtggccagctgggcagccgaactcgcggtgacctcgtgattcacggatccgggctccccgcggcggtaacggtccgggttcaaccggtcgttgcaacacccccgatgacgcaggtgcatgtgcaaccaaacaggaaccaggctcctccgggagcgaggcgacagtgggcggccgatcgtgccctgcggccgccgatgcgctccccagggcggccagacccaccacggatgctccagtaggccttctggcagctcatcgccacggggatctcgaccgcggacgcctgcgagcgcgtgggctcgcgcgtgctacgccaacctgtgctcccatgcccgctacggagcctcccgagcggtcatcaccaccgtccacaacgaccgctggcggagagacggccgaccccgagcctcgtcggctcgaccggcggcagaagttcgagtctcacaccgagacttgatccagacacgcgacatccgtcgtcaatggagctgacgacttctcactcgaacctgcctgaactgcgggaacggatcaatgcgttcgcccgcaccgacaggagccaccatcagacccggatcacctcgaggcccggaacggcgtcgtagtcgcggtcttgagtgacgaccgggattgaggggaccccaagagttgagccacccgctttgcgagttgatgtgcttgtcggtggagccaggcctcgacgaactcgaccggagtgagccagccgtgtgcgctgtggggcctgttcatgttgtagtcgatcctccagtcctcggttaggacctgggcttcgaggaggctgtcgaactgctggccgttgaggtgctcgtcgcgcatccggccgttgaagctctcgatccaggcgttctgccaggggctgccgggatcgatgaagacggtcccggtaccgttgaaccggcaccagtcagccacggcgtgggcgatgaactccgggccgttgtcgaagcggacgtagactggggcgctgcgacctgcggccaggcggtccaggcatctgaccaccccgtcggcgtcgatcgaacgctcgacgtcacaggcgagggcttcgcgggtgaactcgtccacgacgttcaagaagttcaagaacttgagcatcctcccgtccgacgtctggtcgaactggaagtccatggcccagatcacgttgggccggatcgggcacatcgccccgacgggcttgccgatcccccgcaggggcttcttgcgctttctgtagggcacacgcaggccttcggcgatccagaggcggtggatgcgcttgtggttggcccgccagcccgccttcttcgcctcgacggcggcccgccgccagccccagcgcggacggcgccgggcaaagtcacgcagccacgcccgcagtgccagctcgtcgtcggaggggatggggggcttgaggcgctgagtcgagcggggctggccgacgacccggcacgcccggcgttcggtcaccccgaactactctcggagggccaccacggcccgccagcggcagtccggggtcagaagtttccccggttcagctccttcaacatgtcgatgtcgagggcctggtcggccacgatcttcttgagacgcgtgttctccttctcgagctccttcagccgcttgacgtcatccgccttcatgccgccgtactggttgcgccaacggtgccaggtcgactcggtgatctccaggtggcgggccacctcctcgatcgactggccctggccgaggagcttctcgccctcagccagcttccggatgatctgctcggtcgtgtgccggcgtctcttcatcgtgtgctgtcctccttccccacatcgtggggcttggactcgcacaacgggtggagcagcctacggggacccggccaggatcccttcgaccatcgcggttgccgcaacaagcacgtcgagtatcgggacccggcggcgctcagcgtgcagcacggcggccacacgggcaaactgacgcgccacctcggcgtccaccggtagcggatcccacgtcgactccacggctgaaagcgtcgccactcgcgccggtcgatcatcgtcattcgccatgagcacgccgagcgtcagttcggccaccgtcaccaccgacacctctgtgtcggtcaccccttccatcgcgcccaggggtcgacccgactcagtggcgacgaagaacgaggtgtcgagcagtgccctcatagatcgtcggtcgtgtcggacagcagactccgcacctccctcaggagcccgcggtcggccgggtggcgagacgcaattgcgaccgcctcggtcgccgacaccgtccggcgacggcgcaagggcacgatctcggcgaccggtcgccggtcaaccgtgaccgtcaacctctcgccgctctcgacccggcggatcacctcgctgaccgtgttccccaggtcccgcaccgaaatagaaccactcacgtcgctacatgtagcacatgtagccacaagtgacccgcgtggagacgaggggactcgaacccctgacctcctgcgtgcaaagcaggcgctcttccagctgagctacgcccccaaggcttcgctcatgctaatggatcgtgctcggaccaccagtggtccaggcccttctgcaccatcagcgacgtcccggaccaagcaaccgcaggctcacaggctgcacggctggaccacgactggtcaccagtcggacgcgctcgaaaacgtgtaagaccacggcattcgccgccgcaccatcgagactctacgtctgtgccagccccgagcggggccggcacagacgccacgcggagggagtgggattcgaacccacggtacccttgcgggtacagcggttttcgagaccgcccgattcggccactctcgcatccctccccgcccaacgaccgaagtcgccgaacgcaagcagagtctacggcacgacgcctgggcgccgctccgagaagaaacggcgaaggagcaaagcagctcgttcggcatcgaccccgccgacgatctcgagctcgtggttcagccgcggatcggcggcgatgttcatgagcgacccgcatgcacccgcctttggatcccaagccgcaaagacgacgcgtcgggcacgggcgagcaccagcgccccggcacacatcgcacacggctccagagtgacgtacacgtccgcaccgaggacatagccgtcgccggcatcggcgagcgcatccgacagcgcaagcagttccgcgtgcgcaaggctggagcgccgctcgatcgtctcgttgtgacgcgcgccgagcacgcgaccactgcggaccaccacggcccccaccggaacctcagccgtccgcgcagcatcctcggccagaccgaaggcgacgtcaagccaccgacggtcgtcagcgctgagcatcgacgtcagggggtgcgacgcgcttggacgcgtcgaccggtcgagtctgtcgcttggcgatggtcgtgaccacccattcggcatacggatcgtgcgggagcgcgacagagcgaaccagcacctccgggacgtcgtacgggtgggcagacgcgatgagcttcgtcagacggagcacatgctcagggagtgacaaggcccgcacctcgacctcgtcctcggtgtgccagtcgccctgccagtagtaggtcgagcggaccccatcggtacgcttgacgcaggcacacaggccggattcgacgagcgcgtccaccagcgccgctgcgtgctcgtcacttgcgagggtggtgacaatctcgactgcgtcgatcactagcccctccgctcggtccccgccactatagtgatctgcgcttgtgcgctcgtagctcaacggatagagcatctgactacggatcagaaggttgggggttcgaatccctccgagcgcgccacaaagctcctggtaagagggttgacggcacgtggactgggcgtggttcccgctcgcgaagtcaacggcaggcccaggcatcgtgacaccggtcggcgcactccgctctgactcggcgtcctaccaccgaagggtgcttctgtcaggtcgccgcgccggaacatcggcatctggtcctggaacaggtgcagattgctctggaacgtcgttcctagcttgatcctcgaaggttgatcgcgacgtggtcggcttgtgggagtgtggttactccctcggcgtccagggccattggtcgatgtaggtggggatctcgatcgagctgcgcccatagcgcgaactctcgaggatcgcgcagctacgatccgctgtcattgtgagcgacgtccgaagggcttggctgatcaatcggcgcccggtcgagcatctcggtgtcgagctttcgggcccgactgcgacggatcgttgctgcagatctgctcctgaagcctgattcaccggacagacggaggacgacgggcacgatcgctcggcacccggagcggccgccgtggagctcggcggactccctagacggtcgggatgcgacgacggattcgaaggttgggggttcagattcctccgaactcgcatcgccgtccagctgagggggcttagaacctgcaggcaccctgccgatcacgtgcctcgtacgcttgcttcgttcgcctggccaagcgagaacacgggctccggccgatgccggagtccgcaccagtggcctcctcccttcgaatggcactggtgcgaccccgcgtcactcgagcccgaagagtgaaccggtgagcgttgcggcccgccgcgcgcgtcatcagcgaccagcctcaccatgccggtcggcaggtttggagcaggtcccagtgtgagagaccatgcccgccccggtgccaccgtactacgtcgaaatatcgggatagggaagccggacgtgcgagaggcgccgtgcgtactctcgctggaaaccgagaggctcctcgtagtcgtgctcgaacagggcgatgaacagggtcaaggtgaggaagtggtgggcacccaattcgaagagccgcacgtagtcgtgcgtggccagggcctctcgctcctcatcactgaagcccagccaggtggtcgcctccccactgtggaggttgaggacgcgattggcccgctcgcgctcccaccactcgaccgttccccgcggatccacgcgatagcgcgcgacgagttcgggatcgcgatcgaccgtgtagagaaacttgtctacgagatagcggctcacgcctcccccctcctcggataccaggtgaaatatgcctccatcgtgtggaacaggtcgaggttgtcgacgtaatcggctcgcacaccctgaccgacgacgcccatcatgagcaggaagtccatgaatccgtgcgtggcgttgcccggcagccagagactctcgagactgacctctgccagagccccatcgatgtcagcgttcgcgatccactggatcgccttctgatcgaaatctgggtccggcccgtgcggaccgaactgacgcggtccgcccaactccagcgagagatgtccagttccgatgatggcgacgcgctggttgctcggccactgctcgacgatgcgccggagcgccgctcccagctcgacgaaccgtttgggctggggcatcggcggcgcgaagatgttcgtgtagacgggcacgatgggcaggtcgacctgcggtcgcagcgtgatgagcgcacacgtgatcgagtggtcgatgcggagctcgttcgagaacgcaagatcaaagccctcgtcgagtccctgtcgaaggatgtacgcggcgagttcctcctggccggacacccgcatacgtgggagtccgaactcccgctcctcgttgtagtagttcgcgtcgaacaccggcgccttgccgaccaggaactgtggcatgttgtcgagccacagttggtgaaagtggtcagagccgaccatcacgagcacgtccggctcggcgcgggtcaacgtctctcggaacgcctcgatcttggcgacccagacgtcggcgaagtcggggcgatcggctccggtactcgtgctcgccctgtagtagaacgggtggtgcgtcgacgcgatgatcgcacacacatcggccatcatgccccccttcgtgtcatgctaggcagtcggatcgcttgcgcctggggcgacgtagcgcgcccctcgatccaccgtgaggtacacatccatcgcgatgggccgccgacgctcctcggcaagatggccaaggatcccggcggtacgcgcgagcaggaccacgcctcgcgcgagttctccctcgatgccaaggtcccagagaacggccccggctgcaccagcgccgttcagcggcagccggcgaccgagtatgtcggcgtgcactcgtccgatcgcctcgaagagtgccacgtgcggacccgcggcgccctcgcgtcgcgccagttccatgagcacgcccgtgcgcgggtcgcgctccttgtgaaccgggtggcccaaccccgggacgtagcgcccatcacggtgggcgctcgcgactgcgtcccgagcgatcgcatcgaagtccgacgcggtctgcggtgtctgctcggcacgggccaatgcgtcggcgagaaagcgaccggtatcctcggtgactccgaggaacctggagcccccaccgaggattcccgcagcaagcgccccctggatcgactccggcgcgctcaggagcgtcaaccgagctgcgatcgcggtgggggtgaagccgtggtcagcgagcgagaccaagcacgcctcgaacacgcggacctcgccagcgctgggtcgcctgccggtcacgagccagaaggccagctctccgaagctcaccgaacccatgagctcgcccgcgaggtcagccccgagcagggtgatcgcctcgggcgtggatacgccaatactggtcgggaactcgggcgtgctcaacggtcctcctccatcgggcgctggagccagtcccggatctcgtcgccgtgctcgtcatgggccggcggaggaaggtcatagcgtggcgccgtcttcgaatagatcaccgggtggcgcgtctggcgtacggcgcgcgacccctcccccaccacgatgacaggctcgagtccgatgcgctcggcgaaggcaacgccctcggccacggtgttgatcggtccgcacgggacgccgacggcggtgagccgctcaaaccacgcgtccgcactgtcgtgacggagttggtgctcaagcagtggccgcagctgttctcgatgagcggtgcggtcgtcggggtgggcaaagcgcggatcctgggcaagttcaggcacgccaaggacgtcacagagacgagcgaactggacgtcgttgccgatcgtgacgacgagttcaccctcagccgtcgggaacggctcataggggaacagactcggatgcgcgttgcccatgcggctcggcaccacgccgcccgcgacgtaggcgctggtctggttcaccatgccggacaacgccgaggcgaagaggctcgcctcgaggtgctggccctcgccggtcaacgtacggtgatggagggcggccagtatcgcgatcgccgtgtgcagtcctgtcatgacgtcgaacaccgaaatgcccgaacgcagcgctgggccgtcaggctctcccgtcaagctcatcaacccagacatcgcctggaccaccaggtcatagccgggcagttcccgcccaccctgactcgtgccaaagccgctgatcgacgcgtagacgaccgcggggttctcggccgcgacgtcctcgtaggcgaggccgaagcgtgccaatccaccaggcttgaagttctcgacgacgacatcagcacgacgtgcgagttcctgtgcgagggcacgatcgtcatcgtccttgaggtcgagaacgaccgaccgcttgttgcggttgatcgcaaggtagtacgtggacgtcccgtcggcggtgaccggaggcttccaaaaacgagtctcgtcgccggtcgggctctccaccttgatcaccgtggcaccgaggtcgccgaggagcatcgtgcagtagggaccggcgagcacccgcgagaagtcggcgaccaggaggccagcaagtggcccacgcccttggtcctggttgcgatcgtccacgcgaactcacctcgttgccacgcaccgcacgacgtcacgaacccgccgaactcggagtcgaccccgacgtgtccgtagatcggacgcctgtccgtctttgcgtggatactaaaggttcccggcggtgctgtcaagcgtccgggccgaatgcaagccgtcacgcaccgccaatggcgctgccgcgatccgagcgacgtcggcgtcgatggccttggcggtctcgatcagtctcgggagatggtgctcgagcaactcgtccagactggtctcggcagcatgcacgttcacgttgacagccgctaccaccttgccgtctggatcatggagtgcgacggcgatggagcgaatacccacggcgagctcctcgtcggtgagagcccagccccgctcgcgcacgttggcgagcacgcgccgcagctcctcgagggcaggggcacgacgcggcgtcaccggagagcgcgacggcacggccagggtgcgctccagttcgtcgtggtcgagatcggccagcagcaccttgccgagtgacgtcacggaagccggaaagcgcgtccccacggtcaccgcgattgccacgatctttggcaccgcaacccgggcaacgtagagcacgtccgaaccatccaagacagcgatcgaggacgattccctggtctcggccaccaactgctcgaggtgaggtcgcgcgacctcccaacgactcctcgcgagcaccgacgccgtgccgagatccagcaccctcggggtcagctcataacgcccgtcgtctcgttgccgaacgtaaccgagttcggccaacgtcgccaggatgcggtgggcggtcggacgcgcgagatgagctcgggtcgcgagctcgacgaggctggctggctcgccgcgaccgaacgcgagaaggacgtcgagaccccgggcgagcgactcgacgaagtcggggttctcgctgcgtctgaccaccgtgctccctctcgtccgagcccagagggagcctactcggtgcgcgcctgcacgatcgatgcgaggtccttgacgacagacgagcgatggtgcatacttgcgcatcaccatacggacacatgtccgaaactgcggaccagcagcgaccggtccagtgccgacgaagggagcgagcatgcgaaccagcgaagtcgtccgcgagccgatggtgctgcgcgagggactcgtcctcacgatgaatcgggcccacgacgtgctcgcctcgaccgacgtgctcgtccggaacggacggatcgaggcgatcggcccgcgcctcgaagtgcccgagggcacccgagagatcgacgctcgcggcggcatcatcatgcccgggatgatcgacacccaccggcacatgtggcagaccgcaatgcgtggctacggagcagactggaccttaacgcaatacttcgtgtggtactacctcacctggggcaagcggttccgtcctgaggacatctgggcagggaacttcctcagcgccctcgaggcgctcgacgccggtgtgacgaccacggtggattggtcccatggactccagaccgtcgagcacgccgaggccgccgcggacgccctcgaggaggctcccggacggttcgtccttgcctacggcaacattcaacaggggccatgggagtggacgaccgaccacgcgttccgcgccttcgtcgagcgacgtttcgggggcggaggcaccgagctcctcgggttccagctcgcgttcgacgtcaccggcgatccggcgttccccgagcgagccgccttcgaggttgctcgagatctcgacgtcccggtcaccacacacgctggggtctggggtgccaccaacgacgacggaatccgtctgatgcacgagcacgggttcatgacaccgcggaccatctacgtccacgccgccaccctgtcgccggactcctaccaccgcatcagtgcaaccggcggctgggcatcggtatcgaccgagagcgaacagagcgccggtcagggttacccgcccacctggcagctgcgacgctacggtatcggcgtctcgctctcgatggacaccagtgtgtggtggagtgccgacctcttcagcgcgatgcgagccactctcggcgccgaccgcgcgcgcgagcacctcgaggcgcacgcccgcaacgaaaccgtcaccaatcaccacctgcgtgccgagcacgtggtcgaatgggcaaccataggtggagctcgcgcactgggcctcgaccacctcatcggcagcatcgagatcggcaagcgcgccgacctcgtcgtcctcaagaatgaccactcgccagcgatgacgccgatcttgcacccctacggccacgtagcgttccaggcccagcgagccgacgttcacaccgtcatcgtcgacggggttctcgtcaaggacgaccatcggctcgtcggtgaccatctcgcccgagcgcgacgcggcgtcgacgagaccgtggcctacctcatgcaagagcttggtgacgaggcatggctcgaagggatgcatccggcgatcccggagctctcggtcctcgagaacccctatacctacaccgagtggcgcagcgagagcgcacgttggcgggaccgcggcggcccggacacctccgagcagaacgccgatggcggcacgcccaagccgccgtctgcctgacagagcccgatagctctgcccactgaggtgggcacttggccttcgaccgagaccaccggcttgggcgcaccagcaggtgcccatgggtcccccgtcgtctgctccagagtgcccacccggtggaccactgaccagagctgcgacgacaatggtccgcaagacctgcctgcaccgcgcagctccagacgtcatcgattgatgagcttgcaggaaacccgcggctggtatcgacggcctcgaggccgacggaacgacctcaccctccgcacgcggcagcccgctcgctccgacgagaggccgaccacccagcgccctgccatgaccgggagtctgcctgtcctcgctcggggcgaggtctttgtactctaccactatttcgaagctggagatacactgaggagcagcacaagcagaagggagacggtcatgctcacgatgcatcgtgttgcgctcgcagcgctcatggtcgcagcgggaggagcttcgctcaccgcctgcggatcgacgacgacctcctcgaagccgacgaccaccagtcccaccgcagcgatcaagaagagctacaccgacttcttcgccggcacgacgtccgccgcaacgaagatctcgctcctccagaacggcagagagttcgccgacatcatcgacggccaggcttcgtcgtcgctcgccaagagcgtgcaagcaaccgtccagaaggtgacgctcacctccgggacgaccgcacgcgtcgtctacaccctggacgtcggcggacagcccgcactgaagaaccagaccggcgaggcggtcaaggtcggtggccactggctcgtgggtgatgggagcttctgtggcctcttggcgctcgagggcgtgaagaacgtacctgggtgcacgagcaccgctggctaagaccgtgcatccgtcggcccgcgcacgagcgctggtggtgctctgtgcggtcatgtccctgacgttcctcgacaccacgatcgtcgcggttgcgctcgccagcgtgcagaccagcctgcacgctggcgtggcccagttgcaatgggtgatcggtggctatgcgctcgccttcggcgcgctgatgctgcccttcggagcgctcggggatcgcttcggtcggcggcgcgcgatgctcgtcggtctggcactctttgctgttggatctgcgaccgctgcgcttgcccactcacccgctcagttgatcgccgctcgcgtggtcatgggtgtcggcgctgccgccagcgagcctgggacgctctcgatcattcggcagctctacaccgagcccggcagccgcgcacgagcactcggcgtgtggtccgcagtagcggcactcgcgctcgccgtcggaccggtcatcgggggagtactcgtcgggattggaggctggccagcgatcttctggttcaatgtcgccgcgagcgtcgtcgtcatcgtggtcacggccatcgtcatccccgagagtacggaccccggtgtcgggcgcatcgactggggtggagcagcactcggcctgatcgccatcggtggggcgctcttcggcgtcatccagggcgaggcacgcggctatggcaaccctctcatcgtggcggtcttcgtcgtggccgccgtcggtttggccgtcttcagcgtccttgaggcacacgtgccgaacccgatgctcgacctgcactaccttcgtcgaccaggcttctccgggtcgctggtgctggcgttcagcgtgtacttctcgatcttcgcgatcttcttcttcactgccctgtatctgcagatcgtcgagggctacagcggctaccgcatcgcgtcggtgttcctcccgatggcgctcgccatgatcctgacctcgctggccaccggacggtgggtagcgcgcattggcgtcggcatgcccatcgcactgggatcactgctcgccggcctcggcgtgctcggtgccgacgtcggcctcagcggcagcacgcatccattggtgctcgccctctccctcaccgtggctggactcggcttcggcaccaccgtcgttccggtcacgagtatcgcgctcgccgtcgtaccgcagcagcactcaggcatggccgctgcgtccacaaacaccgcacgagccctcggcgtgatcgcgagcgtctcggttctcggctcgtacctcaatgcccagctcaccagtggccttggtaccaagctcgcccgactcggggtcccaccggtcttccgccacgtggtgatcagcgcggtcgagacgggcggcgtccccggtggctcgagcattgcggccgacaccaaaacgttcgggcctctcgtcgccaaggtcgtcacagctgcctacggagcatttcatcgaggtctcaccatctcattgatcatcgctggcgcgctcatcatcgtctcgggcgtcttgagcgccgtcgcggtgcgaggtgcgcggacgcgccccgacggcgagacgtcccaggcgtagtcgaggcccaaccaccgggcgaccccgagctgtgctcgaggccgcccgaagtgcgagctcaggccgtggtcgccgacgacgtcgtcgccgacgttccggtatgagccgggcacgggttggtggtcgtggatggcgtggtcgtggtggtcgtcggcgtcgtcgacgaactcagctggacgactgttccggtcgtcggtgcggccatcgactgcgcgatggcgaaaccgacaccgccaccagcgatcgccgctcccgcgacgccgagacggatcaggactctccgagacagggtcacgctccctctacctccttcattgtgtctgttgctggtgcccgcaggcacgccgatgggtcatcggcacccccatcctcgcgtatgggcctgggagcgagtccagctcgaccatggaagcaggcaagaggccacgcgcgactcgcgctgccttcgatcactctccgaccgctcgacgatgaagctcagccatggccgcggtagctcgctgcgcctgtgcataccatccgccccgtcgaagcagttcgtcgtgggtgccgtcctccaggatgcttccggcacccacgacgacgatccgatccatgcgctcggcactgtggaggcgatgcgcgatcatgaccgtcgtgcggccggcgccggcacgctcgatgccagcgtgcacgcgagcgtcgagctcgggatcgaggttcgacgtcgcttcatcgaggagcaagatcgcgggatcgatgaggacggctctcgcaagacacacgagttggcgctcccccgccgccagcgcgcgaccacgctcgcccacgacctggtcgtagccgtccggcagtgcagcgatgacgtcatgggcaccgacggctcgcgctgcggcctcgacgtcgtcgtcgctggcccagggtgcaccgaacgtgatgttgtcccgaatcgtgcctgagaagaggaacggctcctgggggacgtagccgacccggctgcggaaccacgcaaggtccaaggctcgcagatccgtgccgtcgaggcgcaccgcgccttgcgagggatcgacgaagcgaaccagcagcttcatgagggtcgacttaccggcgcctgtctcacccaccaccgcgacgtgctggcccgctgggatcgcgagcgagcagtcacgaagcgcggggcgctgaacccccgggtaggcgaaccacacccgatcgagttcgatgctccctcggatccgggtgggtcgactcgcgttcgggctggagcggatgctcggttgctcgtcgaggagcgagttgatcttgcgcagtccggccctcgctcgctggtacgcgtcgaaggtttgtgcgagctgttggacgggcgcgaacagctgcgtgatgtagagcaagaacgcgaccagcacgccgacttcgatcacatggccacgcaccagcccactccccacccagaggacaccggcggtcaccaccacactggtaaggtccgcgagggccacgtagatcgcctggacaccaagagcggtcaagctggcgttgcgataggcaatccccagccgtcgaaacgtcgcgagaccagcctcctcctgaccgagggcctggacgacttgcacgccagcgatgctctcttggaaatgcgcgttcaccgcggccacgtgttcgcgctgccggtcgtaggcgcgctgagcgatggctcgatacaccacggtcgcgaccacgagcaccggcacggcgaccagtgcgaccaacgcgagacgcggctcgagtgcgacgagcacgaccgcaatcaccacgaccgtcgcgatccccacgatggcactgaccaagccgttctggagcagctgcgacatggtctcgacgtcgctggtcagccgggtgacgagccgaccgctcggctcccgttcgaagacgtcgataccgagccgctgtaggtgcgagaacagtcggagccgcagctcgaagagcatcgactcccccacacggcccgtctggacagtctcggcccactgatcgatccaaccgatcaacgcgaccgcgaggagtccgagcgcggcgagcacaaccgtgatgccactgtgggcgagcatgcctccgtcgataccacttcgcacgatgagggggccgatgacccccgaagcggtgtcgatggcgacgagtgccaacgcgagcacgaggccgaagcgccagccggagagaaacgtgccgagtcggatgcgaccctcgccaggtggctgtgtccaccggggccgctgcggctcatcacgagtcggggggaggtgcgcgatgagctcgccgacccaaggcggcacgtcacccaggctccgagcagctgcgaggcgacgccgaccagaaccactcgcctcgacgatctgtcgcttgggggacaccgcctcgatctcgacatcagagccatccccaccatcgagaaatcggcgcacccacgacgacatcgcggcgacacgggcaaccgaaccgtcagcgacgacacagccctgctccaacaccaccacacgatcgaccaaggagacgacagaggcacggtgcgacacgacgatcaccgtcgggcgctctggcagcgcccggatcgacgcgatgatgcgctcctcggtcgtcggatcgatggccgaggtcgcgtcgtcgagcacgagcacgtgcgggcgcatgacgagtgcacgcgcaagcgcgaggcgttggcgctgacctcctgagagtgtcactccgccttcgccgatctgggtgtcgaacccgtcaggcaaggcctcgatgaactccagggcgcccgcccgtccacaggcctcacgaacctcggcctccgacgcatccgggcaaccgaaacgaacgttgtcgaccaccgtgccggccagcaggacgctctcctcgaagaccatgctcacgcggcgccgtagctcggcgagcgacaccgagcggacgtcgacgccgccaacgagcaccgcgccccccgagacctcggccaaccgcggcaacaacgtgcagagcgtggtcttcccggatcccgacgggccgaggatcgcgaccatctcaccagccgcgatctcgagatcgacccctgcgagcacttcgtgcgtccccccacgtagcgccgtgacgccccgtacgctgacacggcgagcgtcgcgtggaagtggcagtgggtgcggcacctcggtgatgccaggttcgatcgagaggagttggtcaatccgttcgaagcctgctcgcgcctgctggccgacgacgaggatgccggccaccatgcgcgcgggcgccgcgagctgcgtcaggtagctcgcgaaggcgacgaacgtcccgatcgtgacgtcgccgttcaacgcaagcagaccgccgagggcgagaatgcctgcctgcacgagctgcggtatcgcctggagctcagcggtgacccaggcgcgcagcctgatgttgcgaagcctcgacgcgtagagcgcacgcgcgccatcgacgaaccggcgtatctgcgacgcttcctgcccgaaggcgcgcaccacacgagctccgatgatcgactcggtcaccacggtcgtgagttcgccctcccgctgctgtgcgtcccagctcgacgggaagaccgtggagcgcagggttcgcgacgctaggaaggtggcaaccgggacgatcagtgcgagcagcatgagccagacgttcagcacgctcatgatgacgatcgacacgatcgcttggagaaccgcgccaagaaccatcggagcccacgccaggacttgttgaacgagaccgagatccgtcgtcacacgtgagagcagctggccgatctcgagaccttcgtgggtggcgagatcgagcgagacgaggtgcgcgtacacctcgttccggatgtcgagttgcacgtcgtaggccactcggccaccgatgaaccgtcgcaccagggtcgtgccaaaacgcacgataccgatccccactaagccgagcaccagcgcctcgatggcggcccgtcggcctccaagcccgtcgatcacggctcgttgcaccacgggaaccaacgccagcgaccccatcgacacggccgatgcaagcagggtcacggcaagcttgccacggtgccggcgaagccatggcgcaaccgctgcccacgagccttcggtcaccgacgtcgcgatcggacgggaccgctccccgcccttggtcatcctcaccgctctcgtgctccccgccgctgcgccccacgtgctggctcacatacttgtattctcccaccaccctagagcgatagcagcgcgatcacacctctccagggacctcatccgctaccacgagtccacccacgtggcctccgttgtgcgccgcgaccctcctctgtctcgggcgcggaccgcacggcccaaccaccgaactgccccaacgatacgagcaacgcccttggcggctgacgcgaccggtctccttggctcacaatccacagggttgtgcacacctgtgcacaaccctcttgttcaccttccgataaccctacgcctcgacttgagggtgggggtcgacgatgcccgacgcgatgcgatggagatcggcaagatcgacgaaccgaactcggatgtaccctgcgccactcttgctcacgtcgatctgcacatccgactccatgacgtccgcgagcaaccgctcgagctcgacgacgatggccggacgcagccgtgcctcgggcaccgcctccttggggccctgcgcatgctccgattcgccagcctcgaccctcgtcgcctcggccgcggggttcgagatcgcccgcaccgcctcctcgacgtctcggacggacaggccttcctcgaccgttctcctggccaactcctcctgcagacgacgatccgggcaaccgagcaaggccctcgcatgccccgccgacaacaccccatcgagcagcatccgctgcagcgcagcggggagctgcaggagtcgcagcgtattcgagacagccgcccgactcttgccgacaccacgagcaacctcgtcgtgcgtcagctggaaatcgtcgatcaactgccggtacgcagctgcctcttccagcgggttcaagtcacgacggtgcaggttctcgatgacggccacctggagcgacccgcggtcgtctcgatcttgcacgatggcggggatgcgatccaggccagctcgctgcgccgcgcgccaccgccgttcgccagcgatcagctcgtagccgtccgcgacccgccgcacgaggatcggttggagaacgccgacctcggcgatcgatgcggcaaggccactcagcgcctcctcgtcgaagatcgtccgcggctgcagaggattcggacgaatcgcccctactggaatctcgacgaggccatgctgctcctgctgaacgcctgttggaatcagcgcaccaagtccgcgccccaaaccggtctgcctagccatccttgcgcagctccgtcgccaggtcgcgataggcaatggcgcctcgcgagctcggatcgaacgtcgtaattggctgcccaaacgagggggcctcggagagtcgtatgttgcgagggatcactgtctcacacaccaagtcaccgcagaactccttcacgttggctaccacctgctcggagaggttcgtccgggcatcgaacatcgtcatgaccacgtgcgaaacacggagcgtcgggttcaggctctgctgcaccaatgtcacgttccgaaacagctgcgacaatccctcgagggcgtagtactcgcactggatcggcacgagcacctcatctgcggcagccaacgcattgaccgtcagcagtccgagcgacggcggacaatcaatgaagatgtagtcgtagtcgcctcggaccggctccaacgccctgcgcaaccgagtctcacgcgacagcaccgacaccagctcgatctccgcaccagcgaggtcgatggttgcacccgcgacgaacacattgcggaccccagtcgcctcgatgacgtcttccaacggcgtctcgtgcacgaccgcgtcatagatcgaccccgcaagatcccgagggttcaccccgaggcccgtcgtcgcgttgccttgcggatcgaagtcgaccagcaagaccctcgccccctgctcagccaacgctgcagcgaggttcacggctgtcgtggtcttaccgaccccacccttctgattggcgaccgcaatgaccctacccatggctactcccgcggacgtgttcgcctgcagttccacgtggaacttgacgcttcacggcaggctactcgatcacggctccaccccgcgccacagaccctccctccaccgtcacgttccacgtgaaactggagctgcagaccaaccacccacgccacgtcttccgtccgcaccatcagaccaaccctcccgggtctccaagcgcgcaacacgcataccaccccgccgccgctcgataccacatgaccgacggatcgaccatcgagcaccttcgaactccatgagcctgcctccgcctcacccgcgcccacccaaacccctcaacctggagcccccgtcgcagccggaaccacccgtaccatcgactccccgtgcgaccacagcttccacctggcggaccaacgccaacggccatcgacgacccccaccaaccagtacgtgcgactaccccaaacgcatgcacgtccggagcccagcgatcgatcacgcgagaacggtcaccccacagaagggcgagaggggagtgacaagggaacgagaggggagcgagtcctaggagccttctgaacaagcccctccctggtagcgactgatgccagccacccagcccgggaacgagctcagctgacccgtgctcgcccagctcctcaccctctcctcttcgtcccctcctcgtgggtgcggaggagagggcccgagcgtctctcaggtggcaagcacccagccaccacccactcgggtgagccccaggcgtagcagcaccttcaggttccaggtcgcacagagcagctcgaagtgcaggcggttgcgcacgagtccccggtagcgcagcctcgccccggagagcttgcgcttgagctgtgcgtggatccgctcgacgttcggtcgggtgcgctggtagtcgagacggacagccgggtccccaaagtgcgcccgctggctgatgccgtgccaggtggcaggggtgaaggtgaggacccgtccgcgcttcgatcgtgtgcagcgctcccggagcggacagccatcgcagtgcttggcgaaggaggcacggcccttcgcggaaatggggactcggtgccccgcaggacagctaacccatccctcctcgacgacgaagtcgtcgatcgtgaagccaccagggaccgccatagaaaggggccgaggcttgatcacctcgtcgtggccatgagcggcaagctcgttgaagacctcgctcgtggcgtaggcgctgtcgccatagaccgtgcgtgggccgtcctcgtcaccaaggagctcgggcacgacctgtgcatcaggcacgctacccgtcgtgatggtcgaggcggtgacgatgccgctgtctggctcgacggccacgtggcccttgtagccatcgatggcacgggcacgggacttgtgcacatggcgagcgtcggggtccacggtggagatgaccctgtcgcgggccactcgcctcgcgatgcgccagcggcctgcggtggcatctgtgcactcgacgtcctggcccgccacgagcccaaggaggcccagggcctcgcgctggggctcggtgagagacgcgagcttctcggcctcggcgaggtgggcggtggcatcggcgacgagggcgctcaccgtgcgcaccactgcttcttcgtctcggtagtcgatggcaggctttggacgggtgtagtcgatcgctggtgacagaggaacttcgcggagctcggggatcagcctgcgtacccggttgatctgagcgacgagttgggtcatggtgtcttgggtcgcgaccgcatcggcgagcacggtggagtcgacgacgcgcttcgtcgtgcccttgagcacccccgtggcaccgatcacctcggccacgagctcggtgatgagtcttggggtctcggaggtggcgatgcgcctgcgccagtaggtgagcaccgtggggtgaaaacctgggtcctcgaggtcgagaccgagggcgtacttccagcgcaggttgtagcggacctgctctgtcgcctcggtgtccgagagcccctcgagcacctggagcaccatgaccgcgagcaccctcgaggcggggatggagggtctgccggtcgtggagggatagaggtggcggaagcgctcgtcggggaagagctccctgcggtgctcggcgaggaaggcgtagatggaccctggctcgatgagcgaggagcagaaggcctccgtcgcggtgaggtgtgcctggtctgattcggtgcccaacatgcaaaaagtctagctgagctgggcaaatggcgctgggcaggaggggaggagcgccgtgcgtcgccgcgctacgtggaggagttgttcaggaggctcctagaggcctacggccacctcgcacaccgatcacgggtggaccacagccgcgacgctcccagacgcctctcgatccatgcacggctgctcgtcggtgcccatcgccacaggacgggcggaccgccgccatcacgtcacacggaatcgcgccgaaccacgcgcagctcgtcccggaatgccgtcgtccgacatcggccgcacacgccgctcgcgatgaccctcacgatccgactccctgcgcagagctgccaacgccgagcccaggcatcactgacctggcggaccaccccaacggccacggtcgagaacgccagccacgacactacggacaccaccagcgccaactccagcgaccaagcacgcgcctacgccacgacgccgatgcgaccacgtgcgatcggtgcgtgccgacctcgagttcacccacctcaccgaatgcccacagcagctgatcgcccgcaggagctggccacaccaccacgtgctgccggagccagtgtgacttgccgacgagaccaacccaccgttcctcaccgaccgtcgccccgcgctccagcaagcaggcacgccacagctcgcgaggccgctctctcggcacgcaccacccgcacgtcagcgcacgacccccgaggcaatcccgtgggcggctctcgtcgacgatcgagtgccagcatcgaggcacaccgaggcaatccacacaggtccccaaccagccgcccactcatacgtcgtcgcgcccgacccgcagtgtcgtcgaggaacgctcctcgctccacaacggtcgacgctccggtatcccggagcgtcgaggatactgtcccgcgagcggtgctaccttgcgcagcacagtgaagtgtggggggcccaccaccacttcagccacgacgagaccgagcctcgcgagctgctcgctggccgaccaacgccgtccagccccctcaggtggatcggagaccacgatgacgcctccaacgcgaacgaatccgctaccgatctcggcggtgaccggcggagctccgaatccacgagcgaccacggcgtcagcccgttcacgaatctccttcgaccttgcgagcacctcgccccgctcagcggcgattcgcacccgagccgaccagttcaaggctcgaaccgcctcggtgaggaacgccgcacgccgctggcgagcatcgaccagcagtccttccgatgcgggtagctcgagcgcgacgatcaggcccggtatgcctccgcccgatccaagatcgacccatcgctcggcaccgtagcgacgcacgagcgcagagaaggccctcgaatgttcgagggccttctctgtgggctcgcctacgagaccgagctcgtgggcccgatcaatccactgctcgaccggcagcatcgacggactcggcggccgatggtgctaccccgacacggaagatcacaacgtagcgatccggttcctcaccctctgaacgcgtcccgacaccgtcgatctcggccaccacgtcatggatcaccttccgatctgcggcgctcatcggctcgagcacgcgctcttcgccagtcgtcagtgcgacctctgcctgctctcgcgcgaagcgctcgagcgcgacccgccgtcgctcgcgatagccggcgacgtcgaccgccacccgtcccacaccctcgccggcgatggcctgcaacacactgcgcgtcagctcttgaatcgcgttcaggacactcgcccgtggccccacgaggaccccgagcccatcgccctcgatgtcgagactcatctcttcgtcatcgaggttgctgacgcgaacctcgcccgtcagcccgaactcctgcatgagcccggccaagaaggcctgtgctcgcgcggcaagctccacacgcgagaggggaggagttccctctgccgccggggcttcggccgtctgttgttcgtcgttcatcggagcatcctctgtttcgtctcgcctggtaccagccccgggccgcgcgtcaacggcccgatttcgtcgtccacgacgccgatcacgctttggcatcggaagcttcggccgaagacgagctcgaacccgtgcctctctccgtccgaacccgagaaaacttgctcgcccttcgtcgaggacctcgaactcgacctcggcgtcttccacgccgagcacatccagtgcttgctcacgtgcctcttcgacagttcgtcctgtcgtctcgatccaatccatgctctgactcctagcgattcgccggtcgccgttagcgacgacgccgaccacggcgacggcgatagctgttcttcgaaccctgctgcttgttcttcgctggccccggtggggtcgctggaccgtcggacccgccctcgaccgccgacggcaaccccttcttgccgccaaggaagccaaagataccgccacctgcgggagctgtcggactcgccgcaccgttaccgcgctgctctgcgacccgacgtctcgcctcgaccgagtgcgcacgaaggaccggatcacggcgccacatcacctcctgctgggcgacgcggaacaacccggaaaccaggaagtacacggcaacaccggcagggacatcgaggtagatgacaccgaagacgaccgttgtgagctgttgggtcagcagcgccgatcggttcgccgcggccgccgtgggattcttcgacgcaatctgctgaatctgcaggtactggataccgaccgcgatcagcaccagcacgtagtaggggagtgcgtgcacgaaaccgacgtgcagatgcaagggggtcagggccaggttgatccccacaaagtccatgtgcccgcggtcggccaccagattcttgtagagcttgctggcgtgtgagatgtacaacggcgctgcgacgatggcatgatgactcgtcaccgtgtgtgtcaggccacggatgacgtcgtacatcacgaacagcagcgggaactgcaacagcatcggcaagcaaccgccgagcggcgaaacgccctcctccttgaagagtcgctgctgcgcttcggcgagccccgcacggtccttgccgtactggcgctgcaactccttgagcttcggctgaatcgcttgcatctgcagcatcgaccgcgtggagcggatggtcagcggcgacagcgcgaccatcacggtcaccgtcagcagcgcgatcgcgatgccgtagctcgggatgatggcgtaccagaaggtcacgatccccgcgaggagctcgaacaacgggcggaagatctcgcccagaacacttgcgacgatcatgcgtgcgttacctttccggaccgtcgaggtggaacgggatcgtaccctgagcccccgaacgggttacagcgacccactcgtttagccgccaaccagcttcccctcgccaagccgtgcaactcgactgcctcgtacgcgtactgagagcagctcggcacgtagcgacacggcgatggacgaccacgccgtgcgacctggtaggcgcgaatgaggcccatgccggcccgacggggaagcgcacgtacgcgcgccacaaggctcacgggtcctcccgggggaactcgcctaggtgctccagcctagtgacatccgcacgaatggcggcaaaggaggcgtcgagcttcccttctctcggcccgatcaggtagctgccgggtgcgacagcgctgacgcgcaaggcctcgcgaacccggcgccgaaatcgattgcgctcgaccgccgtacctgctcggcgcggtatggcaaacgcgacacgaactgcggcgctctgctcgtcgcctgacacggtctccgtcggcgcgaccacgacccacatggtgccgagctgatagcgccgacccacgcgccggagacgatggaagtcctgccggcgggcaagccttccgagccgcacctacgccgacagccggtgacgccccttgaggcgccgagccttgagcaccgcacgaccggctctcgtcgacatccgcgcgcgaaaaccatgggtgcgcgcacgacgccgattgttgggctggaacgtccgcttcatcgcctgatcaccttccttgtcgagccccgcagtctaggagttcgaggagtcgaggccaacaccctgcgaggcgagcgaacgtgccctatgat

SEQ ID NO: 2 - DNA, 17 bp, Artificial Sequence
  Synthetic construct, Bact-338F1 primer
cctacgggrggcagcag

SEQ ID NO: 3 - DNA, 18 bp, Artificial Sequence
  Synthetic construct, 909R primer
ccgtcaattyhtttragt

SEQ ID NO: 4 - DNA, 20 bp, Artificial Sequence
  Synthetic  construct, acd320f primer
cggtccagactcctacggga

SEQ ID NO: 5 - DNA, 23 bp, Artificial Sequence
  Synthetic construct, 423r primer
gacagggttttacagtccgaaga

SEQ ID NO: 6 - DNA, 20 bp, Artificial Sequence
  Synthetic construct, acm342f primer
gcaatgggggaaaccctgac

SEQ ID NO: 7 - DNA, 20 bp, Artificial Sequence
  Synthetic construct, 439r primer
accgtcaatttcgtccctgc

SEQ ID NO: 8 - DNA, 507 bp, Acidimicrobiaceae bacterium A6
  misc_feature (1)..(507): FMO gene, ERCFMO_0001
ggtgactgggacttctggcttgactggaaagaccggcaatggtggccggtggtcacaccgattgtagggattacctactgcgcggccatcatgtattacctgtgggtgaactaccgcctgccctatggcgcaacgctttgcattgtctgccttttggtaggcgaatggctgacgcgtttctggggcttttactggtggtcgcactaccccatcaacttcgtatttccctccacgatgatacctggggcgctggtgatggacaccgtcatgctgctcacgcgcaactggatgatcaccgcgctgtttggcggcggagcatttgggttattgttctacccgggcaactggccgatttttggccccacccacctgccgctggttgctgaaggcgtgctgctgtcgttggccgactacaccggctttctgtatgtacgcacgggcacccctgagtacgtacggctgatcgaacaaggctcgcttagaacctttggcggtcacaccaccgtg

SEQ ID NO: 9 - DNA, 507 bp, Acidimicrobiaceae bacterium A6
  misc_feature (1)..(507): FMO gene, ERCFMO_0002
ggtgactgggacttctggactgactggaaagaccgtcgtctgtgggtgactgttgcaccaatcgttgctgtaactttcccggcggcagtgcaagcttgcttgtggggccgttatcgtatgccttggggcgctactatgtgcgttctgggcttgttgttaggtgaatggatcaacagatatttcaacttctggggctggacatatttcccagttaacttctgcttcccttcacaattgattcctagcgctatcattttggacgttgtgttgttgctgtctaacagcttcaccttcaccgctatcgccggcgcgatgggctggggtctgattttctacccaagcaactggccagtaattggaccattgcacgtgccggtagaatataacggtatgatgatgactttggctgacttacaaggttaccactatgtaagaaccggtactcctgagtacatccgtatggttgaaaaaggtactttgagaacgttcggtaaagacgttgctccg

SEQ ID NO: 10 - DNA, 507 bp, Acidmicrobiaceae bacterium A6
  misc_feature (1)..(507): FMO gene, ERCFMO_0003
ggggactgggacttctggtccgactggaaagaccgtcgtctgtgggtcaccgtcaccccgatcgtgctggtcaccttcccggcggccgtccaatacttcctgtgggaacggttccgtctgccgtggggcgccaccgtgtgcgtgctggccctgctgttcggcgaatgggtcaaccgctacttcaacttctggggctggacctacttcccggtgaacttcgtgttcccggcgattctgactccgggcgccatcctgctcgacaccgtgctgatgctgtcgggcagctacctgttcaccgccatcatcggcagcatggcctggggtctgattttctatccgggcaactggccgatcatcgcgccgatccacgtgccggtggaatacaacggcatgctcatgtcggtggcggacatccagggctacaactatgtccgtaccggtacccccgagtacatccgcatggttgaaaaaggcaccctgcgtaccttcggtaaagacgttgctccg

SEQ ID NO: 11 - DNA, 501 bp, Acidimicrobiaceae bacterium A6
  misc_feature (1)..(501): FMO gene, ERCFMO_0004
tgggacttctggtccgactggaaagaccgccgtctgtgggtcaccgtgaccccgatcgtgttggtcaccttcccggcagccctccaggttctgctgtgggaacgcttccgtctgccgtggggcgcgaccctcgccatcctgtctctgctgtttcgcgaatgggtcaaccgatacttcaacttctggggctggacctacttcccggtgaacttcgtgttcccggctattctcattcccagtgcgatcctgctggacatcatgctgatgctgtccaacagcttcctggtcaccgctgtcgttggcggcctggcttggggtctgatgttctatcccggcaactggcccatcatcgctccactgcacgtgccggtcgaatacaacggcatgctgatgaccctcgccgaccttcaaggctaccactatgtacgaaccggtactcccgagtacatccgcatggttgaaaaaggcaccctgagaaccttcggtaaagacgttgctccg

SEQ ID NO: 12 - DNA, 510 bp, Acidimicrobiaceae bacterium A6
  misc_feature (1)..(510): FMO gene, ERCFMO_0005
gactggcatgttcgaccaatcgttgctggcatcgaaccctgtacgctcgataccgactggaaagaccgtcgtctgtgggcaactgttgggacatgcgagcctgcaccatcgtggctgtactttccctgcagctgtgcaagcttgcttgtggggtcgttcaacttctggggctggacatatttcccagcttacttctgcttcccttcacaattgattccttgcgctatcgttcctcaccgtactggatgttgtgttgttgctgtcatgcagcttcaccttcagccagacgctcctacccgctatcgctggcgcaatgggctggggttcttgttttctacccaagcaactggccggttatcgcgccattgcacgtgccggttgaatataacggtactgatgatgactttggctgacttacaaggttaccactatgtaagaaccggtactcctgagtacatccgtatcgtcaagcgaagctccctacgatttagtgggaaagacgttgctccg

SEQ ID NO: 13 - DNA, 507 bp, Acidimicrobiaceae bacterium A6
  misc_feature (1)..(507): FMO gene, ERCFMO_0006
ggggactgggacttctggtccgactggaaagaccgtcgtctgtgggtcaccgtcaccccgatcgtgctggtcaccctgcaggcggccgtccaatacttcctgtgggaacggttccgtctgccgtggggcgccaccgtgtgcgtgctggccctgctgttcggcgaatgggtccaccgctacttcaacttctggggctggacctacttcccggtgaacttcgtgttcgcggcgattctgactccgggcgccatcctgctcgacaccgtgctgatgctgtcgggcagctacctgttcaccgccatcatcggcagcatggcctggggtctgattttctatccgggcaactggccgatcatcgcgccgatccacgtgccggtggaatacaacggcatgctcatgtcggtggcggacatccagggctacaactatgtccgtaccggtacccccgagtacatccgcatggttgaaaaaggcaccctgcgtaccttcggtaaagacgttgctccg

SEQ ID NO: 14 - DNA, 506 bp, Acidimicrobiaceae bacterium A6
  misc_feature (1)..(506): FMO gene, ERCFMO_0007
ggagactgggacttctgggttgactggaaggatcgtcgtatgtggccgacggtcgtgccgattctcggcgtgaccttctgcgccgcggcgcaggcgttctggtgggtgaacttccgtctgccgttcggcgcggtgttcgcggctcttggcctgctgattggcgagtggatcaaccgctacgtctacttctggggctggacctacttcccgatcaaccttgtgttcccgtctgcgttgatcgttccggcgatctggattgacgtgatcctgcttctgtcgggctcctatgtgatcacggcgattgttggttcgctcggctggggtctgttgttctaccccaaccactggccggcgattgccaagttccatcaggcgacggaacagcatggtcagcttatgacgcttgaggatctgatcggcttccacttcgtccgcacctcgatgccggaatatatccgcatggtccagcgcaccttccagccaccttcggtaaagacgttgctccg

SEQ ID NO: 15 - DNA, 506 bp, Acidimicrobiaceae bacterium A6
  misc_feature (1)..(506): FMO gene, ERCFMO_0008
gactgggacttctggaccgactggaaagatagacgtctatgggttactgttgtgcctatagttggtattacttttcctgctgctgttcaagcttgcttgtggcggcgttaccgtttgccttacggcgcggtagtttgtgttttgggtctgcttttaggtgagtggatcaacagatacattaacttctggggttggacttatttcccagtaagtttctgcttcccttcacaactagtaccaggtgctatcgttcttgatgttgtgttaatgctgtcaaacagtatgacaattacagcagtaatcggcggtatggcatggggtctgttgttctatccaggcaactggccagttatagctccattacatgttcctgttgaatacaatggcatgatgatcgcactggctgatttacaaggttaccactacgtaagaactggtacacctgagtacatcagaatggttgaaaaaggtacattaagaacatttggtaaagacgttgctccgga

SEQ ID NO: 16 - DNA, 509 bp, Acidimicrobiaceae bacterium A6
  misc_feature (1)..(509): FMO gene, ERCFMO_0009
ggtgactgggacttctggactgactggaaagatggacgtctatgggtaactgtagctccaatcgtttcaatcactttcccagcagctgttcaagctgttctgcggtggcgttaccgtttgcctttcggtgcggtagtttgtatcttaagtcttctgttaggtgagtggatcaacagatatatgaacttctggggttggacttatttcccagtgaatttctgtttcccttcaaacctgatgccaggtgctatcgttcttgacgttgtgttaatgctgacaaacagcatgacaattacagcggtaattggtggtatggcttatggtttgttgttctatccaggcaactggccaatcatggctccattacatgttcctgttgaatacaatggcatgatgatgactcttgctgatttacaaggttaccactacacaagaactggtacacctgagtacatcataatggttgaaaaaggtacattaagaacttttggtaaagacgttgctccgga

SEQ ID NO: 17 - DNA, 467 bp, Acidimicrobiaceae bacterium A6
  misc_feature (1)..(467): FMO gene, ERCFMO_0010
ggtgactgggatttttggaccgactggaaagatagacgtctatgggtaaccgtagctcctatcgtttctattacattccctgcggctgttcaagcttgcttgtggtggagataccgtttgccagttggcgcaactttgtctgttgttgctctgatgattggtgagtggatcaaccgttatatgaacttctggggctggacatacttcccagttaacatttgcttcccatctaacctgttgccaggtgccattgttcttgacgttatcctgatgttgggtaacagcatgactctgacagctgttgttggtggtttggcttatggcctgttgttctacccaggtaactggcctgttatcgctccattgcacgtgcctgtagaatacaacggcatgatgatgactttggctgacttacaaggttaccactatgttcgtacaggtacacctgagtacatccgtatggtaga

SEQ ID NO: 18 - DNA, 506 bp, Acidimicrobiaceae bacterium A6
  misc_feature (1)..(506): FMO gene, ERCFMO_0011
gactggcatgttcgaccaatcgttgctggcatcgaaccctgtacgctcgataccgactggaaagaccgtcgtctgtgggcaactgttgggacatgcgagcctgcaccaccgtcgctgtactttccctgcagctgtgcaagcttgcttgtggggtcgttcaacttctggggctggacatatttcccagcttacttctgcttcccttcacaattgattccttgcgctatcgttcctcaccgtactggatgttgtgttgttgctgtcttacagcttcaccttcagccagacgctcctacccgctatcgctggcgcaatgggctggggttcttgttttctacccaagcaactggccggttatcgcgccattgcacgtgccggttgaatataacggtatcactgtcgctttggctgacttacaaggttaccactatgtatgaaccggtactcctgagtacatccgtatcgtcaagcgaacctcccgaagaagtgggaaagacgttgctccg

SEQ ID NO: 19 - DNA, 508 bp, Acidimicrobiaceae bacterium A6
  misc_feature (1)..(508): FMO gene, ERCFMO_0012
cgagactgggactcctggaccgactggaaagatagacgtctatgggtaaccgtagcacctatcgtttctattacattccctgcggctgttcaagcttgcttgtggtggagataccgtttaccagttggtgcaacactttcagttgttgctctgatgattggtgagtggatcaacagatatatgaacttctggggctggacatacttcccagttaatatctgcttcccatcaaacttactgccaggtgctatcgtactggacgttatcctgatgttgggtaacagcatgactctgaccgctgttgttggtggtttggcttatggcttgttgttctacccaggtaactggcctgtaatcgcgccattgcacgtgcctgtagaatataacggcatgatgatgactttggctgacttacaaggttaccactatgttcgtaccggtacacctcggtacattcgtatggtagagaaaggtacattaagaactttcggtaaagacgttgcgccgg

SEQ ID NO: 20 - DNA, 468 bp, Acidimicrobiaceae bacterium A6
  misc_feature (1)..(468): FMO gene, ERCFMO_0013
gactggaaagatagacgtctatgggtaactgtagctccaatcgtttcaattactttccctgcagctgttcaagctgtgttgtggtggcgttaccgtttgccttttggcgcggtagtttgtatcttaggtctgctcttaggtgagtgggtcaacagatatttgaatttctggggttggacttatttcccagtaaatttctgcttcccttcaaacttgatgccaggtgctattgttcttgacgttgtgttaatgctgtcaggaagtatgacagttacagcggtaatcggtggtatggcatggggtctgttgttctatccaggcaactggcctgttatggcaccattacatgttcctgttgaatacaatggcatgatgatgacacttgctgatttacaaggttaccactatgttagaactggtacacctgaatacatcagaatggttgaaaaaggtacactgagaactttc

SEQ ID NO: 21 - DNA, 387 bp, Acidimicrobiaceae bacterium A6
  misc_feature (1)..(387): FMO gene, ERCFMO_0014
acgttgacgccgatcctgatgatcaccttccctgcggcgacgcaatatttcatgtgggagaagatgcggcttccgatcggcgccaccttttgcgtgatgacggttcacttcggccaatggatgaatcgggtctttaacttctacatgtgggcctggttcccggtcaactttaccacccctggtttgctgatacccagcgcaatcttcctggacgtggtgttgatgatgacaggaagctacatgtttacggcgctgttcggcggcatggggtggtccctgttgttctatccgtccaactggacctggcttgccccgtttcacttggctgtgaagcatccaagcggaccgctcatgtcgatcgctgatttgatggggatgggtatgtgc

SEQ ID NO: 22 - DNA, 508 bp, Acidimicrobiaceae bacterium A6
  misc_feature (1)..(508): FMO gene, ERCFMO_0015
actggcatgttcgaccaatcgttgctggcatcgaaccctgtacgctcgataccgactggaaagaccgtcgtctgtgggcaactgttgggacatgcgagcctgcaccaccgtcgctgtactttccctgcagctgtgcaagcttgcttgtggggtcgttcaacttctggggctggacatatttcccagcttacttctgcttcccttcacaatcaattccttgcgctatcgttcctcaccgtactggatgttgtgttgttgctgtctaacagcttcaccttcagccagacgctcctacccgctatcgctggcgcaatgggctggggttctgattttctacccaagcaactggccggttatcgcgccattgcacgtgccggtagaataatgcggtatgatgatgactttggctaccttacaaggttaccactatgtaagaaccggtactccatggtacatccgtatcgtcaagcgaacctccctgagaagaagtgggaaagacgttgctccg

SEQ ID NO: 23 - DNA, 508 bp, Acidimicrobiaceae bacterium A6
  misc_feature (1)..(508): FMO gene, ERCFMO_0016
tgggacttctggcttgactggaaggacagggaattttggccaacctttaccccggtgctgttgatcacctttccggcggccgttcaatacgtgctctggacctacttccgtctgcctatcggcgccaccctttgctgtcttggactgctcatcggcgaatggatcgtcaggatccacggctttcacatctgggcgtggttcccgtttacgctgatttggccggcgaccatgttgccgggcgccatcgcactcgatctggtcctaatgctcagcggcaatttcattatgaccggcatattcggcggtatgcttttcgcactgctgttctatcccggaaactggccgatgttggctgcgtaccgtttaccgcttgagcacattggatcgcttctcacggtcggagatctgatcggctacgtctatccgcgcagcagcatgccggaatatctgcgcatcattgagcggggtaccctgcgcacctttggtggtcattccgcggtggttgctg

SEQ ID NO: 24 - DNA, 509 bp, Acidimicrobiaceae bacterium A6
  misc_feature (1)..(509): FMO gene, ERCFMO_0017
gactggcatgttcgaccaatcgttgctggcatcgaaccctgtacgctcgataccgactggaaagaccgtcgtctgtgggcaactgttgggacatgcgagcctgcaccatcgtggctgtactttccctgcagctgtgcgaatggcatgcgcggtcgttcaacttctgcggctggacatatttcccagcttacttctgcttcccttcacaattcattccttgcgctatcgttcctcaccgtactggatgttgtgttgttgctgtctaacagcttcaccttcagccagacgctcctacccgctatcgctggcgcaatgggctggggttctcattttctacccaagcaactggccggttatcgcgccattgcacgtgccggtagaataatgcggtatgaatcgtccctttggctgacttacaaggttaccactatgccggaaccggtactcctcagtacatccgtatcgtcaagcgaagctccctacgatcaagtgggaaagacgttgctccg

SEQ ID NO: 25 - DNA, 507 bp, Acidimcrobiaceae bacterium A6
  misc_feature (1)..(597): FMO gene, ERCFMO_0018
gccgactgggacttctggaccgactggaaagatagacgtctgtgggtaaccgtagcacctatcgtttctattacattccctgcggctgttcaagcttgcttgtggtggagataccgtctgccaatcggcgcaaccgtttctgttgttgctctgatgctgggcgagtggatcaaccgttacatgaacttctggggttggacatacttcccagtaaacatttgcttcccatctaacttgctgccaggcgctatcgttctggacgtggttctgatgctgggcaatagcatgactctgaccgctgttgttggtggtttggcttatggtttgctgttctacccaggcaactggcctatcattgctcctctgcacgttcctgttgaatacaacggcatgatgatgactctggctgacttgcaaggttaccactatgttcgtaccggtacacctgagtacatccgtatggtagagaagggtactttgagaactttcggtaaagacgttgctccg

SEQ ID NO: 26 - DNA, 507 bp, Acidimicrobiaceae bacterium A6
  misc_feature (1)..(507): FMO gene, ERCFMO_0019
ggcgactgggacttctggtcggactggaaagaccgtcgactgtgggtcacggtgaccccgatggtactggtcaccttcccggcggccgtacaatcctacttgtggaaccggtatcgtctgccttggggagccaccgtgtgcgtcctgggtctgctgctgggcgagtggatcaaccgttatttcaacttctggggctggacctacttcccgatcaacttcgtgttccctgcctcgctggtgccgggcgccatcatcctggacaccgtgctgatgctgtcgggcagctacctgttcaccgcgatcgtcggtgcgatgggctggggtctgatcttctacccgggcaactggccgatcatcgcgccgctgcacgtgccggtggaatacaacggcatgctgatgtcgatcgccgacatccagggttacaactatgtgcgtacgggtacgcctgagtacatccgcatggtagagaagggcaccctgcgtaccttcggtaaggacgttgctccg

SEQ ID NO: 27 - DNA, 468 bp, Acidimicrobiaceae bacterium A6
  misc_feature (1)..(468): FMO gene, ERCFMO_0020
gactgggacttctgggcggaccggaaggaccggcgtttatgggtgacggtttatccgattgtgatgatcacgtttcctgcggcggtgcaggcggtgatttgggagcgtatgcggttgccctggggggcgacggtatgcattttaggcatcctgtttgaggagtgggttaaccgctacttcaacttctggatgtggacatatttccccattaactttgtatctccgacggcggcggttcacatggcgatctctttagacgttgtgttgatgcagtctgggagcttcttgtctacggcggtgattggtgggttaggctgggggctattgatgtatcctggcaactggtcgatcattgcgcccttgcccgtaccggtggaatacaatggcatgctgatgtcgattgccgacattcatgggtaccaatatgtgcgtacgggcgcgtctgggtacattcggatggtagatgac

SEQ ID NO: 28 - DNA, 514 bp, Acidimicrobiaceae bacterium A6
  misc_feature (1)..(514): FMO gene, ERCFMO_0021
ggggactgggacttctggctggactggaaagaccgtcaatggtggcctgtggtgacccccatcgtaggcatcgcctactgtgctgccatcatgtactacctatgggtgaactaccggctgccctatggcgccaccttatgtatcgtctgtctcttggtaggcgaatggctgacgcgtttctggggattttactggtggtcgcactaccccatcaacttcgtctttccctccaccatgataccgggcgcgctggtcatggacaccgtcctgctgctcacccgcaactggatgatcaccgcactgattggaggcggcgcatttggcctgctgttctacccgggcaactggcccatctttggcccgacccacctgccgctggtagccgaaggcgtattgctgtcggtcgccgactacaccggctttttgtatgtacgcaccggcacgcctgagtacgtgcgcctgatcgaacaaggctcgctacgaaccttcgggggccacaccaccgcgattggcg

SEQ ID NO: 29 - protein, 169 aa, Acimicrobiaceae bacterium A6
  MISC_FEATURE (1)..(169): FMO enzyme, ERCFMO_0001
GDWDFWLDWKDRQWWPVVTPIVGITYCAAIMYYLWVNYRLPYGATLCIVCLLVGEWLTRFWGFYWWSHYPINFVFPSTMIPGALVMDTVMLLTRNWMITALFGGGAFGLLFYPGNWPIFGPTHLPLVAEGVLLSLADYTGFLYVRTGTPEYVRLIEQGSLRTFGGHTTV

SEQ ID NO: 30 - protein, 169 aa, Acidimicrobiaceae bacterium A6
  MISC_FEATURE (1)..(169): FMO enzyme, ERCFMO_0002
GDWDFWTDWKDRRLWVTVAPIVAVTFPAAVQACLWGRYRMPWGATMCVLGLLLGEWINRYFNFWGWTYFPVNFCFPSQLIPSAIILDVVLLLSNSFTFTAIAGAMGWGLIFYPSNWPVIGPLHVPVEYNGMMMTLADLQGYHYVRTGTPEYIRMVEKGTLRTFGKDVAP

SEQ ID NO: 31 - protein, 169 aa, Acidimicrobiaceae bacterium A6
  MISC_FEATURE (1)..(169): FMO enzyme, ERCFMO_0003
GDWDFWSDWKDRRLWVTVTPIVLVTFPAAVQYFLWERFRLPWGATVCVLALLFGEWVNRYFNFWGWTYFPVNFVFPAILTPGAILLDTVLMLSGSYLFTAIIGSMAWGLIFYPGNWPIIAPIHVPVEYNGMLMSVADIQGYNYVRTGTPEYIRMVEKGTLRTFGKDVAP

SEQ ID NO: 32 - protein, 167 aa, Acimicrobiaceae bacterium A6
  MISC_FEATURE (1)..(167): FMO enzyme, ERCFMO_0004
WDFWSDWKDRRLWVTVTPIVLVTFPAALQVLLWERFRLPWGATLAILSLLFREWVNRYFNFWGWTYFPVNFVFPAILIPSAILLDIMLMLSNSFLVTAVVGGLAWGLMFYPGNWPIIAPLHVPVEYNGMLMTLADLQGYHYVRTGTPEYIRMVEKGTLRTFGKDVAP

SEQ ID NO: 33 - protein, 170 aa, Acidimicrobiaceae bacterium A6
  MISC_FEATURE (1)..(170): FMO enzyme, ERCFMO_0005
DWHVRPIVAGIEPCTLDTDWKDRRLWATVGTCEPAPSWLYFPCSCASLLVGSFNFWGWTYFPAYFCFPSQLIPCAIVPHRTGCCVVAVMQLHLQPDAPTRYRWRNGLGFLFSTQATGRLSRHCTCRLNITVLMMTLADLQGYHYVRTGTPEYIRIVKRSSLRFSGKDVAP

SEQ ID NO: 34 - protein, 169 aa, Acidimicrobiaceae bacterium A6
  MISC_FEATURE (1)..(169): FMO enzyme, ERCFMO_0006
GDWDFWSDWKDRRLWVTVTPIVLVTLQAAVQYFLWERFRLPWGATVCVLALLFGEWVHRYFNFWGWTYFPVNFVFAAILTPGAILLDTVLMLSGSYLFTAIIGSMAWGLIFYPGNWPIIAPIHVPVEYNGMLMSVADIQGYNYVRTGTPEYIRMVEKGTLRTFGKDVAP

SEQ ID NO: 35 - protein, 168 aa, Acidimicrobiaceae bacterium A6
  MISC_FEATURE (1)..(168): FMO enzyme, ERCFMO_0007
GDWDFWVDWKDRRMWPTVVPILGVTFCAAAQAFWWVNFRLPFGAVFAALGLLIGEWINRYVYFWGWTYFPINLVFPSALIVPAIWIDVILLLSGSYVITAIVGSLGWGLLFYPNHWPAIAKFHQATEQHGQLMTLEDLIGFHFVRTSMPEYIRMVQRTFQPPSVKTLL

SEQ ID NO: 36 - protein, 168 aa, Acidimicrobiaceae bacterium A6
  MISC_FEATURE (1)..(168): FMO enzyme, ERCFMO_0008
DWDFWTDWKDRRLWVTVVPIVGITFPAAVQACLWRRYRLPYGAVVCVLGLLLGEWINRYINFWGWTYFPVSFCFPSQLVPGAIVLDVVLMLSNSMTITAVIGGMAWGLLFYPGNWPVIAPLHVPVEYNGMMIALADLQGYHYVRTGTPEYIRMVEKGTLRTFGKDVAP

SEQ ID NO: 37 - protein, 169 aa, Acidimicrobiaceae bacterium A6
  MISC_FEATURE (1)..(169): FMO enzyme, ERCFMO_0009
GDWDFWTDWKDGRLWVTVAPIVSITFPAAVQAVLRWRYRLPFGAVVCILSLLLGEWINRYMNFWGWTYFPVNFCFPSNLMPGAIVLDVVLMLTNSMTITAVIGGMAYGLLFYPGNWPIMAPLHVPVEYNGMMMTLADLQGYHYTRTGTPEYIIMVEKGTLRTFGKDVAP

SEQ ID NO: 38 - protein, 155 aa, Acidimicrobiaceae bacterium A6
  MISC_FEATURE (1)..(155): FMO enzyme, ERCFMO_0010
GDWDFWTDWKDRRLWVTVAPIVSITFPAAVQACLWWRYRLPVGATLSVVALMIGEWINRYMNFWGWTYFPVNICFPSNLLPGAIVLDVILMLGNSMTLTAVVGGLAYGLLFYPGNWPVIAPLHVPVEYNGMMMTLADLQGYHYVRTGTPEYIRMV

SEQ ID NO: 39 - protein, 168 aa, Acidimicrobiacea bacterium A6
  MISC_FEATURE (1)..(168): FMO enzyme, ERCFMO_0011
DWHVRPIVAGIEPCTLDTDWKDRRLWATVGTCEPAPPSLYFPCSCASLLVGSFNFWGWTYFPAYFCFPSQLIPCAIVPHRTGCCVVAVLQLHLQPDAPTRYRWRNGLGFLFSTQATGRLSRHCTCRLNITVSLSLWLTYKVTTMYEPVLLSTSVSSSEPPEEVGKTLL

SEQ ID NO: 40 - protein, 169 aa, Acidimicrobiaceae bacterium A6
  MISC_FEATURE (1)..(169): FMO enzyme, ERCFMO_0012
RDWDSWTDWKDRRLWVTVAPIVSITFPAAVQACLWWRYRLPVGATLSVVALMIGEWINRYMNFWGWTYFPVNICFPSNLLPGAIVLDVILMLGNSMTLTAVVGGLAYGLLFYPGNWPVIAPLHVPVEYNGMMMTLADLQGYHYVRTGTPRYIRMVEKGTLRTFGKDVAP

SEQ ID NO: 41 - protein, 156 aa, Acidimicrobiaceae bacterium A6
  MISC_FEATURE (1)..(156): FMO enzyme,ERCFMO_0013
DWKDRRLWVTVAPIVSITFPAAVQAVLWWRYRLPFGAVVCILGLLLGEWVNRYLNFWGWTYFPVNFCFPSNLMPGAIVLDVVLMLSGSMTVTAVIGGMAWGLLFYPGNWPVMAPLHVPVEYNGMMMTLADLQGYHYVRTGTPEYIRMVEKGTLRTF

SEQ ID NO: 42 - protein, 129 aa, Acidimicrobiaceae bacterium A6
  MISC_FEATURE (1)..(129): FMO enzyme, ERCFMO_0014
TLTPILMITFPAATQYFMWEKMRLPIGATFCVMTVHFGQWMNRVFNFYMWAWFPVNFTTPGLLIPSAIFLDVVLMMTGSYMFTALFGGMGWSLLFYPSNWTWLAPFHLAVKHPSGPLMSIADLMGMGMC

SEQ ID NO: 43 - protein, 169 aa, Acimicrobiaceae bacterium A6
  MISC_FEATURE (1)..(169): FMO enzyme, ERCFMO_0015
TGMFDQSLLASNPVRSIPTGKTVVCGQLLGHASLHHRRCTFPAAVQACLWGRSTSGAGHISQLTSASLHNQFLALSFLTVLDVVLLLSNSFTFSQTLLPAIAGAMGWGSDFLPKQLAGYRAIARAGRIMRYDDDFGYLTRLPLCKNRYSMVHPYRQANLPEKKWERRCS

SEQ ID NO: 44 - protein, 169 aa, Acidmicrobiaceae bacterium A6
  MISC_FEATURE (1)..(169): FMO enzyme, ERCFMO_0016
WDFWLDWKDREFWPTFTPVLLITFPAAVQYVLWTYFRLPIGATLCCLGLLIGEWIVRIHGFHIWAWFPFTLIWPATMLPGAIALDLVLMLSGNFIMTGIFGGMLFALLFYPGNWPMLAAYRLPLEHIGSLLTVGDLIGYVYPRSSMPEYLRIIERGTLRTFGGHSAVVA

SEQ ID NO: 45 - protein, 169 aa, Acidimicrobiaceae bacterium A6
  MISC_FEATURE (1)..(169): FMO enzyme, ERCFMO_0017
DWHVRPIVAGIEPCTLDTDWKDRRLWATVGTCEPAPSWLYFPCSCANGMRGRSTSAAGHISQLTSASLHNSFLALSFLTVLDVVLLLSNSFTFSQTLLPAIAGAMGWGSHFLPKQLAGYRAIARAGRIMRYESSLWLTYKVTTMPEPVLLSTSVSSSEAPYDQVGKTLL

SEQ ID NO: 46 - protein, 169 aa, Acidimicrobiacea bacterium A6
  MISC_FEATURE (1)..(169): FMO enzyme, ERCFMO_0018
ADWDFWTDWKDRRLWVTVAPIVSITFPAAVQACLWWRYRLPIGATVSVVALMLGEWINRYMNFWGWTYFPVNICFPSNLLPGAIVLDVVLMLGNSMTLTAVVGGLAYGLLFYPGNWPIIAPLHVPVEYNGMMMTLADLQGYHYVRTGTPEYIRMVEKGTLRTFGKDVAP

SEQ ID NO: 47 - protein, 169 aa, Acidimicrobiaceae bacterium A6
  MISC_FEATURE (1)..(169): FMO enzyme, ERCFMO_0019
GDWDFWSDWKDRRLWVTVTPMVLVTFPAAVQSYLWNRYRLPWGATVCVLGLLLGEWINRYFNFWGWTYFPINFVFPASLVPGAIILDTVLMLSGSYLFTAIVGAMGWGLIFYPGNWPIIAPLHVPVEYNGMLMSIADIQGYNYVRTGTPEYIRMVEKGTLRTFGKDVAP

SEQ ID NO: 48 - protein, 156 aa, Acidimicrobiaceae bacterium A6
  MISC_FEATURE (1)..(156): FMO enzyme, ERCFMO_0020
DWDFWADRKDRRLWVTVYPIVMITFPAAVQAVIWERMRLPWGATVCILGILFEEWVNRYFNFWMWTYFPINFVSPTAAVHMAISLDVVLMQSGSFLSTAVIGGLGWGLLMYPGNWSIIAPLPVPVEYNGMLMSIADIHGYQYVRTGASGYIRMVDD

SEQ ID NO: 49 - protein, 171 aa, Acidimicrobiaceae bacterium A6
  MISC_FEATURE (1)..(171): FMO enzyme, ERCFMO_0021
GDWDFWLDWKDRQWWPVVTPIVGIAYCAAIMYYLWVNYRLPYGATLCIVCLLVGEWLTRFWGFYWWSHYPINFVFPSTMIPGALVMDTVLLLTRNWMITALIGGGAFGLLFYPGNWPIFGPTHLPLVAEGVLLSVADYTGFLYVRTGTPEYVRLIEQGSLRTFGGHTTAIG

The invention claimed is:

1. A reactor for ammonium oxidation comprising: a medium including an ammonium component and a Feammox bacterium and/or enzyme(s) thereof capable of oxidizing ammonium coupled with electron transfer to an anode in contact with the medium, wherein the Feammox bacterium colonizes the anode.

2. The reactor of claim 1, wherein the medium does not comprise Fe(III).

3. The reactor of claim 1, wherein the anode comprises metal, alloy or electrically conductive carbon material.

4. The reactor of claim 3, wherein the electrically conductive carbon material comprises graphite.

5. The reactor of claim 1, wherein the electrically conductive carbon material is provided in granular form.

6. The reactor of claim 1 further comprising a cathode.

7. The reactor of claim 6, wherein the cathode is spaced apart from the anode by a separator.

8. The reactor of claim 1, wherein the medium further comprises an electron shuttling compound.

9. The reactor of claim 1 further comprising a power source for application of a potential to the anode.

10. The reactor of claim 1, wherein the medium is aqueous-based.

11. The reactor of claim 1, wherein the medium is wastewater.

12. The reactor of claim 1, wherein the medium is soil.

13. The reactor of claim 1, wherein the medium further comprises one or more contaminants selected from the group consisting of fluorochemicals, chlorinated volatile organic compounds, perchloroethylene (PCE), trichloroethylene (TCE), trichloroethane, dichloroethane, vinyl chloride, polychlorinated biphenyls, fuel constituents, benzene, ethylbenzene, toluene, xylene, phenanthrene, methyl tert butyl ether, tertiary butyl alcohol, polyaromatic hydrocarbons, ethylene dibromide, and inorganic species.

14. The reactor of claim 13, wherein the fluorochemicals comprise perfluoroalkyl compounds, polyfluoroalkyl compounds, fluorinated carboxylic acids, fluorinated alcohols, fluorinated sulfonates or mixtures thereof.

15. The reactor of claim 1, wherein the Feammox bacterium is an Actinobacterium or variant thereof.

16. The claim 15, wherein the Feammox bacterium is an *Acidimicrobiaceae* bacterium or variant thereof.

\* \* \* \* \*